(12) United States Patent
Gasiunas et al.

(10) Patent No.: US 12,264,328 B2
(45) Date of Patent: Apr. 1, 2025

(54) GENE EDITING COMPONENTS, SYSTEMS, AND METHODS OF USE

(71) Applicant: ReNAgade Therapeutics Management Inc., Cambridge, MA (US)

(72) Inventors: Giedrius Gasiunas, Vilnius (LT); Alim Ladha, Cambridge, MA (US); Vladimir Presnyak, Cambridge, MA (US); Muthusamy Jayaraman, Cambridge, MA (US); Elisabeth Narayanan, Cambridge, MA (US)

(73) Assignee: ReNAgade Therapeutics Management, Inc., Cambridge, MA (US)

( * ) Notice: Subject to any disclaimer, the term of this patent is extended or adjusted under 35 U.S.C. 154(b) by 0 days.

(21) Appl. No.: 18/481,393

(22) Filed: Oct. 5, 2023

(65) Prior Publication Data

US 2024/0141382 A1    May 2, 2024

Related U.S. Application Data

(63) Continuation of application No. PCT/US2023/070339, filed on Jul. 17, 2023, which is a continuation-in-part of application No. 18/297,346, filed on Apr. 7, 2023.

(60) Provisional application No. 63/495,198, filed on Apr. 10, 2023, provisional application No. 63/368,728, filed on Jul. 18, 2022, provisional application No. 63/368,737, filed on Jul. 18, 2022, provisional application No. 63/368,736, filed on Jul. 18, 2022, provisional application No. 63/368,730, filed on Jul. 18, 2022, provisional application No. 63/368,731, filed on Jul. 18, 2022, provisional application No. 63/368,744, filed on Jul. 18, 2022, provisional application No. 63/368,724, filed on Jul. 18, 2022, provisional application No. 63/368,734, filed on Jul. 18, 2022, provisional application No. 63/368,735, filed on Jul. 18, 2022, provisional application No. 63/368,722, filed on Jul. 18, 2022, provisional application No. 63/368,726, filed on Jul. 18, 2022, provisional application No. 63/368,742, filed on Jul. 18, 2022, provisional application No. 63/368,738, filed on Jul. 18, 2022, provisional application No. 63/368,741, filed on Jul. 18, 2022.

(51) Int. Cl.
*C12N 15/11* (2006.01)
*C12N 9/22* (2006.01)
*C12N 15/86* (2006.01)

(52) U.S. Cl.
CPC ............... *C12N 15/86* (2013.01); *C12N 9/22* (2013.01)

(58) Field of Classification Search
CPC ....... C12N 2310/20; C12N 9/22; C12N 15/11
See application file for complete search history.

(56) References Cited

U.S. PATENT DOCUMENTS

2023/0340538 A1* 10/2023 Maresca ................. C12N 9/22

FOREIGN PATENT DOCUMENTS

| WO | 2020/142754 A2 | 7/2020 |
| WO | 2021/092130 A1 | 5/2021 |
| WO | 2021/178933 A2 | 9/2021 |
| WO | 2021/178934 A1 | 9/2021 |
| WO | 2023/056291 A1 | 4/2023 |

OTHER PUBLICATIONS

Paul et al., CRISPR-Cas12a: Functional overview and applications, Biomedical Journal, vol. 43, pp. 8-17. (Year: 2020).*
Xiaosa Li, et al., Base editing with a Cpfl-cytidine deaminase fusion, Nature Biotechnology (Mar. 19, 2018) vol. 36, No. 4, p. 324-327.
Invitation to Pay Additional Fees with Partial International Search Report dated Nov. 24, 2023 in International Application No. PCT/US2023/070339.

* cited by examiner

*Primary Examiner* — Dana H Shin
(74) *Attorney, Agent, or Firm* — Duane Morris LLP; Thomas J. Kowalski

(57) ABSTRACT

The present disclosure provides methods and compositions comprising Cas TypeV programmable nucleases and lipid nanoparticles capable of delivering the Cas TypeV programmable nucleases and genome editing systems comprising same.

16 Claims, 79 Drawing Sheets
Specification includes a Sequence Listing.

SEQ ID NO:13

SEQ ID NO:14

SEQ ID NO:15

SEQ ID NO:28

SEQ ID NO:29

SEQ ID NO:40

SEQ ID NO:41

SEQ ID NO:53

SEQ ID NO:54

SEQ ID NO:69

SEQ ID NO:70

SEQ ID NO:71

SEQ ID NO:92

SEQ ID NO:93

SEQ ID NO:94

SEQ ID NO:95

SEQ ID NO:112

SEQ ID NO:113

SEQ ID NO:114

SEQ ID NO:126

SEQ ID NO:127

SEQ ID NO:291

SEQ ID NO:292

SEQ ID NO:293

SEQ ID NO:294

SEQ ID NO:295

SEQ ID NO:296

SEQ ID NO:297

SEQ ID NO:298

SEQ ID NO:299

SEQ ID NO:300

SEQ ID NO:301

SEQ ID NO:302

SEQ ID NO:303

SEQ ID NO:304

SEQ ID NO:305

SEQ ID NO:306

SEQ ID NO:307

SEQ ID NO:308

SEQ ID NO:309

SEQ ID NO:310

SEQ ID NO:311

SEQ ID NO:312

SEQ ID NO:313

SEQ ID NO:314

SEQ ID NO:315

SEQ ID NO:316

SEQ ID NO:317

SEQ ID NO:318

SEQ ID NO:319

SEQ ID NO:320

SEQ ID NO:321

SEQ ID NO:322

SEQ ID NO:323

SEQ ID NO:324

SEQ ID NO:325

SEQ ID NO:326

SEQ ID NO:327

SEQ ID NO:328

SEQ ID NO:329

SEQ ID NO:330

SEQ ID NO:355

SEQ ID NO:356

SEQ ID NO:357

SEQ ID NO:358

SEQ ID NO:359

SEQ ID NO:360

SEQ ID NO:380

SEQ ID NO:381

SEQ ID NO:382

SEQ ID NO:394

SEQ ID NO:395

SEQ ID NO:423

SEQ ID NO:424

SEQ ID NO:425

SEQ ID NO:426

SEQ ID NO:427

SEQ ID NO:428

SEQ ID NO:542

SEQ ID NO:543

SEQ ID NO:544

SEQ ID NO:545

SEQ ID NO:546

SEQ ID NO:547

SEQ ID NO:548

SEQ ID NO:549

SEQ ID NO:550

SEQ ID NO:551

SEQ ID NO:552

SEQ ID NO:553

SEQ ID NO:554

SEQ ID NO:555

SEQ ID NO:556

SEQ ID NO:557

SEQ ID NO:558

SEQ ID NO:559

SEQ ID NO:560

SEQ ID NO:561

SEQ ID NO:562

SEQ ID NO:563

Target gene = TTR

Target gene = PCSK9

Target gene = CISH

Target gene = TTR

Target gene = TTR

Target gene = HBG1

Target gene = BCL11a

Target gene = HBG1

Target gene = PCSK9

Target gene = CISH

Target gene = CISH

Target gene = BCL11a

FIG. 31

```
SEQ ID NO:1     ------------------------------------MEELMTNPSDPT---G  12
SEQ ID NO:3     ------------------------------------------MKEPT---N   6
SEQ ID NO:436   ----------------------------NNTNTQRSPVSGGKNEEGQKSVPDSPT---R  28
SEQ ID NO:442   ---------------------------------------MNIYSNPT---N   9
SEQ ID NO:564   -------------------------------------NKAELPKIPV---D  11
SEQ ID NO:1385  ----------------------------------------MSKLSKPT---N   9
SEQ ID NO:447   -------------NIIY-------------NCYIGGSPMKKIDSPT---N  21
SEQ ID NO:57    ----------------------------------------MKEQFI---N   7
SEQ ID NO:74    ----------------------------------------MKEQFI---N   7
SEQ ID NO:59    ----------------------------------------MKEQFI---N   7
SEQ ID NO:118   ----------------------------------------MNSIEQPT---G   9
SEQ ID NO:119   ----------------------------------------MNDLSQPT---G   9
SEQ ID NO:440   ---------LPNLYSCLIEYILNQITIP----------TNKNRNRNMENDNLPT---N  38
SEQ ID NO:446   ----------------------------------------MKRLIDFT---N   9
SEQ ID NO:32    ----------------------------------------MKNLKEPS---N   9
SEQ ID NO:33    LCSIFAHMAINFARSIKFYYLCI-----------INIKKILNMECLKDFY---N  40
SEQ ID NO:20    ----------------------------------NKNRDVVFEDPT---K  14
SEQ ID NO:445   ----------------------------------------MPNISEFS---B   9
SEQ ID NO:331   -----------------LLFI-----------IBFEEKINKTIENFCGQKN  23
SEQ ID NO:333   ----------------------------------------MKTIDSPCGQNE  12
SEQ ID NO:334   ---------------------------------------MARIIDEFCGQN  13
SEQ ID NO:335   ----------------------------------------MATIENFCCQEN  12
SEQ ID NO:336   ----------------------------------------MTTINKFCGQSN  12
SEQ ID NO:448   -------------------LLPAR-PCNGAVPHIPHTDNRATPGRSMSLGSPT---R  34
SEQ ID NO:386   ---------------------------------LRGKMAKNTIFSKFT---B  16
SEQ ID NO:387   -----------------LSLFVAKNGYIKK--NTILRGKMAKNTIFSKFT---G  32
SEQ ID NO:399   ----------------------------------------MKDLKQFI---G   9
SEQ ID NO:400   ----------------------------------------MYDLKQFI---G   9
SEQ ID NO:401   ----------------------------------------MKDLKQFI---G   9
SEQ ID NO:402   ------------MLNLNYYLFYFVSLN-QONBYLKP----ITSNLKQFI---G  34
SEQ ID NO:403   ----------------------------------------MKILKQFI---G   9
SEQ ID NO:404   ----------------------------------------MKDLKQFI---G   9
                                                                      *

SEQ ID NO:1     LPSLSKTLRFELKPVGKTKEFPKQWLENNRST----NBESNLLAKDKKINSYLALKPVN  69
SEQ ID NO:3     LYQLSKTLRFELKPIGKTAKFFPWLEENNKAELVGINDGMLFLRDKRIKNAYLAIKPIN  66
SEQ ID NO:436   KYALSKTLRFELVPQGKTSESLK-------------AVFEEDKKVEENYQKTVRL  71
SEQ ID NO:442   NYQVNKTIRMGLKPICKTDENIA-------------KFLEEDKEPSEKYRIAKKII  52
SEQ ID NO:564   EYPVSKTLRFSLIPVGRTLENIE-------------KDGILDCDEKRSEEYKPVKKLL  56
SEQ ID NO:1385  CYSLSKTLRFEAIPVGKTQENID-------------NKPLLVEDEKRAEDYKGVKRLL  54
SEQ ID NO:447   CYSLSKTLRFELPIGATQSNFD-------------LNKMLDEDKRAENYSKAKSII  66
SEQ ID NO:57    PYSLSKTLRFSLIPVGKTENNFN-------------KNLLLKRDKQRAENYKRVKGYI  52
SEQ ID NO:74    CYFLSKTLRFSLIPVGKTEINPN-------------KKLLLEEDKQRAENYENVKSYI  52
SEQ ID NO:59    CYFLSKTLQFSLIPVGKTDNFN-------------KKLLLERDYQRAENYEKVKGYI  52
SEQ ID NO:118   LYSLSKTLRFELKPIGRTQENIE-------------KNGILERDNERAVAYKSVKKYI  54
SEQ ID NO:119   LYSLSKTLRFELKPIGRKTLENIE-------------KNGILERDKRRSIGYKSIKKVI  54
SEQ ID NO:440   NYQVSKTLRFRLEPTGGTDDLLK-------------QAQLIENDERRNKEAYTMKQIL  83
SEQ ID NO:446   IYQPSKTLRFRLEPIGKTADYIK-------------VSQYLETDERLAEKSRKVKELA  54
SEQ ID NO:32    LYFVQKTLRFKLEPIGKTREFIE-------------RAQYLENDERRAPEYLKVKEYI  54
SEQ ID NO:33    QYSVQKTLRFKLEPVGRTEEFIE-------------RAQVLENDERRAEYKRVKDLI  85
SEQ ID NO:20    QYQVSKTLRFELIPQGRTLENME-------------RAGIVKDCQRSEDYQEAKKII  59
SEQ ID NO:445   BPQKTLTLRMELVPVGKTLENLI-------------SSNYLLNDERKSEDYKMAKETI  54
SEQ ID NO:331   GYSPSITLRNKLIPIGRTEENIE-------------KLQLLONDIKPSKAYVSVKSMI  68
SEQ ID NO:333   GYSPSITLRNKLIPIGETERNIR-------------BPLRKDVERSEAYPQIKKLI  55
SEQ ID NO:334   GYSPSITLRNKLVPIGKTEENLR-------------QPLEKDLERATAYPDIKNLI  56
SEQ ID NO:335   GYSPATTLRNKLIPIGKTANNLR-------------QPLEKDQERADVYPEIKKLI  55
SEQ ID NO:336   GYSPATTLRNKLIPIERTANNLR-------------QPLEKDQERADGYPEIKKLI  55
SEQ ID NO:448   KYKLAKTLRFELRPVGRTLEFPR-------------SKFLPCDERRAAAYFGAKEML  78
SEQ ID NO:386   LYFVSKTLRFELKPIGKTLEKIK-------------ENGIIDRDYNKADNYVDAKKYI  61
SEQ ID NO:387   LYFVSKTLRFELKPIGQTLEKIK-------------ENGIIDRDNKADNYVDAKKYI  77
SEQ ID NO:399   LYFVSKTLRFELKPIPVGRTQENME-------------RNKVLERDGKRAEDYPPVKELI  54
```

```
SEQ ID NO:336   QSGARKKIVEAFKRH---------------PDYDKLF--K-----------D-----GLF   130
SEQ ID NO:448   QAVFRKALADRLTRD---------------PSYKTL---T-----------AATPR-DLF   155
SEQ ID NO:386   QKTFRKIAERLAAH---------------PRFKEL---T-----------ATTRK-DLF   135
SEQ ID NO:387   QKTFRKIAERLAAH---------------PRFKEL---T-----------ASTPK-ELF   151
SEQ ID NO:399   QTRNRLEICKELARF---------------ERYQELV--K-----------ADTPS-KLI   129
SEQ ID NO:400   QTRNRNKIRDQLSEF---------------ERYRKL---N-----------ADTPS-LLI   128
SEQ ID NO:401   QTRNRKRIATAIKDF---------------RRYRKL---T-----------AATPS-DLI   128
SEQ ID NO:402   QTMNRKQIAAAIKDF---------------RRFKEL---T-----------AATPS-DLI   153
SEQ ID NO:403   QALMRKQIALVIKDF---------------RRYRKL---T-----------TPTPQ-KLI   128
SEQ ID NO:404   QTNNRKQIAAAIKDF---------------RRFREL---T-----------APTPQ-KLI   128

SEQ ID NO:1     DRKMLKYLSAFVQ--ELAEQNGV-----D------EQTLKGHLEQFKGFWGYLDGYNQRE   196
SEQ ID NO:3     DRKMYNYLSABVR--DLAEQNGT-----D------EQKLKHIEQFKGFWGYLDGYNQRE   197
SEQ ID NO:436   DEAVLRITLMR-------------------FAEDTQVFSTFPGFFTYFSKFNEFRE     206
SEQ ID NO:442   ------YITDR---------------------EDTEILEYFKKFTTFFTGFSNRE     142
SEQ ID NO:564   EKELVDFLNGR---------------------DSDVELVKSFKGVAIMFQGFWDARK   164
SEQ ID NO:1385  ETILPEFLDKN--------------------DEIALVNSFNGFTTAFTGFFDNRE    159
SEQ ID NO:447   KKTLPEFLESD--------------------ADKEIIAEFDGFSTYFTGFYNNRK    179
SEQ ID NO:57    CEDLPSFLTDR--------------------DERETVECFRSFTTYFNGFNTNRK    157
SEQ ID NO:74    CEDLPAFLTDR--------------------NERETVECFRSFTTYFNGFNTNRK    157
SEQ ID NO:59    CEDLPSFLTDR--------------------RERETVECFRSFTTYFKGLSTNRE    157
SEQ ID NO:118   QEDLAEFVNIALFETYIRSQKGNNLIEEEVRQIQERTIREISLFRNFTVFSGYNENRK  195
SEQ ID NO:119   REDLTEFVNTPLFEQYILSQKGNEDLSTDDVRHIQEDVIEDIAQFRDFTTYFSGFYENRR  195
SEQ ID NO:440   ERGLIKYASN---------------------EKERNIVSRFKGFATYFTGFTNRL    190
SEQ ID NO:446   TDTLPKFLQDR--------------------DDDIKIVNRFGFTTYFYAFRKNRD    160
SEQ ID NO:32    KEDLPKFLKDR--------------------N-EKEIVSHFDEFTTYFTGFQNRN    166
SEQ ID NO:33    YTDLKQFLTDR--------------------N-EIDIVSHFANFTTYFTGFRQNRN    197
SEQ ID NO:29    CAAFFEIDLTD--------------------E-------EKAILDKFKKFTTYFTGFENRK  175
SEQ ID NO:445   DFLLPNFIKNN--------------------E-------GRKIISSFNKFTSYFTGFYENRK  176
SEQ ID NO:331   TEPVPTVIKAD---------------ESGTI-SDKRAALDVFKGFATYFTGFRQNRQ  184
SEQ ID NO:333   KELLFQLIKSA---------------FVTEI-ADKEKALSVFTRFSTYFNGFRENRK  171
SEQ ID NO:334   KELLPELIKSA---------------PVDEI-AVKTKALECFNRFSTYFTGFWDNRK  172
SEQ ID NO:335   KELLPALIKNS---------------SDSEI-SRKEEALKVFDRFSTYFVGFRENRK  171
SEQ ID NO:336   KELLPALIKNS---------------SDSEI-SRKEEALKVFDRFSTYFVGFRENRK  171
SEQ ID NO:448   KALKARCESA-------------------G-QPVPGDLQTFLRFSCYFKGYQENRR  191
SEQ ID NO:386   KNILFDNFG----------------------NDESIESFKGFSTYFKGFQENRQ    167
SEQ ID NO:387   ERTLPNHFG----------------------KEESVEAFKRFSTYFKGFQENRK    183
SEQ ID NO:399   NGILPN---------------------------DKALDTFNKFAVFEGFQENRR    157
SEQ ID NO:400   NHILPQ----------------------------EDALESFKKFATYFEGFQNRK    156
SEQ ID NO:401   TSVLPEF-S-------------------------DNEALKSFRGFASYFIGFQENRN   159
SEQ ID NO:402   TSVLPEF-S-------------------------DDDSLKSFRGFATYFSGFQENRI   154
SEQ ID NO:403   DNVFPSI-Y-------------------------ESDALKSFNRFAVYFKGFQENRN   159
SEQ ID NO:404   DDVFPQI-Y-------------------------EDEALKSFNRFALYFRGFQDNRN   159

SEQ ID NO:1     NYYEYEKEASTAVATRIVHENLPTFCSKVLPFENR-KDEY---LGIYQYLKDKNPETKIFN  255
SEQ ID NO:3     NYYEVDKEASTAVATRIVHENLPTFCSNAMPFEKR-KDEY---LCIHRYLKDNSPETKIFN  254
SEQ ID NO:436   NFYKSD-GDSTAVATRVV--BRLRKFLRNKRIVESEYRKV-----------------F    247
SEQ ID NO:442   NVYSRE-DISTSIGHRIIHENLPKFISNFRILNKAIEA-----------LGTGKINEDFRN   191
SEQ ID NO:564   NIFSDE-SKSTAIAYRIINENLPKFISNKNIYFTKIQPEN-DAELDQ-LTL-------G   213
SEQ ID NO:1385  NMFSEE-AKSTSIAFRCINENLERYISNMDIFEKVDAIFD-KHEVQE-IKEKILNS----   212
SEQ ID NO:447   NMYSAD-DQSTAISHRCINDNLPKFLENVRTFKNSDVANI-LEN-------NLKILNEDFDG   232
SEQ ID NO:57    NMYSSD-SKSTAIAYRCINDRLPRFLENVKSFQRV-FDNL-SDE-------TITKLNTDLYN   209
SEQ ID NO:74    NMYSSE-SKSTAIAYRCVNDRLPRFLENVKSFQRI-FDNL-SDE-------TITKLNTDLYN   209
SEQ ID NO:59    NMYSSD-SKSTAIAYRCINDRLPRFLENVKSFQRV-FDNL-SDE-------TITKLNTDLYN   209
SEQ ID NO:118   NMYVAD-DKATSIANRMITENLPKFVDMEVP-GKIAASE-VAN-------HFETLYKGMEA   247
SEQ ID NO:119   NMYVAD-DKATSIANRLIMENLPKFIDNIDVP-ERIAQSE-VSG-------NLETLCKEMEA   247
SEQ ID NO:440   NMYSEE-AKSTAISFRLINQNLIKFIDRILVY-RKVGQTL-PSD-------MLSNIYIDFKA   242
SEQ ID NO:446   NMYVSE-SKSTAIPYRIVNQNLVKYFSNYKTFRKKVMPLLKDKN----IVESIERDFKD   214
SEQ ID NO:32    NMYTAE-AKSTSIAFRLINQNLVKFVDNSNIL-EKVFPVL-GKD-------IIAQLDSDFEP   216
SEQ ID NO:33    NMYSVE-AKSTSISFRLINQNLVKCVDNSKIL-EKVRPAL-GAD-------IFSKLNHDFEP   249
SEQ ID NO:29    NIFTDE-GISTSFTYRLVNDNFIKFYDNCLYRDI-IASV---PG-------LKGEFKKCFKD   226
SEQ ID NO:445   NLYTSA-PLFTAVAYRIVNDNFPKFISNQKIFRVN-KDNV---PK-------FVEIAKTKLFE   229
```

FIG. 31 (Cont'd)

```
SEQ ID NO:331    NMYSEE-AKATAISNRIVNENFPKFYARVKVFECL-QKEY--PA-----ITRETEALSE    235
SEQ ID NO:333    NMYSEE-SISTGIAYRIVNENFPKFPSRIKLFEYL-KDNF--PE-----ITKETEISLED   222
SEQ ID NO:334    NMYSEE-AKSTAISYRIVNENFPKFYARIKLFNYL-KERF--PR-----ITIDTEESLED   223
SEQ ID NO:335    NMYSEE-DKSTAISYRIVNENFPKFYARVKLYNYI-KENF--PK-----ITSETEESLEN   222
SEQ ID NO:336    NMYSEE-EKFTAISYRIVNENFPKFYARVKLYNYL-KENF--PQ-----ITSETEESLEN   222
SEQ ID NO:449    NIYSDK-AQATAAANRAVKGNFPRFLEDVRIFSRI-AERY--PQ-----IPADAARELAF   242
SEQ ID NO:386    NIYSAE-AISTGVPYRIVHDNFPKFSRIETFQRI-QKRC--LS-----VLTDAETELEK    218
SEQ ID NO:387    NIYSAD-AISTGVPYRIVHDNFPKFSRIETFQRI-QKRC--PS-----VLTNAETELEK    234
SEQ ID NO:399    NIYSEE-AISTGVAYRIVHDNFPKFSRIEVFERI-KEIC--PE-----VIQQVATEMAF    208
SEQ ID NO:400    NIYSEE-AISTGVPYRIVHDNFPKFLARIEVFERL-QELC--PE-----VTRQAATEMAF    207
SEQ ID NO:401    NIYSPD-AISTGVPYRIVHDNFPKFLSRLEVYDRI-KATC--PE-----VIQQASEELQF    210
SEQ ID NO:402    NIYSQE-SISTGVPYRIVHDNFPKFLSNQEVYDRI-RSVC--PE-----VTKQASEELQF    235
SEQ ID NO:403    NIYSSD-AISTGVPYRIVHDNFPKFLADIEVFERI-KTRC--PE-----VTEQAASELQF    210
SEQ ID NO:404    NIYSRE-AISTGVPYRIVHDNFPKFLADIEVYERI-KATC--PE-----VTEQVAVEMQF    210
                         *   :          *    *  *  * :      ;

SEQ ID NO:1      SKQEEVDAKAISESVFQIKRFNECLTQFQIEEYNRIIGNYNLL-------------INLYN    303
SEQ ID NO:3      TKGEEIDVEAISDRIFQIKRFNECLAQSQIEEYNRIIGNYNML-------------INLYN    302
SEQ ID NO:436    A----IGLTDSEILALTUVEAYRCFLQAGIDVYRTVLGGSTEL-----EQSVNKKVNEYR    299
SEQ ID NO:442    -----NEINVTVEELNEIDYFNKVLTQSGIDLYNNLIGI------------LNQNINLYN    294
SEQ ID NO:564    -----NNSNEIRDIFFLEYFSKTIFTQFGIEIYRGILGGYTIDEQ-VRLQGINEIVNLRN    266
SEQ ID NO:1398   --------DYDVEDFFEGEFFNFVLTQRGIDYNAIIGSPVTESG-ERIKGLNEYINLYN     263
SEQ ID NO:447    -------IYGTSAEDVFRVDYFPFVLSRGIEAYRSILGGYTRSIG-SRIKGLNEYIYLYN    336
SEQ ID NO:67     -------IFGRNIEDIFSVDYFSRFVLAQSGIEIYRSMIGSYTCSER-TRIQGLNEYINLYN    362
SEQ ID NO:74     -------IFGRNIEDIFSVDYFSDFVLTQSGIDIYRYMIGSYTCSIG-TRIQGLNECINLYN    262
SEQ ID NO:59     -------TFGRNIEDVFSVDYFSRFVLAQSGIDIYRSMIGSYTCSIG-TRIQGLNECINLYN    262
SEQ ID NO:118    -----YLNVISIEENFRLDYYFILLTRQIDVYNTIIGGKVLEIG-SRIQGLNEYVNLYN    301
SEQ ID NO:119    -----YLNVNSIAEIFCLDYFSRVLTQRQIDVYRAIIGSRSLEIG-TRIKGLNYYVNLYN    301
SEQ ID NO:440    -----IINTSSLEEFFSINRYNRILTQRQIEIFRAVIGGKKDKEKIITKGFNQYINEYN    297
SEQ ID NO:446    -----ILNEKSIEDVFGLAEFTRTLCQADIEKYRTLIGGLVVKNEKKEIKGINQYINEEN    269
SEQ ID NO:32     -----FLNVDSALDLFKIDSYNEVLTQLQIELYRAIIGGRVDEGRNKVEIKGLNQYINEFN    273
SEQ ID NO:33     -----FLNVVDALDLFKEVERNYEVITQFQIELYRAIIGGRVDNESKVEIKGLNQYINEYN    304
SEQ ID NO:29     L---QLFSKCRLEEIFETSFYNRILTQDGIDEFRQLLGGISAKEGEKKQGLNEVINLAN    303
SEQ ID NO:445    -----NGISDLNLEFQFELSRFNSCLRQTGIDSYRELIGQLNFA--------------INLEC   273
SEQ ID NO:331    -----ILNGKKLADIFSAIGFNSVLSQSGIDFYNTIIGGIAGEAGTQKLQGINEKINLAR   290
SEQ ID NO:333    -----TLKGKELCDIFFEVEAFNSRVLSQSGIDFYRTIISGVAGEGGTQKIKGNNEFINLAK    277
SEQ ID NO:334    -----YLKGKELESVFSIIDGFNSVLAQSGIDFYRTVIGGISGEAGTKKTQGLNEKINLAK    276
SEQ ID NO:335    -----HLNQKRLEEIFRAESFNDVLAQSGIDFYNTVIGGISTE--TERVQGLNEKINLAR   275
SEQ ID NO:336    -----HLNEKRLEEIFRVESFNDVLAQSGIDFYRTVIGGISTE--TERVQGLNEKINLAR   275
SEQ ID NO:449    -----LLSGRTLDSIFTPAAYNGFLAQSRIDFYRSVLGGFVPA-EGEETRGINEFVNLYR    296
SEQ ID NO:386    -----LLNGQKLVEIFNIDFFNSVVTQEGIDFFRQIIGGYTIE--NNTRIKGINEFANLYR    272
SEQ ID NO:387    -----LLNGQRLAEIFNIVFFNSIITQEGIDFRQIIGGYTIE--NNKIRGINEFTNLYR    296
SEQ ID NO:399    -----FLEGVMIEDVFTVSYYNAVLTQNGIDYYNQILGGVAK--DDQKYRGINQFINLYR    261
SEQ ID NO:400    -----FLQGVMIEDVFTVGFYNAILTQNGIDFYNQILGGSVVK--DEQHYRGINQLTNLYR    260
SEQ ID NO:401    -----FLEGVMIEDIFSLDFYNSLLTQDGIDFYNRVIGGVSEE-DKQKYRGINEFSNLYR    264
SEQ ID NO:402    -----FLEGVMIEDIFSLDFYNSLLTQDGIDFYSRVIGGVSEE-GKQKYRGINEFSNLYR    299
SEQ ID NO:403    -----FLEGVMIEDIFTIDFYNSLLTQDGIDFFNQVLGGVASE-GKQKYRGINEFSNLYR    264
SEQ ID NO:404    -----FLEGVMIEDIFTLDFYNSLLTQDGIDFFNQVLGGVASE-GKQKYRGINEFVNLYR    264
                       :   .  *     *; :* ::.

SEQ ID NO:1      QAFREEAG----FKKIDEFETLYKQIGGKKKSMFET--LQNDSDVKELLGSAKMAGDVMF    356
SEQ ID NO:3      QLFRGEKD----FKKIDEFEKLSKQIGGKKKSMFET--LQGDSDVKRLLLKASDAGKQMF    357
SEQ ID NO:436    QKF---------GNKISFLAKLNRQILSEKINFEMLV--IKGDAQLWEKLKVFSEENVAYC    349
SEQ ID NO:442    QQQ---KVK---KNKIGKLETLNRQILSEKEFVSFIE-EFAEDNQLLSCILSYFYEKGCLI    298
SEQ ID NO:564    QK----SKD---GGKIFKLNSLYKQILSEKGFETDOEVLESLNIFYDVSNENI          320
SEQ ID NO:1385   QKF-------KQKLFKFKFLYKQYLSDRESLSFYSECYTSDEVLEVFRNTLMKNS---    312
SEQ ID NO:447    QK-----NGN--IRRIFFNKLFKQILSEBREGVSFIPEKFDSDDFVLSSINDYYLERDSGK    339
SEQ ID NO:67     QQISRNEK----SKRLFLIKPLYKQILSEKDGVSFIPEKFNSDNEVLLAIIDYYNNHIGDF    319
SEQ ID NO:74     QDVAKNEK----SKRLFLNKPLRKQILSEKGVSFIPEKFNSDNEVLLAIEYYNNHISDI    319
SEQ ID NO:59     KQDAKNEK----SKRLFLMKPLYKQILSEKIGVSFIPEKFNSDNEVLLSIEDYYSSHIGDL    319
SEQ ID NO:118    QQQ---KDK----ANRLFKLKPLFKQILSEENAISWLFQTFSTQNEMLESIEKCYQNLRTQ-   355
SEQ ID NO:119    RKQ---KEK----TCRLFKLKPLFKQILSEBNAISWLFDEFTSDKELLESIEKCYQDLKNS-   355
SEQ ID NO:440    QTN----K----NIRLFKMMRLFKQIILSDREGVSARPEPFNNANEITISSVRDCFTNEISK-   349
SEQ ID NO:446    QTG---KK----GNGIFKLKPLFKQILSDRKGLSFTLDDIKKTSEAIRTIKDEYENLREK-   322
```

FIG. 31 (Cont'd)

```
SEQ ID NO:32     QTR---EK---SLRIPELKPLFRQILSENVGVSPRMEQFTDASQVQTAIKEEYTKLESS-    326
SEQ ID NO:33     QTR---SK---QERLPELKPLFRQILSREQVSPRIEQFEKANQVQEAINEAYRDLHAR-    357
SEQ ID NO:29     QKDEGIRNKLR-YRAHKFTPLFRQILNDKSTLSPIPETFENDRKVL-ESIEAYKLYL---  338
SEQ ID NO:445    QQDKNLSELLRKKRSLINIPLYRQILSDKDSS-PCIDEFENDKSAINDVISFYKKAV---  329
SEQ ID NO:331    QQLPTEEK---NKLRENSVLYKQILSDRSTASPIPTGFESSDEYYESVKQFYEQSL---   344
SEQ ID NO:333    QQLPKEEK---DKLRGNVVLFKQILSDRETASPIPTGFEKREEVYASIKEFYNRITV--- 331
SEQ ID NO:334    QQLSKEEK---NKLRGNVVLFKQILSDRETSSPIPVGFANKEEYYSTVKEFYNRSIA--- 332
SEQ ID NO:335    QKLPAEEK---NKLRGENVVLFKQILSDRGTSSPIPVGFNNREEVYSSVKSFNDEFY--- 329
SEQ ID NO:336    QKLPAEEK---NKLRGENVVLFKQILSDRGTSSPILVDFNNKEEVYSSVKSFNDEFY--- 329
SEQ ID NO:448    QRREDARE---DRALAFLRPLRQILSDRESESLVPRNFENDGAVSAIRNMLDKRLLAL   353
SEQ ID NO:386    QQRPEPAK---LRIATRNIPLYKQILSDRDNSPILEPFKDASQVQSAVKDFYEDRILRY   329
SEQ ID NO:387    QQRPEPAK---QRIATRNIPLYKQILSDRESNSPILEPFKDASQVQSAVKDFYEDRILRY  345
SEQ ID NO:399    QARPELAT---KKESLTNVPLFKQILSDRETLSDIVRPVESEKQLIEVINRFY-QRITRF  317
SEQ ID NO:400    QARPDLTA---NRESMTNVPLFKQILSDRETLSDIAKPIESEEQLIEVVTSFY-NRVTDF  316
SEQ ID NO:401    QQRKELAG---SKRALTNIPLFKQILSDRDTLSYIPAQIETENELNTSISQFY-KRITYF  320
SEQ ID NO:402    QQRKDLAA---SKRAMTNIPLFKQILSDRETLSYIPVQIESEDELVSSIKQFY-ERITRF  345
SEQ ID NO:403    QQRPEQTA---KKETLTNIPLFKQILSDRDTLSYIPQQIESEQQLIELLNQFY-SRITAF  320
SEQ ID NO:404    QQRPELTG---KKRALTNVPLFKQILSDRETLSYIPQQIESEQQLIDVLSQFY-ARITDY  320
                 :          :  *  :*:

SEQ ID NO:1      KN----------TLFAFIRFLEE--CDNWDGIYNS-SAAVNKISNQYFA--NWHSTKDKLFD    405
SEQ ID NO:3      KDVADFSEIKTVPDFIEFLRE--CDNWDGIYNS-KTAIDKISSLYFA--NWHSTKDKLEE    412
SEQ ID NO:436    T--K---ML-ALIRDALTMFEKSGYEWSKIYFS-SGAINTISSKYFT--NWSVLKGALLD    400
SEQ ID NO:442    -----------NVDLKRLLENIDTYSLRGIFIKRDKSLYNISIYLYK--DWGYTSNLIRE    336
SEQ ID NO:564    L--D-------EDLGIIRLLRNIDKFSYDGIYIRNDNALIDISNYLFG--DWHYTKNAIRK    370
SEQ ID NO:1385   ------EIFSSIKELFELFNFDEYSSAGIFVKNGPAISTISKDIFG--EWNVIKDKWNA    364
SEQ ID NO:447    V--L--SIEKTVEERIERLFSAVTDYCTDGIFVKRAAELTAVCSGAFG--YWGTVQNAWNN   393
SEQ ID NO:67     -----------DLLTELLQSLNTYNARGIFVKDGVAITDISNGAFN--SWNVLRSAWRE    365
SEQ ID NO:74     -----------DSLTELLQSLNTYNARGIFIKSGAAVSDISNAAFN--SWNVLKLAWRE    365
SEQ ID NO:59     -----------DLLTELLQSLNTYNARGIFVKSGAAVSDISNGAFN--SWNVLRLAWRE    365
SEQ ID NO:118    -------VPEGEISLKELLDNLGDYDLERIYIPRDLQLTRIVQKVYG--DWSMYKRAMEE   406
SEQ ID NO:119    -------VPECKSLRSLMVLLKELQEYDLERIYLRNIAQKQYG--UWATIKRAFEE    406
SEQ ID NO:440    ------QIT---ILSETTSKIEFSFDIDRIYIKGGEDLRALSNSIYG--YFNYTHDRIAD   397
SEQ ID NO:446    ------L-A---YIERLIKSIKEYDLAGIYIKNGEDTSTISQHNFG--AYYKIIEAIAD   369
SEQ ID NO:32     ------VFD---KLKEMIKSLPTFNLNGIYLANDLGLTDICQRYYG--ANDKLNNALVA   374
SEQ ID NO:33     ------VPT---KLKDLLLNLSSFDLDGVPVANEQSLTDISQRHYG--AWDTVKNAVVA   405
SEQ ID NO:29     ------SEQNILEKAQELLCSWRYDSPKLSID-GNYISKLSQAIFN--SWSKINDGIRD   389
SEQ ID NO:445    ------CENGPQRKLSELLRDLSSHDLDKIFIQ-GNNLNSISKNLFGGKNWSLLRDAIIA   392
SEQ ID NO:331    --------DNVISAAKELFE-KSDYDLSQITVF-AKEVTDFSLKLFG--NWSILHDGLFL   392
SEQ ID NO:333    --------KDSVTETRNLFALNSDIKLNEIIVP-AKSITAFSLTIFG--NWVIISEGLYL   390
SEQ ID NO:334    --------EKAVSKVRDLFLHREEFTLNEIPVF-AKSLTDFSQAIFG--SWSILSEGLFL   391
SEQ ID NO:335    --------NISVCETKELFFQVAEFNLSEIIVF-AKSLTNFSQNIFG--SWSILTEGLFL   376
SEQ ID NO:336    --------NLSVCETKELFFQVAEFNLSEIIVF-AKSLTNFSQNIFG--SWSILTEGLFL   376
SEQ ID NO:448    E--TENGTENVPEALQSLLATLSP--SPAINID-GAEITPVSKDLLG--SWNALSILMEA   406
SEQ ID NO:386    T--TDGSQINVLEKIANLVASLNFSDEKIFIA-RESLSQIBQKIFG--NWNSINDAFFE   394
SEQ ID NO:387    S--TDGSQINVLEKISNLITSLNFEPDKIFIA-RESLSQIBQKFFG--SWNSINDAFFE   400
SEQ ID NO:399    D--INGKNVNVVKELTDLVLSIDTYNPEGIFIS-AKSITDVSHSLYD--HWNRINEKLYD   372
SEQ ID NO:400    T--LNGNSINIIEELATLVQSLNTYNPEGIPVS-AKSLTDVSHTLYG--HWNKINEKLYE   371
SEQ ID NO:401    E--RDGKTINVLNELVALLSKIDTYNPDGICVT-ANKLTDISQKVFG--KWSIIEEKLKE   375
SEQ ID NO:402    E--RDGKTVNVLSELVAVLGNIDSYNPDGICIS-ASKLTDISQKVYG--KWSIIEEKLKE   400
SEQ ID NO:403    D--YNGKTVDVLKELTKLTGNINKYNPDGIYLS-AKSLTDVSQKLFS--KWNVITERLSE   375
SEQ ID NO:404    E--YNGKTINVLKELSNLTNRIGDYNPAGIFLS-AKTLTDVSQKLFG--RWSAINDKLYE   375
                 :   .    .    ;   :

SEQ ID NO:1      AKANAC-----------ITYNKEQIKLRDAVELSGLFAVLGTENS---------    442
SEQ ID NO:3      ANADAC-----------ITYENKEEFIKLPDAVELSGLFAVLDSEQS--------    449
SEQ ID NO:436    AVGTAKGSGGELFD----FVSLQHVQ-----NALDVNEINKGKKPSELFRSEILKHAAFV    451
SEQ ID NO:442    EYDYKHRNK--VKD---DNYYSKRKAIDKIKYFSIGYIDELLRD------K---NV      376
SEQ ID NO:564    KYEIDNFGK---NT---ENYIVRKNFIKSFDSFSLKYLQDKT--------------GS    409
SEQ ID NO:1385   EYDRIHLKKKAVVS----EKYEDDRKSFKIGSFGLEQLQEYADADLS--V--------   430
SEQ ID NO:447    EYDALNGYK--ET---EKYIDKNKAYKSVESFSLADIQKYADVSES--SE--T--NA   440
SEQ ID NO:67     KYEALHPVTSKTI----DKYIEKRDKVYKAIKSFSLFELQSLG-------NE--N--GN    410
SEQ ID NO:74     KYEALHPVTSTTKI----DKYIEKRDKVYKSIKSFSLFELQELG-------AE--N--GN    410
SEQ ID NO:59     KYEALHPVTSKTNL----DNYIEKRDKIYKAIKSFSLFELQSLG-------NE--N--GN    410
```

FIG. 31 (Cont'd)

```
SEQ ID NO:118    GVKAKNFQPKNETG----EKYERPIVKILKSDESFGIAQINNLLKPYIG---E----K---YV  455
SEQ ID NO:119    SVKAATFAKRNETT----EKYAARIEKILKATDSLSLSQINRNLKAYMG---D---D----FK  455
SEQ ID NO:440    KWKHNFPQGKKS-F----ESYQRNLNAYLKGIKSVLHSIANIC----GD---N--------   439
SEQ ID NO:446    ANERRNFKNRES------------KAYSKYLGSLKSISLQEIDDLK----IG---E-----   407
SEQ ID NO:32     EFDAVVFRKRTQSQ----EKRDNQVKKYLKSVKSISLGKIDSLLADVTE---K--------   420
SEQ ID NO:33     SYDMTNFRKKSQSQ----EKRDEQVKKNLKSIKSLSLATIDNMLKDSTG---L--------   451
SEQ ID NO:29     Y------KKSLLPKETKKALSGIDMELK-QGVSVQDILDALPEENF----------HE    430
SEQ ID NO:445    EKSKDKSYKKAIKTNFSSDLDPI----LG-KDEFSISYLSKVCGKDL----------CE    427
SEQ ID NO:331    IEKDN--SKKTFTE----KQ-IEBLRKEIA-KTICSLADLQNAYERWAK---EN--GVKAEK  441
SEQ ID NO:333    LEKDK--ITKALSE----KQ-EEQLEKDID-KKLCNLEEIQSAYERWCS---EN--GEIVRF  429
SEQ ID NO:334    LEKDS--MKKALSE----SQ-ESKINKEIA-KKLCSFTELQLAYERYCT---EE--NLPVEK  430
SEQ ID NO:335    LEKDK--VKKALSE----NK-EEKINKEIA-KKDYSLDELQVAYERYCN---EN--NFSVEK  427
SEQ ID NO:336    LEKDK--MKKALSE----NQ-ESKINKEIA-KKDYSLDELQVAYERYCN---EN--NFSVEK  427
SEQ ID NO:446    AAEIR--FASEGTE----KKPDAAVANWKK-KPVFSLAEMQGLRVDTIN---------G--  449
SEQ ID NO:386    YCERQ--FGSAQKT----ANK-KYIDAKLK-EDCYSIKEINCVIRKIDS---------SK   427
SEQ ID NO:387    YCERQ--FGSAQRA----ANK-KYIDAKLK-EDCYSINEINRVIRQIDP---------SK   443
SEQ ID NO:399    KAVEA--IGGVQTV----KNK-KVEAYLK-KDAYTLSELSF--------GD-------DV   410
SEQ ID NO:400    KAVEI--FGDVQVV----KNR-KVEAYLN-KDTYTLAELSF--------GD-------DI   409
SEQ ID NO:401    RAVQQ--FCDISVA----KNK-KVDAYLG-PKAYCLSDLCF--------GD-------SF   413
SEQ ID NO:402    KAIMQ--YGDISVA----KNK-KVDAYLG-PKAYCLSDLCF--------GE-------VV   438
SEQ ID NO:403    EAIER--FGDVSIT----KNK-KYIDAYLS-KDAYALSEIPL--------DN-------DR   413
SEQ ID NO:404    KAVSQ--FGDPAIV----KDK-KKIDAYLA-KDAFALSEINL--------DS-------SH   413

SEQ ID NO:1      --ERFFKDSLFKDNETNEYRGI-LDKDLPFSKNLINLLCFDIERNIKAFLQESDK-----  494
SEQ ID NO:3      --ERFFKDSLFKDDTNDYRGV-INKYLFFSKNLIQLLCFDIERNTNAFLSKSNN-----  501
SEQ ID NO:436    RSVQSFTNLITILLSELDAR---VAES---AVDL-----ADL--KKDSFWTT------G-  491
SEQ ID NO:442    PMVECYF---------------------KEK-----INL---VVKEFNAS-----IN-  401
SEQ ID NO:564    RFNERILIKI---------------RNL----IDD--VKKAYNSV------AL-   435
SEQ ID NO:1385   --VEKLEKII---------------IQK-----VDE--IYKVYGSS-----EK-   434
SEQ ID NO:447    EVTENLRNEI---------------KEK-----CNL--AVQGYESS-----RD-   466
SEQ ID NO:57     RIYDWYISSI---------------RES-----NRK--IKEAYLQA-----QE-   436
SEQ ID NO:74     RIYDWYISSI---------------REC-----NRK--IKETYLQA-----RE-   436
SEQ ID NO:69     RIYDWYISSS---------------REC-----NSK--IKEAYLQA-----RS-   436
SEQ ID NO:118    PLERYFIPKGAEDNN----------NVQ---KPNL-----FIR--IENAYIEA-----KS-  490
SEQ ID NO:119    TIESYFTAMGAEDTV----------DGQ---KPNL-----FIR--IENAYADV-----QP-  490
SEQ ID NO:440    KVLEYFRNLGAENTV----------QFQ---RENV-----VSL--IDNKYNCA-----SN-  474
SEQ ID NO:446    PIERYFATFGFTCSD----------RES---GVSS-----LSR--IEAAYTEFVNKFPEG  447
SEQ ID NO:32     SIVDYFTNLGAIDNS----------TTQ---RENL-----FAL--IQNRYISL-----RS-  455
SEQ ID NO:33     SIVDYFTTLGAVNNE----------NLQ---RENL-----FAL--IENRYNAA-----RS-  486
SEQ ID NO:29     VIVDYERNLVQKCQ-------------------------------------------  444
SEQ ID NO:445    RIDRFIRNQDELLI--------------------------------------------  441
SEQ ID NO:331    TVKRYFRIARLSADG----KSR---SKT---SVEI------LRK--IEST----------  473
SEQ ID NO:333    SVRRYFRLIETQSSS----SENTS--TYK---EVCI------LDK--ITKS----------  463
SEQ ID NO:334    FCKDYFDIVDYPGNG----AKS---SKT---KVSI------LSE--ILET----------  462
SEQ ID NO:335    SCKDYFDVVDYRSKN----SKS---DKK---KISI------LSA--ITES----------  459
SEQ ID NO:336    SCKDYFDVVDYRSEN----EKS---DYK---KVSI------LSA--ITES----------  459
SEQ ID NO:448    ----------ANP-VDVSGLNKGPY----AAAR------FDA--VPKAVAEV------RSV  481
SEQ ID NO:386    QILDYWRFDSLKNS----IESGDIYEKYV---DFIS----------L-------------  458
SEQ ID NO:387    QISDYWKSLESFKNS----IESGDIYEKYE---DFIS----------L-------------  474
SEQ ID NO:399    SISQYFSALTNSTDS----IRSL--WLQFQ---SWCK----------S-------------  439
SEQ ID NO:400    SIAQYFENISGSADA----TRSL--WVQFQ---SWCK----------T-------------  438
SEQ ID NO:401    RISQYFSDLPQILNA----IEGY--WLQFR---EWCK----------N-------------  442
SEQ ID NO:402    SPSRYYSELPQMLNA----INGY--WWQFR---EWCK----------S-------------  467
SEQ ID NO:403    SLSMFFAEFFKEIEN----VGSN--WLQFM---EWCK----------G-------------  442
SEQ ID NO:404    RLSTYFSEMALVVEQ----VGSS--WLQFK---EWCK----------G-------------  442

SEQ ID NO:1      IAALEKYKDENIQAGEEDQFIRKYIKEWFDAATDAMRIVRYPAVRKSMRGNLPNVTMEQA  554
SEQ ID NO:3      IVKLEKYKDENDQAGEEDQTIRKIKEWFDAATDAMRIVRYFSVRKSRMEGNIPNATIEQA  561
SEQ ID NO:436    ----ALSQRRKEKEDGGTIQINRISAYLNSCRDAERMIKYFATENSRD------WVSPEEG  542
SEQ ID NO:442    R---PNEYKFTNELKTDETAVEIIKNLCDSIFKIQGIIKPLIITG---------ND---  445
SEQ ID NO:564    LIKRKYEG---TNLINSRKDAIEKTKQFLDSMRSLVSFIRCFEGTG---------QEFD  461
LbCas12a         LFDADFVL--EKSLKKNDAVVAINKDLLDSVKSFENYIKAFTGEG---------KSTR  461
```

FIG. 31 (Cont'd)

```
SEQ ID NO:447    LIGKFYTE---SKKLFNEDNAVELIKSALDSVKELENVLRLLLGTG------------KEEG   513
SEQ ID NO:57     LLKSDYEKSYNKRLYKNEKATESVKNLLDTIKEFQKLIKPLNGTS------------KEEN   485
SEQ ID NO:74     LLESDYEKDYDKRLYKNEKATELVKNLLDAIKEFQQLVKLLNGTG------------KEEN   485
SEQ ID NO:59     LLKSDYEKSYNKRLSKNGKATQSIKNILDAIKDFHHLVKSLNCTG------------KEEN   485
SEQ ID NO:118    LLNTQYFK---DRTMSQDKQFVERIKILLDAIKDLQHFVKPLLGRG------------SECQ   537
SEQ ID NO:119    LLNTPYFE---DKKLSQDKANVAKIKNLLDTIKDLLHFVKPLLGNG------------TKGE   537
SEQ ID NO:440    LLSDAQIT---DEEL---RTNSRSIKDLLDAVKSAQRPFRLLCGSG------------NEPD   518
SEQ ID NO:446    FEDGDGCN---DAYF---KANVEVVKNLLDSIKDFQRFVKPLLGNE------------DERD   491
SEQ ID NO:32     VLDCPTPS---DELL---RKNIEGIKDLLDAIKDLQRFIKPLCGCG------------EELD   499
SEQ ID NO:33     VLDSDGPS---DELL---RKNITQIKDLLDSIKDLQRFIKPLCGSG------------EEPL   530
SEQ ID NO:28     ---AVLSGS---LPGNIETDKDKTDIKLVMDFLLELYRFLSIFSHDN------------SQG   486
SEQ ID NO:445    ---KINSQA---WPSSLKNSEEKNLIKSFLDFLLNFYRFAQAFSGNN------------TDK   495
SEQ ID NO:391    FEKIDFEK---RDNLIKEKETATPIKEFLDEVQNLYRYLKLVDYRG------------EEQ   519
SEQ ID NO:333    FSQIDFEN---EKDLQQEKEAATPIKIYLDEVQNLYRHLKLVDYRG------------EEQ   509
SEQ ID NO:334    FLQLDFEH---IQDLQQEKNAAIPIKAYLDEVQNLYRHLKLVDYRG------------EEQ   508
SEQ ID NO:335    YSKIDFEN---IHDLQQEKEAATPIKTYLDEVQNLYRHLKLVDYRG------------EEQ   505
SEQ ID NO:336    YSKIDFEN---IHDLQQEKEAATPIKTYLDEVQNLYRHLKLVDYRG------------EEQ   505
SEQ ID NO:448    LDGAFSGE---GTFLEERQEDIARIKAALDAILELLRFVKPLRAGG------------ELD   527
SEQ ID NO:386    ------KFS---PDEKLEKDINIQGLKAFLDAINEFLSYVKPLIVNE------------EN-   496
SEQ ID NO:387    ------KFS---PDAKLEKDSNIQGLKDFLDAINEFLRYVKPLTANE------------EN-   514
SEQ ID NO:399    ------AS---KPQSFVRNEVGTKYVKNLLDAIMLVLRKCGALLVSL------------ENE   479
SEQ ID NO:400    ------AS---KPRFVRNEAGTELVKMLLDSILNVLRKCSVLVVSN------------END   476
SEQ ID NO:401    ------DE---KQKFLNSPAGTEVVKSLLDANMELSRKCSVLNSFS------------EYE   482
SEQ ID NO:402    ------DE---KQRFLNDPMGTEVVKCLLDANMELYRKSAVLNSFS------------EYE   507
SEQ ID NO:403    ------ES---KQLFLNNADGTEIVKNFLDSIMEILRRCSVLNVVSV------------END   482
SEQ ID NO:404    ------SD---KQLFLNNADGTEIVKNLLDANMEILRDCAVLVVFI------------EYD   482
```

```
SEQ ID NO:1      LSNL--------LYNDD-VQNFKNYDLVRNYFTKKPQDDAKENKLKLNFGK--GTLLNGFV   604
SEQ ID NO:3      LSNL--------LYNDD-AQNFKNYDLTRNYLTKKPQDDAKENKLKLRFGT--SSLLGGNS   611
SEQ ID NO:436    YDPKFYDAYREEYAK--DIFFFLYNVARNFLTQKPSDE----NKVKLNFEC--GTLLGGND   595
SEQ ID NO:442    RDDDFYVEINYIRDELN-KFDKIYNMVRNYLTRKDYIE----EKIRMMFSK--SSFNDGWG   499
SEQ ID NO:564    RDEIFYGEFDTGKKTFY-YLENIYNKTRNYVTRKPYSI----EKYKLNFDN--AELLFGND   535
SEQ ID NO:1385   RDESFYGDFVLAYDILL-KVDRIYDIRNYVTQKPYSK---SKFKLYFDN--PQPFGGWD   535
SEQ ID NO:447    RDENFYGEFLPCYERIG-EVDSLYDKVRNYMTQKLYKT----DKIKINFSN--SNFLSGNA   567
SEQ ID NO:57     RDELFYGKFTSLYDSVA-DIDRLYDKVRNYITQKPYSR----DKIKLNFDN--PTFLSDWA   539
SEQ ID NO:74     RDELFYGKFTSLYDSVA-DIDRLYDKVRNYITQRPYSK----DKIKLNFDN--PQLLGGND   539
SEQ ID NO:59     RDELFYGKLTSYYDSIT-DIDRLYDKVRNYITQKPYSR----DKIKLNFDN--PQLLGGND   539
SEQ ID NO:118    RDNTFYGEFIPLWSALD-QITPLYNMVRNMTQKPYSD----DKIKLFFEN-NGSFLNGSV   590
SEQ ID NO:119    RDNRFYGEFIPLWELLD-QITPLYNMVRNKLTRKCSD----EKIKLFFENNGPFLSGNT   593
SEQ ID NO:440    RDEFFYDKYTEAFEAIERSINPLYNKVRSFVTRKDFST---DKFKLNFDS--SSFLSGNA   573
SEQ ID NO:446    RDEAFYGKFVPTYTDMDKIITPLYNPVRNFATKKPYST---DKIKINFEK--STLLTGNA   546
SEQ ID NO:32     RDEMFYSDFSPLYETLDQI-ITPLYNKVRSYLTRKPYKL---DKFKLNFET--PTLLQSWP   554
SEQ ID NO:33     RDEIFYSDFSALYESLDQT-ITPLYNKVRSYLTRKPYSL---DKFKLNFDN--SQLLDGWD   585
SEQ ID NO:28     VKIAFEEQLMEILADWK--EIIPLYNKVRNFATKKAYSV---EKFKLNFEV--ATLASGWD   542
SEQ ID NO:445    DNSLYADY-DVSLSLIV--SVIGLYNKVRSYATRKPYSL---EKTKLNFEN--PNLATGNG   538
SEQ ID NO:391    RDTFYSKYDEILQTLS--EIVPLYNKVRNFVTRKPNEV---KKVKLNFDN--VSLAKGND   573
SEQ ID NO:333    RDSRFYSKFDEIKELS--EIISIYNKVRNFVTRKPQEV---KKVKLNFDC--PTLANGND   563
SEQ ID NO:334    RDSTFYSKNDEILLTDLS--QIVPLYNKVRNFVTRKPGES---KMTKLNFDC--PTLANGND   562
SEQ ID NO:335    RDSRFYSKLDEITTQLS--EIIPLYNKVRNFVTRKPGEM---KKTKLNFDC--PTLANGWD   559
SEQ ID NO:336    RDSRFYSKLDEITTQLS--EIIPLYNKVRNFVTRKPGEM---KKTKMMFDC--SSLLGGWG   559
SEQ ID NO:448    RDEAFYGAFDPLFDALD--GFVPLYNKVRNYLTRKPGET---GSVKLMFDN--PSFLEGNE   581
SEQ ID NO:386    GDTAFYRELMPLVDQLS--NIIPLYNTVRDFATQKPSDS---AKFKLNFEN--PTLADGND   552
SEQ ID NO:387    GDTAFYRELMPLFDQLS--NVIPLYNTVRDFATQKPSDS---AKFKLNFEN--PTLADGNE   568
SEQ ID NO:399    LDSPFYNKFLPLYAELE--NVILVYTRVRNFLTRKLSDT---GKTKLRFDT--PSLGAGNG   533
SEQ ID NO:400    LDKDFYNKFLPLYAELE--NVILLYNKVRNFLTQKPSST---GKTKLRFDI--PSLGAGNG   532
SEQ ID NO:401    VDKSFYREFIPLYEELS--TLFLLYNKVRNYLTRKPSDV---KKFKLRFET--PSLADGND   536
SEQ ID NO:402    VDKSFYREFIPLYEELS--TLFLLYNKVRNYLTRKPSDV---KKFKLRFES--PSLASGND   561
SEQ ID NO:403    LDKDFYRDFLPLYAELE--NAVNVYNRVRNFLTRKPSDT---KKFKLNFGV--PSLGDGWD   536
SEQ ID NO:404    LDKDFYRDFLPLYAELE--NVIFVYNRTRNYLTRKPSDT---KKFKLRFGT--PTLGDGWG   536
```

FIG. 31 (Cont'd)

```
SEQ ID NO:1     DGRSDSDNGIQYGGYIFRKRHERCNEYEYFLGVSKNAQLFRCHLRNE-VPSND----KSA   659
SEQ ID NO:3     DSQERTKVATLLK-------YH-----EEIYLCVLKTKNIPDTSKDN--NPIYDIT-ESE   656
SEQ ID NO:436   KNKE--------QERLGII----LRKDGAYYLAIMRKQFSDILEEKH--------PKSYR   636
SEQ ID NO:442   KDYG--------TK-EARI----VYRDKNYYLVIVDEKLKLEDYDELY--------KPG   587
SEQ ID NO:564   LNKE--------TSEASII----LRKDNLYYLGIPKKSDRRVFLNVPE----------T-E   573
SEQ ID NO:1305  KDKE--------TDYRATI----LRKYGSKYYLAIMDKKYAKCLQKIDK----------D   572
SEQ ID NO:447   QTYS--------TK-GALI----VKKENRYYLVIVDEKLSNDDIVFLG----------T-N   604
SEQ ID NO:57    LGKE--------FANSAQL----LRKDGDRYLAIMDKELKNNIPKEYN----------SPT   578
SEQ ID NO:74    KNKE--------SDYRTVI----LRKNDFYYLAVMDKSBSKVFVNAPE----------ITS   578
SEQ ID NO:59    KNKE--------SDYRTVL----LRKYDDFYYLAVMDKLESKAFVDAPN----------ITS   578
SEQ ID NO:118   DSKTESDNAIQYGGY-LFRKNSIGKYDYYLGISSRTKLFRSPNSVS----------E   639
SEQ ID NO:119   DNQTESDNGIQYGGY-LFRKRNGIGKYDYYLGVSDAKKLFRSFKSVP----------D   640
SEQ ID NO:440   TKSE--------YERSSAFI---FIRDNQYYLGIR----------------RCLSKEDYAYLEDS   611
SEQ ID NO:446   NYKQ---------YGGV-LF----CKNDSDFYLGIVKSSKTE-IHEVDD-----   580
SEQ ID NO:32    NYQA---------YS-CAIF---KEDDNRYYLAILDKNNRSCLNTIVPPISENDIIGLVER   602
SEQ ID NO:33    VNKE--------KDYLSIL----LRKNGTYYLAINRKRDKSALSQINQC----DMI----   625
SEQ ID NO:29    QNKE--------NANCAII----LRKKDMYYLGIYNSSNQPF-FEIV----------E   577
SEQ ID NO:445   ENKE--------NDCLSVI----LLKNQIYYLGIINKSNPN-FSRGI----------SQQP   577
SEQ ID NO:331   VNKE--------SDYTCIL----LRBSGLYYLGVLNPKDKPK-FDSEN---------NGETRI   614
SEQ ID NO:333   ENKE--------KDNDAIL----LLKDGRYYLGIYNPKNEPK-FDFEE----------S   599
SEQ ID NO:334   ENQE--------SSNDAIL----LRKDGRYYLGIYNPNNEPK-FARKD----------S   596
SEQ ID NO:335   ENKE--------SSNDAII----LRKDGEYYLGIFNPRNKP-RFSEIE----------N   595
SEQ ID NO:336   TDYG--------TK-EARI----FIDSGKYYLGIINEKLSKDEVELLK----------K   596
SEQ ID NO:448   QNLE--------TKRTSIL----FFRDGFTYLGVRAPDAKIN-FSAFA----------VS   616
SEQ ID NO:386   QNKE--------AKRTSII----LRKEGRYYLGIPNAKDKPK-IDTYK----------VN   589
SEQ ID NO:387   QNKE--------QARTSII----LRKGERYYLGIPNAKDKPK-IDTYK----------VT   605
SEQ ID NO:399   INKE--------KTRKAVL----LFKDGLSYLGIPNVKGTLD-PNC-K----------IE   569
SEQ ID NO:400   INKE--------KKNKAIL----LFYDGRSYLGIPNVKGTLD-FDC-K----------AE   566
SEQ ID NO:401   QNKE--------RANKAIL----LFYDGLSYLGIPNAQNMPN-LNQ-K----------WS   572
SEQ ID NO:402   QNKE--------NKRNAIL----LFKDGKSYLGVLNAKNRAK-IKDAK----------GD   596
SEQ ID NO:403   QNKE--------RDNKAII----LFYDGKSYLGIPNAKDMPI-IKER----------DE   572
SEQ ID NO:404   VNKE--------RKNKAIL----LFKEGLSYLGIPNVKGTLK-FEBT----------RD   572
                                                    :*:

SEQ ID NO:1     --------FERLEYYQNK----SCTFY-FNDYGNKKEEIIDVVRKLAEDNE--ELVEWIDK----   705
SEQ ID NO:3     ASPLLLKNLKFQTLAGEGFLGEY-EISYGDNGKE----------------   699
SEQ ID NO:436   AGDNGYSKNEYKLFP----------DPKRMIFKVAFABTNEK-TFSW------   672
SEQ ID NO:442   G---DTVHYIYNYQS----------IDYRNIFRKFIYSKGNRFAPSVER----   573
SEQ ID NO:564   STYNCYKNEYKLLP-----------GPNKMLPKVFFAKSN-----------   603
SEQ ID NO:1305  DVRGNYEKINYKLLP----------GPNKMLPKVFFSRKW-----------   602
SEQ ID NO:447   TQLSPAERIVYDFQK----------PDNKNTPRLFIRSKGTSYAPAVKE---   643
SEQ ID NO:57    NEEDMLQRIIYQQAA----------NPANDIPNLLVIDGVTVKENGRKEKTGI   621
SEQ ID NO:74    EDEDYYEKMEYKLLP----------GPNKMLPKVFFASRN-----------   606
SEQ ID NO:59    KDEDYYEKMEYKLLP----------GPNKMLPKVFFAAKN-----------   606
SEQ ID NO:118   SDKSIFERLDYYQLKEKTFYGALYKGDYEKESSAIKLAIDKFITNENTI----IREK---   693
SEQ ID NO:119   SDKSDYERLDYYQLKEKTFYGALYKGDYESESANINRSIDYFISHNGNSE--IKGK---   694
SEQ ID NO:440   TSSSDAKRAVYLFQK----------VDAKNIPRIFIRSKGSN--------   643
SEQ ID NO:446   -SASDIYRIDYALIP----------NPGKTIPCLMFRDEVKAE-KVNGRKDK   620
SEQ ID NO:32    LQGGDNGKNVQNLMR----------IDG--KTRKVNGRKE-------TSGP   634
SEQ ID NO:33    -SGDCYERLNYKLLP----------SPFKMLPKVFFSRK-----------   653
SEQ ID NO:29    QDDDGFEKMIYKQFP----------DFNKMLPKCTVSRKNDVAVHFN----   614
SEQ ID NO:445   SSESCYKNRYLLFK-----------GPNKMLPKCAFTGE--VKEHFK----   612
SEQ ID NO:331   NKNDCYEKLVYKYFK----------DVTTMIFKCSPQLNE-VKQHFK----   650
SEQ ID NO:333   KASDCYKKVYKLLP-----------GPNKMLPKVFFSAKG-QKEF------   633
SEQ ID NO:334   IVGDCYEKNAYKQIA----------LPNGLGA-FVR----KCFGT-----   626
SEQ ID NO:335   ISESYYEKNVYKLLP----------GPNKMLPKVFFSTKG-QETF------   629
SEQ ID NO:336   SSRMVTKVIYDFQK-----------PDNKNTPRLFIRSKG-TNYAFA----   631
SEQ ID NO:448   AASGCYRKVVYKAIS----------KAA-----QYFSIKQ-IKPQ------   647
SEQ ID NO:386   SNEPHYDKMVYKLIP----------SPHKGLPKAFFSKKG-LALY------   623
SEQ ID NO:387   PDEPHYDKMVYKLLP----------GPNKMLPKVFFSAKG-KEIY------   639
SEQ ID NO:399   ADEPTFKNVCRNYS-----------KPYMDLPNSFSQNG-ISKF------   603
SEQ ID NO:400   HSEPTYKNVCVNHS-----------KPYMDLPNSFRQTG-IDKY------   602
SEQ ID NO:401   ALESHYSKMVYKLIP----------GPNKMLPKVFFSKKG-LDIF------   606
SEQ ID NO:402   ASSSYKKNIYKLLS-----------DPSNDLPHKLFAKGN-LDFY------   632
```

FIG. 31 (Cont'd)

```
SEQ ID NO:403    STPSSYKEMIYKLLA---------------DPAKDFPRTFPSRKG-IDTY--------    606
SEQ ID NO:404    ASLRSYKEMICRYLS---------------KPFMDLPRTFPSRKG-ISTF--------    606

SEQ ID NO:1      ---------KNEDKELTPTE--------LFKPLE----NTND-FILKNKELLNK----VDETI    742
SEQ ID NO:3      ------------------NFTY---------AIKCLQ---KIIKERYVNEYPL---------    712
SEQ ID NO:436    -------------TPSV-QA-----IKDEYAKPQESKKEDQSAWKNQFDA--NKTAPLI    710
SEQ ID NO:442    --------------YNLPIE------D-VIEVYNN--KYYPTEYEENPKIYK--KSLTSLI    610
SEQ ID NO:964    --------------IDYYDPSP-----D-IMKIYKE---GTFYK-----GDRFNI--DDCRDLI    637
SEQ ID NO:1395   --------------NAYYNPSE-----D-IQKIYKN---GTFYK-----GDMFNL--NDCRKLI    636
SEQ ID NO:447    --------------YDLPIS-------D-ITELYDN--EYSKTEYRKINPEGYK--SALIKLI    680
SEQ ID NO:57     HAGENIIL-ENLRETYLPD-----N-INRIRKE--KTFSTS----SERFSK--DDLCEYI    666
SEQ ID NO:74     --------------IDFPQFSD-----R-ILDIPKR--ESFYK-----GATFNK--SECREFI    642
SEQ ID NO:69     --------------IDTPQFSD-----R-ILDIPKR--ESFYK-----GATFNK--SECREFI    642
SEQ ID NO:118    ------I--NTEKRRRQPKVSTAIGY-LRFLPQQ--GVELFDSLLRDGCFERSNQAMYTSI    743
SEQ ID NO:119    ------I--NTERREQQPKISTAIGY-LRFIPQN--DPGLYKLLQDAEFEKSNQEMIASI    744
SEQ ID NO:440    ------LA-PAVNEFQLFIE-----Y-ILDIYDN--KPFTTSYQKEDRTKWK--RSLTKLI    687
SEQ ID NO:446    KTGENLRLEEKKDRYLP-A-----R-INRIPKS--RSY-----LKSSECYCR--QDMVAYI    665
SEQ ID NO:32     NAQQNIRLEESKKTYLP-H-----R-INEIRIE--KSF-----SLRSPNYRR--RCINKYI    679
SEQ ID NO:33     --------------GIEVYNFSQ-----R-ILDIYNE--KKF-----QLG-DEFDK--RSLIKLI    686
SEQ ID NO:29     --------KSDAEF-LLNV-----NTFSKFLL--ITREVYDLGTKTVQG--KK-KFQI    653
SEQ ID NO:445    --------ESSEDYHLYNK-----DTFYYPLV---INKRIFDLACSTEKV---K-KFQK    651
SEQ ID NO:331    -------RSNEDYILENN-----N-FIKPLVI---SRRIFDLRNKTFDE--KKMF-QI    639
SEQ ID NO:333    -------------LPPK-----R-LLLGYEE--GKRY-----RGERFDK--RSMYKLI    663
SEQ ID NO:334    ----------AQRYGWGCPEN-----C-L-NS--E--GKI-----IIKEEEAK--GNLEAYI    662
SEQ ID NO:335    -------------LPPK-----D-LLLGYDA--GKRN-----RGEAFDK--RSMYKLI    659
SEQ ID NO:336    --------VSQYN--LPIE-----S-IIDIYDR--GLFNTEYRKINPEVYK--RSLIKMI    671
SEQ ID NO:448    -------------NPPQ-----F-VLDWLAK--GFDK----KT---LMR--DQLTRLI    675
SEQ ID NO:386    -------------KPSM-----Q-ILDGYNA--NKBK-----KG-SSFTK--KYCHQLI    653
SEQ ID NO:387    -------------NPSK-----R-IQDGYAA--EKBK-----KG-PSFTK--RFCHQLI    669
SEQ ID NO:399    -------------NPSE-----R-IQKIYE----AFK-----ENSKEVDI--KKVRELI    632
SEQ ID NO:400    -------------KPSE-----R-ILKIYE----AFK-----KDSKSVDI--NEVRELI    631
SEQ ID NO:401    -------------NPSR-----R-ILRIKEE--ETFK-----KGSPNFKL--ADLRDLI    637
SEQ ID NO:402    -------------KPSE-----Y-ILEGREL--GKYN-----KG-PNFDK--KFLRDFI    662
SEQ ID NO:403    -------------NPSR-----Y-ILDGPEQ--GKYN-----KG-ETFDK--KFMRDFI    636
SEQ ID NO:404    -------------NPSE-----R-IMDIYKN--GTFK-----KDSPSYSI--AALRDLI    637

SEQ ID NO:1      SIYKS--NLKNFTIRINAINDLQ----------------NDQNWHGGIDGFKKLVDELKRI    794
SEQ ID NO:3      --------LERFARNTYTDKAQ----------------F----DARIYET    734
SEQ ID NO:436    AYYQN---------CLAKEGYQETFGLT----------WRKFEEYVGIGEFNERI    746
SEQ ID NO:442    DYPKI---------GVNRDMDFE-KFDIK------------LKDSNEYKNIWEFYRL    646
SEQ ID NO:964    DYFKE---------SLDKNDWK-IFDFD------------FSETSSYKDIGEFYKEV    673
SEQ ID NO:1395   DFFKD---------SISRYFKNSNAYDFN-----------FSETEKYKDIAGFYREV    673
SEQ ID NO:447    DYFKL---------GFSRHESYR-CFNFK-----------WKESEQYSDISEFYNDV    716
SEQ ID NO:57     QYTIC---------RVQ--EYYS-SYNFT-----------FKNASEYRNFPEFSEDV    700
SEQ ID NO:74     DYFKE---------SIKKHDDWS-KFGFE-----------FSPTSYNDISEFYREV    676
SEQ ID NO:69     DYFKN---------SIEKHYDWS-QFGFE-----------FTPTENYDISEFYRSI    678
SEQ ID NO:118    KATLAS---------MARIFNAQDYA-R-----------KDYSLFSDAMEDV    774
SEQ ID NO:119    RETLLS---------LVRIFSAHEYA-D-----------KTYTLFSDNMEDV    775
SEQ ID NO:440    DYYKL---------GFSQHKSYA-DFDLK----------WKASSEYNDINDFIADV    723
SEQ ID NO:446    DYYRK---------CCI--SYYS-KLSFT----------FKDSGMYSDWNDFIADV    699
SEQ ID NO:32     DFYKP---------LVE--EYYS-EFDFS----------FKEASEYDFSQEFTNRI    713
SEQ ID NO:33     DFYKN---NTGDEAGY--AIFQNESWQ-SFDFS------FAPSQSYESIMEFYSVI    724
SEQ ID NO:29     DYKRNTGDEAGY--KAALKAWI-SFGKEFIKAYESTAIYDISLLRKSEGYPDIQSFYEDV    710
SEQ ID NO:445    AYEK--VNYAEY--RQSLIKWI-SFGLEFLSAYKTTSQFDLSNLRKFEEYSDLKEFYEDV    706
SEQ ID NO:331    DYYRNTGDLKGY---TEAVRDWI-SFCMTFVHGYKSTCIYDFSSLGDCSQFKQVDQFYKSI    746
SEQ ID NO:333    DNFKD---AIN-------RHEDWK-KFDFK----------FSDTRSYEDKSAFYKEV    699
SEQ ID NO:334    DCYKD---FLNKY--EKDGFKYK-DYNFS----------FLDSAGYEKLSDFTNDV    702
SEQ ID NO:335    DNFRD---AIN-------RHEDWK-RFNPV----------FSPTRSYEDMSGFYREV    695
SEQ ID NO:336    DYFRL---GFE------RHESYK-RYPPC----------WKESSKYNDIGEFYKDV    707
SEQ ID NO:448    SYVMDD-FIPNYFPLADGSGKV-AFDFS-----------PRKFSEYGSWKEFTDHI    718
SEQ ID NO:386    DFFKEA-------ISRHFDWK-NFFPN-----------FSETASYDDTSAFYNEI    689
SEQ ID NO:387    DFFKEG-------ISNHFDWK-NFNFN-----------FSETSSYEDISAFYNEV    705
```

FIG. 31 (Cont'd)

```
SEQ ID NO:399    DYYKDA---------ISRHEDWG-SFGFR-------------------YSPTESYETIRDFYYEV   666
SEQ ID NO:400    DYYKDA---------ITRNEDWN-SVSFT-------------------YSPTETYETIDDFYKEV   667
SEQ ID NO:401    DFYKDG---------INRHPIWS-KFNFQ-------------------KADTKAYEDIAGFYEDI   673
SEQ ID NO:402    DFYKDA---------IAIDPIWS-KFNFQ-------------------YSPTESYEDIGAFFSEI   696
SEQ ID NO:403    DFYKDA---------VAKRPIWS-KFNFV-------------------YSPTESYEDIGAFFNEV   672
SEQ ID NO:404    DFYKDA---------INRREDWV-KYGFR-------------------FSPTESYEDISSFYSEI   673
                                                                      :

SEQ ID NO:1      IA--ATKLFDFPVSSE-FNA--NRGEDLFLFKISRKDLSYCETFARGKRKESTNQKEN          839
SEQ ID NO:3      LK--BCYVCQFVPIDWRYVTEK--QDNRELFLFRILCKDYRPKS------------VGKED     779
SEQ ID NO:436    AQ--QRYKIKFVPVDADYIDEN--VAKGEMYLFRIKSKDPASG-------------STGTEN    791
SEQ ID NO:442    ET--CCYKLQEEKVNFSVLEEF--SYSGKIYLFRIYNKDFSK----------Y--SKGTPN    691
SEQ ID NO:564    QQ--QGYKISFKNIASSYVDEL--VENGKLYLFQIYRKDFSE----------N--SKGTEN    716
SEQ ID NO:1385   EE--QGYSVSFESASKKEVDKL--VEEGKLYMFQIYRKDFSD----------K--SHGTPN    716
SEQ ID NO:447    VK--SCYQLKSESINFDSLIKL--VDEGKLYLFQLYRKDFSE----------S--SKGTPN    761
SEQ ID NO:57     NS--QAYQISYDNISKEQIMEL--VDNGYIYLFQIYRKDFSE----------Y--SKGTPN    745
SEQ ID NO:74     SD--QGYYISFSKISKRYIDKL--VENGYLYLFRIYRKDFSE----------Y--SKGTPN    723
SEQ ID NO:69     SD--QGYSVSFNKISKSYVDEL--VDNGYIYLFRIYRKDFSE----------Y--SKGTPN    723
SEQ ID NO:118    EELLQDVIPSYFPISQEMDKVLEREEKFMYLFRITNKDLSPAETHEKGLRK--SRGTDN     832
SEQ ID NO:119    EILLKSKVPSYPTVSQSELDEVLVREEEFTYLFKITNKDLSYAETHEKGLRK--TRGTDN     833
SEQ ID NO:440    QK--SCYRIEFININWDKLIEF--TRKDKFYLFRIANKDLSG----------N--STGLPN    766
SEQ ID NO:446    DG--QGYQLNRIFVSMQKLENL--VDNGNMLLFRIANKDFSP----------------SRGRPN   744
SEQ ID NO:32     NQ--QDYQLKIIPFSKRYLRTL--VDNGQVFLFRILRKDFSP----------Y--SKGRPN    756
SEQ ID NO:33     EN--QGYRIDFKKVPSSLIRLL--IDQGLLYVFRIANKDFSP----------S--SKGRPN    769
SEQ ID NO:29     DN--ICYRIAFQKISDEAVRQC--VENGSLYLFRLHAKDFSPG----------ASGKPN    755
SEQ ID NO:445    DN--LTYRIELVDLKEEYVDSL--VENGQLPLFEISNKDFARK----------SSGTPN    751
SEQ ID NO:331    NL--LLYKIWFVNVTAEKIRSL--VDSGKLPLFQIYRKDYSTGK---DGGNG--STGKEN    797
SEQ ID NO:333    EL--QGYRISFKKVSTEIIREF--VRSSKLPLFQIYRKDFAVK------------ATGKEN   744
SEQ ID NO:334    KF--QGYRLSFTSIPLSEIDKM--IDEGKLPLFQIYRKDFARK------------ATGKEN   747
SEQ ID NO:335    EL--QGYNVSFQKISUTEIRSF--VDNGKLPLFQIYRKDFALK------------ASGKEN   740
SEQ ID NO:336    IN--SCYQLNFEKVNYDNLLKL--VENRKIPLFQIYRKDFARK------------KSGKEN   782
SEQ ID NO:448    AS--MAYNISFEDIPAEAVDRL--VERKLCLFLLWNKDFSQA------------SNGKFN    763
SEQ ID NO:385    SN--QGYMLSFTSIPDSQIDTW--IDEGKLPLFQIYRKDFAPG------------AKGKFN    734
SEQ ID NO:387    SD--QGYNLSFTFIPDSQIDTW--IDEGKLPLFQIYRKDFAPG------------AKGKFN    750
SEQ ID NO:399    AA--QSYKLRFIEVPQKQVDEN--VEEGKLYLFQLYRKDYABG------------AHGKEN    713
SEQ ID NO:400    AK--QSYQVSFKDISQEQVDEN--VEKGQLYLFQLYRKDYABG------------AHGKEN    712
SEQ ID NO:401    AN--QAYKITFSDIPVWQINDW--IDNGQLYLFQLYRKDYABG------------AHGKEN    716
SEQ ID NO:402    KE--QAYKIRFTDITESQVNEN--VDNGQLYLFQLYRKDYABG------------AHGKEN    743
SEQ ID NO:403    SK--QAYKIRFSYIEESQINEN--TEKGQLYLFQLYRKDYABG------------AHGKEN    717
SEQ ID NO:404    AK--QAYKISFTNVSEQQVRDN--VENGQLYLFQLYRKDYABG------------AHGKEN    716
                          .  (*  :    **                                            :

SEQ ID NO:1      LHTLIFKALMREDLFGD------IVDIGKGEVFLREKVP-------------------       872
SEQ ID NO:3      LQMYWEDVLSDGSKHQ------L--CAGAEIFMREPVAKE-SPIIHRIGSKFVN----KR   827
SEQ ID NO:436    VRSLYPSQLFSEANLAQTPTVVQLAQNAEIFYREASVEPEK-------------            832
SEQ ID NO:442    LHTLYFKMLFDKENLEN---PIYKLSGNAEMFREGNLDLDKTTIHHANQFINNKNFN--       747
SEQ ID NO:564    LHTMYWRALFDEENLEN---VIYKLNGAEIFFPRKSISENEKIVHPAHVEIENKNDETPK     776
SEQ ID NO:1385   LHTMYFRLLFDENNHGQ------IPLSGGAEIFMRPASLKEEIVVHPANSFIANYKNDN--    772
SEQ ID NO:447    LHTLYFKMLFDERNLEN---VVFKLNGEAEMFYRKSISKDIMIVHPKNQFIKNKNEQN--      817
SEQ ID NO:57     LHTLYFKMLFDERNLSN---VVYKLNGEAEMFYREASIGDKEKITRYANQFIENKNFDN--    801
SEQ ID NO:74     LHTLYFKMLFDERNLSN---VVYKLNGEAEMFYREASINDKEKITRHANQFIKNKNFDN--    779
SEQ ID NO:69     LHTLYFKMLFDERNLSN---VVYKLNGEAEMFYREASINDKEKITHQANQFIENKNFDN--    779
SEQ ID NO:118    LHTMYFKALMSGTQN-------VFD-IGSGTVFFREEKIVYSE-EQLGKGH-------HH     876
SEQ ID NO:119    LHTLYFKALMSGNQS-------VFD-IGSGAIFFREKKINYTD-EQMRKGH-------HH     877
SEQ ID NO:440    LHTLYFMSDESELKD---IVYKMSGNAEVFMRYNSLEKNP--IVRKAGVEIKNKCSFTE-     823
SEQ ID NO:446    LHTIYWRMLFDPANLKD---VVYQLNGNAEIFYREASITREE-PTHPAMVAIKNKSFYNKQ    801
SEQ ID NO:32     LHTIYWRMLFDDNNLKD---VIYKLNGKAEMFRPSITNP-VIHAAMKEIANKSAYNKQ        814
SEQ ID NO:33     LHTIYWRMLFDENNLKN---VVYKLNGEAEMFYRKSSIQNP-VIKAHHDIKNKSEYNKL       825
SEQ ID NO:29     LHTLYWKYVFEEENLKD---VVYKLNGQAELFYRPSLTQP-VVRKGEKILN------KT      806
SEQ ID NO:445    LHTLYFKSIFDPRNLKD---CIVYKLNGEAEIFYRKSLKIDDITVHQGSCLVNKVFNPD       809
SEQ ID NO:331    LHTMYWENLFSEENLRD---VCLKLNGEAELFWRDANPDV-KDVCHKRGSVLVN------RT    849
SEQ ID NO:333    LHTMYWENLFSEENLKD---ICFKLNGEAELFWRKASLIKEKVTHKNSILIN--------RT    797
SEQ ID NO:334    LHTLYWENLFSVENLQD---VVLKLNGEAELFWREASIKKDKVIVHKNGSILVN------RT    800
SEQ ID NO:335    LHTLYWENLFSEENLKD---VCLKLNGEAELFWRKPSLNKEKVTVHKEGSILVN------RT    793
```

FIG. 31 (Cont'd)

```
SEQ ID NO:336   LETLYWERLFSEERLKD--VCLRLNQEAELFWRPSLNKEKYTVRKKGSILVN-----RT   805
SEQ ID NO:440   LETMYWKAVFSPERLRD--VVIKLNQEAEVFYRPKSIRT--PFRRKVGEKMVN-----RR   814
SEQ ID NO:386   LETYWKATFSPERLKD--VVFKLNEAELFYRPCSIKK--PYSRKIGEKMVN-----RI   785
SEQ ID NO:387   LETYWKATFSPDRLQD--TVFKLNGEAELFYRPCSIKK--PYSRKIGEKMVN-----RI   801
SEQ ID NO:399   LETMYWECLFSEERLSN--LFIKLGQQAELFYRPQSIKK--PVSRKVGTYMLN-----RR   764
SEQ ID NO:400   LETYWESLFTAERLSD--TVIKLGSNAELFYRPQAIKK--PVKREVGTYMLN-----RR   763
SEQ ID NO:401   LETYWERLFTDERLSN--LVLKLNGQAELPCRPQSIKK--PVSRKMGSKMLN-----RR   769
SEQ ID NO:402   LETYWERLFTDERLSN--LVLKLNGQAELPCRPQSIKQ--PVSRKIGSKMLN-----RR   794
SEQ ID NO:403   LETYWESLFSPERLSN--TVLKLGGQAELFYRPQSIKQ--PFSRKTGSKMLN-----RR   768
SEQ ID NO:404   LETYWENLFSKERLMR--LVLKLGGQAELFYRPQSINK--PAKRVVGSKMLN-----RR   769
                 : :: :   :              ,  ,  :^   *

SEQ ID NO:1     --------------SYDYDD-----------SVRKYG------------------R   835
SEQ ID NO:3     DKDGDTIPEQIYREIYSYANGKRK----TISAESRMYI------------------D   862
SEQ ID NO:436   -----------------------------------------------------------   832
SEQ ID NO:442   K---------------------K------------------------------------   749
SEQ ID NO:564   E---------------------K------------------------------------   778
SEQ ID NO:1385  P---------------------K------------------------------------   774
SEQ ID NO:447   S---------------------R------------------------------------   819
SEQ ID NO:57    K---------------------K------------------------------------   803
SEQ ID NO:74    E---------------------K------------------------------------   781
SEQ ID NO:59    E---------------------K------------------------------------   781
SEQ ID NO:118   E---------------------M------------------------------------   876
SEQ ID NO:119   E---------------------M------------------------------------   879
SEQ ID NO:440   ----------------------K------------------------------------   824
SEQ ID NO:446   N---------------------K------------------------------------   803
SEQ ID NO:32    B---------------------K------------------------------------   816
SEQ ID NO:33    B---------------------K------------------------------------   827
SEQ ID NO:20    TRGEPVPDVYVELSRFIENGSTG---NLSNEAKWQ--A---------------------   842
SEQ ID NO:445   SEKSEQIPDKIYNEIYAYVN-GKST----TLSKEDEFFY--T-----------------   844
SEQ ID NO:331   TSDGETIPEEIYQEIYEFKRPNKQEKSFKLSDTAKELLDSG------------------   890
SEQ ID NO:333   KRDGSTIPENLYQEIYQYKRNMIS---DISENAKDLLNSG-------------------   834
SEQ ID NO:334   TTDGKSIPEAIYQEIYQLENKMAD----SISDEAKRLLESG------------------   837
SEQ ID NO:335   TNDGKSIPEDIYQEIYQFKRKMKD-----KISDNISIQNDDGRVITITVTLENKQKEKFTE   849
SEQ ID NO:336   TNDGKSIPEDIYQEIYQFKRKMID----NLSENAKSLLDGG------------------   842
SEQ ID NO:440   GRDGAPVPEAIRGELFRHANGETAF----LSGAARQWLESG-----------------   851
SEQ ID NO:386   TKDGRPIPDAIPGELFHYFRNSTK-P--SLSDDAKKYL--D------------------   821
SEQ ID NO:387   TKDGRPIPDAIPGEIFHYFRNSTK-P--SLSDDAKKYL--D------------------   837
SEQ ID NO:399   AKDGKPIPDAIYRSLYQFFNGKABA--ELTTEEKAYI--S-------------------   801
SEQ ID NO:400   DNDGKPIPDTIYRSLYQFYNGKAMA--ELTAEERAYI--S-------------------   800
SEQ ID NO:401   DKGGMPIPESIYRSLYQFYNGKKES---ELTAAEKQYM--D------------------   806
SEQ ID NO:402   DKGGMPIPENIYRSLYQFYNGKKES---ELTTAEKQYM--D------------------   831
SEQ ID NO:403   DKGGMPIPEAIYRSLYQFYNGRKAES--ENTLVEKSYI--D------------------   805
SEQ ID NO:404   DKGGMPIPEFIYRSLYQFYNGKQSD---ELTAAEKAYI--D------------------   806

SEQ ID NO:1     BYNDLKDRFTYPII-SNKRFSEDK-ILHLSVILNYKSDNR-----KNVGVEIND--ALQ   936
SEQ ID NO:3     EQKVIIKDVKEKIIKDNRFYGSTK-YMFHCPIKLQFEAKDF-KYAYSEVNTTVQN--ALQ   918
SEQ ID NO:436   -----SKRNFPRDITKYK-RFTEDK-VFFHVPIKINAGTDAMRG---QYQFNKILMAELIAK   894
SEQ ID NO:442   -----RQSVPKYDIIKNR-RYTVDK-PALHMSITTNFQVYK---NK----PVNETVNK--ALK   796
SEQ ID NO:564   -----KTSIFNYDIIKDK-RFTVDK-PQFHVPITLNFQAIDK--KS----DINLNMPQ--EIK   826
SEQ ID NO:1385  -----KTTLSYDVYKDK-RFSEDQ-YELHIPIAINKCPKM---IP----KINTEVRV--LLK   821
SEQ ID NO:447   -----KQSTFKYDIVKER-RYTVDQ-PMLHIPITLNFTANG---GT----NINREVPK--ALK   866
SEQ ID NO:57    -----KESVFKYDIVKDK-RFTKPQ-PSLHVPITINFKAHG--QE----FLNYDVPK--AVK   850
SEQ ID NO:74    -----KESVFEYDIIKDK-RFTKPQ-PSLHVPITINFKAHG--QE----FLNYDVPK--AVK   828
SEQ ID NO:59    -----KESTFEYDIIKDK-RFTKPQ-PSLHVPITINFKAHG--QE----FLNYDVPK--AVK   828
SEQ ID NO:118   -----LKDKFDYPIISNK-RYAYDK-PQFHLSININYKADKH-K----DINLLVNE--YLK   925
SEQ ID NO:119   -----LKDKFNYPIISNK-RYAFDK-PQFHLSISINYNADKN-K----DINPMVNA--YLK   926
SEQ ID NO:440   -----KTSIFDYDIIKER-RYTKDQ-LELHVPILNFKSPGA--AK-GNVFNKEULE--YIK   874
SEQ ID NO:446   -----PYSTFRYGLIKER-RYTTDQ-FEFHVPTMNFYQPES--SKLQEFKLNKQVLD--FLK   854
SEQ ID NO:32    -----AVSKFDYDIIKER-RFTRNQ-YEFHVPITMNFKAGS-V-----PFNQEVLS--FIK   863
SEQ ID NO:33    -----PSSKFDYDIIKER-RFTRNQ-YEFHVPITMNFKPAGS-G------QFNPDVLK--FIK   874
SEQ ID NO:20    -----KVSVRNVFHEITKER-RFTQDK-FFFHVPLTLNYKSANT-PR----RFNDLVKA--YIK   892
SEQ ID NO:445   -----KATIKKATHEIVKEK-RFTVDK-FFFHCPITINYKSKDK-PT----KFNDKVLD--FLR   894
```

FIG. 31 (Cont'd)

```
SEQ ID NO:331   --KVGFKEAKFDIIKDR-RFTQKT-YLPHCPITNNFKAFEITGR---KFEEKYQQ--YLK   941
SEQ ID NO:333   --KVICKKATRSITKDR-RFTEDA-YLPHCPITNNFKAPEITGR---KFNDKVLE--ALK   865
SEQ ID NO:334   --TVVCKVATRDIVKDK-RFTENT-YLPHCPITNNFKAKDSTNK---EFNNKVLE--VLN   868
SEQ ID NO:335   NYKVVYKTATRYITKDR-RFTEDT-YLPHCPITNNFKAPDKSNK---EFNNKVLE--VLS   902
SEQ ID NO:336   --VVYCKEATRNITKDN-RFTEDT-YLPHCPITNNFKAPDKSNK---EFNNQVLE--VLS   893
SEQ ID NO:446   --NLVVKEVTREIVKDA-RFAADK-FSFHVPVTINFKQPDV-SA---KFEDQVRA--FLR   901
SEQ ID NO:386   --FVIVKDVKREITKDK-RYEDK--FEFHVPLTNNFKSSDG-SR---YIKDBVKD--FLK   871
SEQ ID NO:387   --FVIVKDVKREITKDK-RYIEDK-FEFHVPLTINFKADDG-SK---RLNDQIKD--FLK   867
SEQ ID NO:399   --QVIVKDVTRELIIKDR-RYEKQFFYQFHVPIVFNANA-PQ-RP---KINERVLE--YIK   851
SEQ ID NO:400   --QVTVKDVQRELIIKDR-RYEKQFHYQFHVPIVFNANA-NG-KV---KFNDKVND--YIQ   850
SEQ ID NO:401   --QVTVKDVTRELIIKDR-RYIEPQE-YFFHVPLTFNANA-EG-NE---YIRENVLN--YLK   855
SEQ ID NO:402   --QVTVKDVTRELIIKDR-RYIEPQE-YFFHVPLTLNANA-DG-NE---YIREQVLN--YLK   880
SEQ ID NO:403   --QVVVKDVTREIVKDR-RYIEPE--FFFHVPITFNVNA-DG-NE---YIREQVNE--YLK   854
SEQ ID NO:404   --QVVVKDTNREIVKDR-RYIEPE--YFFHVPIVFNANA-DG-NE---YIRERVLD--YLK   855
                                    :       :*    :                  ..

SEQ ID NO:1     QSDNLQFTGIDRGERHLVYSCTIDRNAKIIKCRHMDNIR----------GTDYVKKLEDVA   987
SEQ ID NO:3     QSDNLQFTGIDRGERHLVYSCIVDKSTKILKCGHHDVIR----------GTDYVQRLEAVA   969
SEQ ID NO:436   KAKDFCIITGIDRGERHLAYYSVINQKGVIVDEGSLHEIS----------GTDYRKLLEGKE   935
SEQ ID NO:442   YCDDIYATGIDRGERNLLYACYVNDRGEIVKQVPLRFVG----------NTDYRQLLAERE   847
SEQ ID NO:564   KRKDWHITGIDRGERNLLYISIDLESNKIVKQSLRTITNEYSGKIY-TTDYRKLLERKE   865
SEQ ID NO:1385  RDDNPYVIGIDRGERNLLYIVVVEQKSHIVEQYSLREIINNPNGIRI-KTDYRSLLEKKE   880
SEQ ID NO:447   DCDKRYVTGIDRGERNLLYICVVDSEGRIIEQYSLREITNETNGNTY-STDYRALLDERKE   925
SEQ ID NO:57    YEDDRYVTGIDRGERNLIYISVIDSNGKIVEQMSLREITSD---NGR-KVDYQKLLETRE   906
SEQ ID NO:74    YEDDRYVTGIDRGERNLIYISVINSNGEIVEQMSLREITGD---NGY-SVDYQKLLERKE   884
SEQ ID NO:59    YEDDRYVTGIDRGERNLIYISVIDSNGKIVEQMSLREITSD---NGR-RVDYQKLLETRE   884
SEQ ID NO:116   ESKVTHITGIDRGERNLLYLSVIELQSNIVEQYSLREIVNETNDCNY-RTNYRDLLGIRE   964
SEQ ID NO:119   ESNSTHITGIDRGERNLLYLSLIELQGDIVEQYTLREIGN----------TNYRDLLGIKE   977
SEQ ID NO:440   NNGIKHITGIDRGERNLLYMVITELKSNIVEQKSLRQIASNPKLPLF-RQDYRKLLKTKA   933
SEQ ID NO:446   QDGVRHITGIDRGERNLLYLVMVMESKIKKQISLREIAGNPKNSEF-KQDFRALLKERE   913
SEQ ID NO:32    EEGIKHITGIDRGERNLLYLTMINNRKGEIVEQFSLRDVASNPNNPEY-KQDYRELLSRKE   923
SEQ ID NO:23    ARGIKHITGIDRGERNLLYIMIELKEKIVEQSASNPNPDF-KQDYNTMLAIRE   933
SEQ ID NO:20    KNPDVHITGIDRGERNLLIYAVVIEGKGKIVEQRSFRIVGG----------YNYQERLWQKE   943
SEQ ID NO:446   KEDINITGIDRGERNLIYATVINQKGEIIDCRSFRTIRHQSSSVNY-DVDYRNKLQERE   953
SEQ ID NO:331   NNPDVKITGLDRGERNLIYLSLINQKGEIBLQKTLRLVEQVRNDKTV-SVNYQEKLVQKE   1000
SEQ ID NO:333   ERPETKITGIDRGERNLIYLSLINQKGEIBLQRTLRLVDQIRNDKTV-QINYQEKLVQNE   944
SEQ ID NO:334   KNPDKVITGIDRGERNLIYLSLINQKGEIBLCQRTLRLVEQVRNDKTV-SVNYRERLVRKE   947
SEQ ID NO:335   GNPNVKITGIDRGERNLIYLSLINQKGEIBLQRTLRLVEQVRNDKTV-KVNYQERLVRKE   961
SEQ ID NO:336   DRPDVKITGIDRGERNLIYLSLINQKGEIBLQRTLRLVDQVRNDKTV-KVNYQEKLVRKE   952
SEQ ID NO:446   ARPDVKVTGIDRGERNLLYLALVDREGNLLEQRSFRTVSRTRKDGVVTPTDYQAKLVQSE   961
SEQ ID NO:386   NNPDVNITGIDRGERNLIYMTLINQKGEILIQKSFRLVG----------NTNYREKLSIRE   922
SEQ ID NO:387   NNPDVNITGIDRGERNLIYMTLINQKGEILIQKSFRLVG----------NTNYREKLSIRE   938
SEQ ID NO:399   ENPDVNITGIDRGERNLVYLTLINQKGEILKQKTFRVVG----------KYNYQERLKQRE   902
SEQ ID NO:400   DNPDVNITGIDRGERNLIYLTLINQKGEILKQKTFRVVG----------NYDYQERKLKQRE   901
SEQ ID NO:401   DNPDVNITGIDRGERNLIYLTLINQKGEILKQKTFRVVN----------SYNYQAKLEQRE   906
SEQ ID NO:402   YNPDVNITGIDRGERNLIYLTLINQKGEIIKQRTFRIVN----------NYNYQVKLEQRE   931
SEQ ID NO:403   DNPDVNITGIDRGERNLIYLTLINQKGEILKQKTFRIVG----------NYNYRAKLEQRE   905
SEQ ID NO:404   DNPEVNITGIDRGERNLIYLTLINQKGEILKQKTFRMVG----------NYNYRAKLELRE   906
                **;*****;;* *     : : : : ; ;       (:     *

SEQ ID NO:1     DERIIAKKNWQAQNKIRDLKTGYISHVVHRLVEETIKDGEKIAFHAYIVLEDLNTEMKRG   1047
SEQ ID NO:3     DERIVAKKNWQQNKIRDLKNGYISHVVHRLVEETIKDGKIAFHAYIVLEDLNTEMKRG   1029
SEQ ID NO:436   KEETANRQAMLFVRQIKDLKRGYVSHVKKICDLAIEK------NAIIVLENLMPFKQI   989
SEQ ID NO:442   EERMNSRKNVKIIDNIKNLKEGYLSQAIRIITDFMVEY------NAVLVLEDLNFPFKER   901
SEQ ID NO:564   EKRKVARQTWNTIENIKELKAGYMSQVHKITQLMKEY------NAIVVLEDLNTOFKRG   939
SEQ ID NO:1385  KERFEAKQWTSIERIKELKAGYISQVVRKICELVEKY------DAVIALEDLNSGFKNS   934
SEQ ID NO:447   KEELESRKNWTVENIKELKEGYISQVVHKICELVEKY------DAVIVMEDLNFGFKQ   979
SEQ ID NO:57    KEDKARKNWTSVENIKELKEGYISQVVRKICELVVKY------DAVIAMEDLNFGFKRG   960
SEQ ID NO:74    KEDKARKNWTSVENIKELKEGYISQVVRKICELVVKY------DAVIAMEDLNFGFKRG   938
SEQ ID NO:59    KEDKARKNWTSVENIKELKEGYISQVVRKICELVVKY------DAVIAMEDLNFGFKRG   938
SEQ ID NO:116   RQRDEARPSNLTTERIKELKEGYMSQVVRLIAQLIVKY------NAIVVLEDLNTOFIRG   1038
SEQ ID NO:119   KQRKEARPNWMEIENIRELKEGYMSQVIHIIAQLMVKY------NAIVVLEDLNMGPNRG   1031
SEQ ID NO:440   DANAQARRDWETISTVKEIKFGFLSQIVRSIAMSIIKY------DAIVVLENLNRGPNQR   987
SEQ ID NO:446   GDRLESRPSWNTIQEIKDLKEGYMSLVVHEIAPNMLEN------DAIVVLENLNRSFPMQK   967
```

```
SEQ ID NO:118    IGKQCGFLSYVPAWNTSKMDPTTGFVNLDT-RYESN-DKAKAFPAKFRSIRQNVS--KG    1145
SEQ ID NO:119    LGKQCGFTSYTPAWNTSKMDPTTGFVNLLDT-RYESN-EKAKAFPGKFSIRNNAA--KG    1146
SEQ ID NO:440    NVRQSGFVSYTPAWLTSKIDPVTGFASFLRFHRDDSN-ATIKSTISKFDCFYDKE--CD    1099
SEQ ID NO:446    AIRQCGFTSYTPAWNTSKIDPVTGFVPNLRC-QYESI-VASKDFFGRFDSIYYDAT--QK    1078
SEQ ID NO:32     NVRQCGFVSYTPAWNTSKDPVTGYVRLFDT-RLSTI-GEIKAFFSKFDRIKYNSK--ND    1087
SEQ ID NO:33     NVRQCGFVSYTPAWNTSKDPATGFVNLFDT-RLSTI-GEIKAFFSKFDRISYDAS--ND    1098
SEQ ID NO:20     MNQQTGFLSYVPAAYTSKIDPLTGPVDCFSNWKQIKENTESPKAFIGLFSLCYDAR--TN    1107
SEQ ID NO:445    IGNQCGFLSYVPAAYTSKIDPSTGPVNLLRFNEYMRS-DKRRELYCRFYRICYVQR--EN    1116
SEQ ID NO:331    VGKQCGWTSYTPAAYTSKIDPRTGFANLFYTAGLTRI-EKKRDFFDKFDSIRYDSK--TD    1162
SEQ ID NO:333    VYKQCGWLSYTPAGYTSKIDPRTGFANLFYTKGLTRV-EKKRDFFSKFDSIYYDRE--EA    1106
SEQ ID NO:334    VYKQCGWLSYTPAAYTSKIDPRTGFANLFITKGLTRV-EKKRDFFGKFDSIRYDAT--ES    1109
SEQ ID NO:335    VYKQCGWLSYTPAAYTSKIDPRTGFANLFITKGLTRV-EKKRDFFDKLDSIRYDSK--ED    1123
SEQ ID NO:336    VYKQCGWLSYTPAAYTSKIDPRTGFANLFITKGLTRV-EKKRDFFDKFDSIRYDSK--ED    1114
SEQ ID NO:446    IGKQTGFLSYVPAGYTSKIDPTTGFTNLFRTKECTRA-AGIRDFFAAFDAIRNDAA--RR    1123
SEQ ID NO:336    IRKQNGFLSYVPAAYTSKIDPTTGPVNLFRFTDLTRA-EKKRDFLTNPDDITFDSE--TN    1084
SEQ ID NO:337    MGKQNGFLSYVPAAYTSKIDPTTGFVNLFRFTDLTRA-EKKRAFLTNPDDITYDSE--TS    1100
SEQ ID NO:398    IGKQTGFLSYTPAAYTSKIDPATGPVRHFRFNDITRA-EKRKFFMENERIEM--R--NG    1062
SEQ ID NO:400    IGRQTGFLSYTPAAYTSKIDPVTGPVRHFRLNDITRA-EKRKAFLMNERIEV--K--NG    1061
SEQ ID NO:401    LGKQSGFLSYTPAAYTSKIDPITGFVRHFRFNDITRA-EKRKFLMEMERIEM--R--NG    1066
SEQ ID NO:402    LGKQSGFLSYTPAAYTSKIDPVTGPVRHFRFNDITRA-EKRKDFLMEMERIEM--R--NG    1091
SEQ ID NO:403    LGKQSGFLSYTPAAYTSKIDPVTGPVRHFRLNDITRA-EKRKAFLMEMERIEM--R--NG    1065
SEQ ID NO:404    LGKQSGFLSYTPAAYTSKIDPVTGPVRHFRLNDITRA-EKRKAFLMNERIEV--K--NG    1066

SEQ ID NO:1      YFEYT--------------EANAGRTWRLYSGKDGKPLPRFQNKKQI------QQDK    1194
SEQ ID NO:3      YFEYT--------------EANVGRTWRLYSGRNGKALPRFQNKKQA------LQDK    1175
SEQ ID NO:436    SYFIT--TDPVRLVERKERTKTISKLNTVYADVP--RIPREPNEQSV------         1140
SEQ ID NO:442    YFEFE--FDYRDFTD---RAQGTRSKNTVCSFGP--RIEGFRNP---------EKN    1043
SEQ ID NO:564    YYEFR--IDFNEFTD---RGKDTKTDNNICSFGK--RIDNARNQ---------R--    1086
SEQ ID NO:1365   LFEFA--LDYKNFSR---TDADYIRNKLYSGYN---RIPIFPNF---------KKN    1081
SEQ ID NO:447    YFEFE--LDYNKFPR---CNTDYRKKNTVCYGS---RIKTFRNP---------EKN    1123
SEQ ID NO:57     MFEFY--IDYGKFPR---CRSDFRKTNTVCNSS---RILTFPNK---------EKN    1107
SEQ ID NO:74     MFEFC--IDYGKFPR---CRSDFRKTNTVCNSS---RILSFRNE---------EKN    1084
SEQ ID NO:59     MFEFC--IDYGKFPR---CRSDYRKTNTVCNSS---RILTURNK---------EKN    1064
SEQ ID NO:118    WFEFA--IDYNEFTS---EAAGTKTQNTLCTYGT--RIETKRDT---------KQN    1185
SEQ ID NO:119    WFEFE--FDYNFFTT---RAADTRTPNTLYTGT---RIETKRDP---------RQK    1186
SEQ ID NO:440    MFHIR--IDYNKFST---BCSGQQPKNDLFTFGD--RILAERNT---------MQN    1139
SEQ ID NO:446    YFVFQ--TDFTKFNT---ESKGGIQKNDICYGD---RIYTPRTE---------DRN    1118
SEQ ID NO:32     AFEFT--FDYRNFTT---RAEGTRTCNTISSQGE--RIFTHRSK---------EQN    1127
SEQ ID NO:33     VFEFS--FDYRNFTS---RAQGTRRNTVTTRGE---RIFTHRSK---------EKN    1133
SEQ ID NO:20     NFVLHYRHKANRYVR---GGNLDITENDILIQEN--KEVVSKTGKSYRQKRIIYPKGGG    1162
SEQ ID NO:446    LFKFS--IDYGKLCF---DSKIPVRKNDIFSYGK--RIVKED-----------LRTG    1155
SEQ ID NO:331    SFVFT--FDYSRFGR---NADFKKKNELYSKGE---RLVFSKAE----------    1193
SEQ ID NO:333    CFVFA--FDYSKFGR---RADFKKKNEVYTKGE---RLVYSKGE----------    1142
SEQ ID NO:334    CFVFS--FDYAKICD---NADYKKKNDVYTKGT---RLVYNKTE----------    1145
SEQ ID NO:335    CFVFG--FDYGKICD---NADFKKKNEVYTKGE---RLVYNKTE----------    1159
SEQ ID NO:336    CFVFG--FDYGKICD---NADFKKKNEVYTKGE---RLVYNKTE----------    1150
SEQ ID NO:446    VFAFS--FDYPNFKT---SQESHRTKNTVYSADR--RLAFDKES----------    1160
SEQ ID NO:396    SFAFT--FDYSKFKV---FQTDFQKTNTVFTNGK--RIVYDRE-----------    1123
SEQ ID NO:397    TFALT--FDYSKFKV---FQTDYGKTNTIFTNGK--RIVYDRE-----------    1137
SEQ ID NO:399    NVEFE--FDYRKFKT---YQTDFQSVNTVNTSGK--RIVFDTEK----------    1099
SEQ ID NO:400    NVEFE--FDYRKFKT---FQTDFQSVNTVNTSGK--RIIFDTET----------    1098
SEQ ID NO:401    NIEFE--FDYPKFKT---FQTDYQNLNTVSFYGK--RIVMRIDDKGY-------    1106
SEQ ID NO:402    YIEFT--FDYPKFKT---YQTDYQSVNTVSTFGK--RIVMRIDEKGY-------    1131
SEQ ID NO:403    DIEFE--FDYPKYKT---YQTDYQNINTVNSSGK--RIVMRIDENGR-------    1105
SEQ ID NO:404    NVEFE--FDYPKFKT---YQTDYQNINTVNTSGK--RIVFDGET----------    1103

SEQ ID NO:1      NIWVPEQINVVKILESIFADFDKAKSFKTQIEEGIELKK------------AGSRTETANQS    1244
SEQ ID NO:3      NVWVPEKINVVDILNKLPAKFDKKFSFKSQIEAGVBLQK------------DEERNETANQS    1225
SEQ ID NO:436    ---WNARNVNFNDMFKSLFEAWNFEDKIATDLRSKIEERMRNGELGSYKMIDGRERNFFA    1198
SEQ ID NO:442    NMWDGREIDITERIKKLLDDYKVSLS-E-DIKAQIMDI-------------NTKDFFER    1092
SEQ ID NO:564    GDFESKMIDITNEFRNLFKKYGINDR-S-NLKEDILNV-------------KEAKFYKE    1139
SEQ ID NO:1365   NVFDNEEVCLTSAYKSLFNKYGINYQQG-DIRALLCED-------------SDKAFYGS    1126
```

FIG. 31 (Cont'd)

```
SEQ ID NO:447    SEWDRKTVELTPAFNALFEKYSIDYN-G-DIKAQIMSV---------------DKKDFFVE      1172
SEQ ID NO:57     NWWDRKQIVLTSEFKSLFREFGIDYK-G-RLKSSILSI---------------SNADFYRR      1151
SEQ ID NO:74     NEWDRKQIVLTDEFKSLFREFGIDYK-S-DLKASILSI---------------SNADFYNR      1128
SEQ ID NO:59     NWWDRKQIVLTSEFKSLFGEFGIDYK-G-RLKTSILSI---------------SNADFYRR      1128
SEQ ID NO:118    NRFVSDEFDLTSFKVLFRKYRIDYN-G-RLMEQICSQ----------------RDRTFFKE      1229
SEQ ID NO:119    NRFVSEEFDLTSFKELFVKYRIDLN-D-RLKEQICLQ----------------RDRSFFKE      1230
SEQ ID NO:440    SRYVQTVNLTSEFKRLFATKDIDFS-G-RLKDSICKI----------------EDVGFFRK      1183
SEQ ID NO:446    NSFVSERVNLTEAMKSLFVLRRINIQ-G-DIKAGIMQQ---------------TQKAFFES      1162
SEQ ID NO:32     NQFVSKTVBPTQLFKDVFKMACCEIN-G-RLKEGIASI---------------ESLEPLRQ      1171
SEQ ID NO:33     NQFVSELVSPTSLLKDVLEKTGTNLQ-G-RLKEAIASL---------------QSLDELRQ      1162
SEQ ID NO:20     NRGEASPYYPREELQSLLEEKGISYKAGKNILPKIEAA---------------ND-NALVEK     1203
SEQ ID NO:445    YMKENESYDPTEELKSLFTLMRVEYKKGENILETISIR---------------DMSREFWNS     1292
SEQ ID NO:331    --KSVRENPTERLKALFDKGGINWSSEDRIIDQIQAVQ-------AERENCAFYDG           1246
SEQ ID NO:333    --RKSITVSPTEELKEIFREFSINWNSESVLDQIATIP-------AEKINAKFFDT           1190
SEQ ID NO:334    --RKRVSVNPTEELCVFDEFGIKWNTGEDLIESISLIP-------AEKSNAKFFDV           1193
SEQ ID NO:335    --RKNININPTEELKSIFDDFGINWNEERFIDSVRTIQ-------AEKSNAKFFDI           1207
SEQ ID NO:336    --RKNISTNPTEELKSIFDDFGINWNEERFIDSVRTIQ-------AEKSNAKFFDT           1193
SEQ ID NO:446    --RSERSTNPTAILLGALEERGIAVADGFDLKALLLATE------PSKANAAFYRS           1203
SEQ ID NO:396    --KKYNTTEPTTIIQEALEKGCVQCVDQLPVLAEIEKIE------T--ENASFFRS           1167
SEQ ID NO:397    --KTRNTTEPTTIIQEALEKGCIQCVDQLRVLTEIEKIE------PTRENARFFDS           1185
SEQ ID NO:399    --REHKAVYPTQEFVQAFSNKGITLEEGMDIKAFIGGIE------ADIENASFFSS           1147
SEQ ID NO:400    --RKAKDVYPTKEIAQSFANKGIALEEGMDLKAIIAEVE------PDVENAAFYKS           1146
SEQ ID NO:401    --KQMVDYEPTKDIVRTFENKGIQLTEGSDLKALIADIE------ANATNAGFFNT           1154
SEQ ID NO:402    --KKMVDYEPTNDYIYAFENKGILLSEGSDLKALIAGVE------ANATNAGFFGT           1179
SEQ ID NO:403    --KQMTDYFPTKEIVKAFSDKRITLCEGTDLKALMAVID------TSPENASLYGT           1153
SEQ ID NO:404    --RKAKDVYPTQEIIAAFEEKGINLNDGTDLKFLIADIE------ANAENASFYVA           1151
                         :   ..  :

SEQ ID NO:1      LRYALKLIQQIRNSGEKD-SKDNFLYSFVRNENGESFDTR-NFEKNG-------DLSRIV      1296
SEQ ID NO:3      LRFALDLIQQIRNSGEKN-SGDNFLYSFVRNDKEEFDTR-NYKNNG--------ELSRIR      1277
SEQ ID NO:436    FIYIFNIILDTRNSSDKT-----DFIASFVAF----FFTTL-NAPKPNF------CDIRLA     1243
SEQ ID NO:442    LIKYFKLVLQMRNSKYGT---DIDYLIFVRNEQNEFYDSR-KK--------NEKLPM      1139
SEQ ID NO:564    FINLFKLMLQTRNSESNE---KVEFLQSFVKNNKEFFNSN-NVNGN--------EAPE      1177
SEQ ID NO:1365   FMALMSLMLQMRNSITGKT---DVEFLISFVKNSDGIFYDSR-NYEAQE------NAILPK     1177
SEQ ID NO:447    LIGLLRLTLQMRNSETGKV---DRDYLISFVKNSEGVFYRSD-DYKGIE-------NASLPK     1223
SEQ ID NO:57     LIKLLSLTLQMRNSITGSTLFEDDYLISFVANENGEFYDSR-NYKGT--------NAALPC     1203
SEQ ID NO:74     LIKLLSLTLQMRNSIIGSTLFEDDYLISFVANDRGEFYDSR-NYKGE--------NAALPC     1180
SEQ ID NO:59     LIKLLSLTLQMRNSITGSTLFEDDYLISFVANDRGEFYDSR-NYKGM~~~~~~~~NAALPC     1180
SEQ ID NO:118    LLEMLELTLQMRNSITGT---EVDYLISFVNNASGKFYDSR-TC-----------ERNLPK     1275
SEQ ID NO:119    LLEHLLQLTLQMRNSKIGT---DVDYLISFVNNDKGKFYDSR-NC-----------GKNLPE     1276
SEQ ID NO:440    LSQLLSLTLQLRNSNAET---GEEFLISFVAEKDGEFFDSR-NC-----------FDSLPK     1229
SEQ ID NO:446    LRRLLRLTLQIRNSKRSTGENYEDYIISFVNGKDGRFFDSR-NA-----------DATQPK     1213
SEQ ID NO:32     LLHAFKLVIQMRNSITGE---EVDFLLSFAIDAKGTNFDSR-KG-----------ISTLPE     1217
SEQ ID NO:33     LLHAFKLTNQMRNSVTGT---DVDYLISFAIDAKGSMFDSR-EC-----------DSTMPL     1228
SEQ ID NO:20     LRYIIKAVLQLRNSNSET---GEDYISSFVEGRKDWCFDSR-AADEA--------LPQ      1254
SEQ ID NO:445    LFKIFKAILQMRNSLTRS---PVEFLLSFVKGRDATFFDTD-KVDGT--------KPEKLK     1251
SEQ ID NO:331    LYRSFTAILQMRNSVPRSSKGEDDYLISFVNAEDGSFYDSREEAEKGKTTDCKWISKLPV     1306
SEQ ID NO:333    LLRAFNATLQMRNSVPRSSRGEDDYLISFVKARDGTFYDSRIEAEKGIDEKNGPWVSKLPV     1280
SEQ ID NO:334    LLRMFNATLQMRNSVPNT---DTDYLVGFVKABDGSFFDSREEFKGGI--------AKLPI     1244
SEQ ID NO:335    LLRMFNATLQMRNSIPNT---EIDYLISFVKSEDGTFFDSREELKKGEN--------AKLPI     1258
SEQ ID NO:336    LLRMFNATLQMRNSIPNT---EIDYLISFVKSEDGTFFDSREELKKGEN--------AKLPI     1249
SEQ ID NO:446    VFYAFDRTLQMRNSRA-----EEDYIHSFVLNARGGFDSR-EAG-----------DALPR      1252
SEQ ID NO:396    ICYAFEKSLQMRNSNET---DDDYILSFVKNKNGVFFNSN-EAD-----------DKLPK      1213
SEQ ID NO:397    ICYAFEKTLQLRNSNSET---GDEYILSFVKNKNGIFFNSN-EAD-----------DKLPK      1231
SEQ ID NO:399    LFYAFKTTLRMRNSNADT---REDYILSFVVHGRQFSTD-EVNKGKEADGNWISKLPV      1203
SEQ ID NO:400    LFYAFENTLRMRNSNETT---QEDYILSFVAINGKQFSTTD-EANKGRDADSNWLSKLPV      1202
SEQ ID NO:401    LLYAFQKTLQMRNSNAAT---EEDFIFSFVARDGRYFGMD-EANKGRDAQSNWVSKLPI     1210
SEQ ID NO:402    LLYAFQKTLQMRNSNALT---EEDFILSFVARDGHHFCSTD-EANKGRDAQSNWVSKLPV     1235
SEQ ID NO:403    LFYAFQKTLQMRNSEBAT---EEDYILSFVTQGNKQFNTKD-EADKGQESAGNWVSKFPV     1209
SEQ ID NO:404    IFDAFKRTLQMRNSNAAT---EEDYILSFVVCNGKQFCTTD-EVNKGKEADSNWLSKLPV     1207
                       :  ; ;*      ;  ;  ;

SEQ ID NO:1      DADANGAYNIARKGLIMDAHYKKWIESGRPKTKDGKEKSDLDLFISDKSMDLWLLDREQ        1356
SEQ ID NO:3      DADANGAYNIARKGLIMETHIKHWINNGRPKTKIDGSEVSDLDLFISDKSWDLWLLDREQ       1337
```

FIG. 31 (Cont'd)

```
SEQ ID NO:436   NGDSLGAYNIAREGIITIGRIRDNP--------------EKPDLYISKEQWDEWATKRGI  1269
SEQ ID NO:442   DADANGAYNIARRGLMFIDIIKETE--------------DKDLKMPKLFIENKDWLRYVQKSDL 1169
SEQ ID NO:564   NADANGAYNIARRGLWIVEQIRKMP--------------DSQMEKTKLAMKNQEWLLEAQKGNV 1227
SEQ ID NO:1365  NADANGAYNIARKVLNAIGQFKKAE--------------DEKLQKVKIAISNKEWLEYAQTSVK 1227
SEQ ID NO:447   DADANGAYNIARRGLWIIEQIRACE--------------NDAELNKTRLAMSNAEWLEYAQKK-- 1272
SEQ ID NO:57    DADANGAYNIARKALWAIRVLRDTP--------------DDMLNKAKLSITNAEWLEYTQK--- 1250
SEQ ID NO:74    DADANGAYNIARKALWAIRVLRDTP--------------DDMLQKAKLSITNAEWLEYTQR--- 1227
SEQ ID NO:59    DADANGAYNIARKALWAIRVLRSTP--------------DDMLNKANLSITNAEWLEYTQK--- 1227
SEQ ID NO:118   NADANGAYNIARRGLWIVEQIRRSD------------NTSKLKIAISNKEWLRYTQGLVD 1323
SEQ ID NO:119   NADANGAYNIARRGLWIIDQIERTD------------DLSRLRLAISNKEWLQYAQKMV- 1323
SEQ ID NO:440   DADANGAYNIARRGLMLVEQLRRCK--------------DVSKFKPAIKNEDWLDYVQR--- 1274
SEQ ID NO:446   DADANGAYNIARRGLMLLRQIQAQE-------------------KQDLSNGRWLEFAQR--- 1251
SEQ ID NO:32    NADANGAYNIARKGLMTVEQIQNAD--------------DIANTKYSVSNKDWLEFAQG--- 1262
SEQ ID NO:33    NADANGAPNIARKGLMTVEQIQKVD--------------DTGNLKYAVTNKDWLTFAQK--- 1273
SEQ ID NO:20    DADANGAPHIARKGLLMFRIPND-------------------SKLAISNEDWLRYIQGLRS 1297
SEQ ID NO:445   DADANGAYHIALRGLLILENDSVK--------------TDKELKNVEKVSLEDWLKFVQISLR 1301
SEQ ID NO:331   DADANGAYHIALRGLYLLQNNPNLR------------EN---GYIERISNADWFREVQEREY 1353
SEQ ID NO:333   DADANGAYHIALRGLYLLENNPNRR------------EK---GVIQNISNVEWFRFAQTR-- 1295
SEQ ID NO:334   DCDANGAYHIALRGLYLLLNDFNRD------------NK---GVIQNISNKDWFREVQERVY 1291
SEQ ID NO:335   DADANGAYHIALRGLYLLENDFNRR------------DK---GVIQNISNADWFREVQEREY 1305
SEQ ID NO:336   DADANGAYHIALRGLYLLENDFNRR------------DK---GVIQNISNADWFREVQGREY 1296
SEQ ID NO:448   EADANGAYHIALRGVQLLENLAAE------------T-----PNLKIERKDWFREAQELAE 1297
SEQ ID NO:386   DADANGAPHIALRGLYLLQHI-SET-----------D-----SKLKIPHERWFREVQSRNK 1257
SEQ ID NO:387   DADANGAPHIALRGLYLLQHI-SET-----------D-----SKLKIPHERWFREVQSRNK 1275
SEQ ID NO:399   DADANGAYHIALRGLYLLNF-----------------------QTKKIENERWLQFMAEKPY 1243
SEQ ID NO:400   DADANGAYHIALRGLYLLNF-----------------------QTKKIENERWFQFMIERLY 1242
SEQ ID NO:401   DADANGAYHIALRGLYLLNF-----------------------ETKKIENERWLQFMVERPY 1250
SEQ ID NO:402   DADANGAYHIALRGLYLLNF-----------------------ETKKIENERWFQFMVERPY 1275
SEQ ID NO:403   DADANGAYHIALRGLFLLNQ-----------------------QTKKIENQERWLQFMVQRPY 1249
SEQ ID NO:404   DADANGAYHIALRGLYLLNF-----------------------QTKKIENERWFQFMVERPY 1247
                  :  *:  **:**  *  (                                (    ,* (

SEQ ID NO:1     WEKDLPAFASLSAKEDADESKAGRGREKQ   1395
SEQ ID NO:3     WMKELPTPASKIAKYDSDAPYTAKPREKR   1366
SEQ ID NO:436   QL---------------------------   1291
SEQ ID NO:442   -----------------------------   1198
SEQ ID NO:564   -----------------------------   1227
SEQ ID NO:1365  E----------------------------   1228
SEQ ID NO:447   -----------------------------   1272
SEQ ID NO:57    -----------------------------   1250
SEQ ID NO:74    -----------------------------   1227
SEQ ID NO:59    -----------------------------   1227
SEQ ID NO:118   -----------------------------   1323
SEQ ID NO:119   -----------------------------   1323
SEQ ID NO:440   -----------------------------   1274
SEQ ID NO:446   -----------------------------   1251
SEQ ID NO:32    -----------------------------   1262
SEQ ID NO:33    -----------------------------   1273
SEQ ID NO:20    -----------------------------   1297
SEQ ID NO:445   G----------------------------   1302
SEQ ID NO:331   AK---------------------------   1355
SEQ ID NO:333   -----------------------------   1295
SEQ ID NO:334   KD---------------------------   1293
SEQ ID NO:335   RD---------------------------   1307
SEQ ID NO:336   EK---------------------------   1298
SEQ ID NO:448   RKFR-------------------------   1301
SEQ ID NO:386   -----------------------------   1257
SEQ ID NO:387   -----------------------------   1275
SEQ ID NO:399   KE---------------------------   1245
SEQ ID NO:400   LK---------------------------   1244
SEQ ID NO:401   LE---------------------------   1252
SEQ ID NO:402   LE---------------------------   1277
SEQ ID NO:403   KS---------------------------   1251
SEQ ID NO:404   LE---------------------------   1249
```

GENE EDITING COMPONENTS, SYSTEMS, AND METHODS OF USE

RELATED APPLICATIONS

This application is a continuation of International Application PCT/US2023/070339 filed Jul. 17, 2023, which claims priority under 35 U.S.C. § 119(e) to U.S. Provisional Application Ser. No. 63/368,722, filed Jul. 18, 2022; U.S. Provisional Application Ser. No. 63/368,724, filed Jul. 18, 2022; U.S. Provisional Application Ser. No. 63/368,726, filed Jul. 18, 2022; U.S. Provisional Application Ser. No. 63/368,728, filed Jul. 18, 2022; U.S. Provisional Application Ser. No. 63/368,730, filed Jul. 18, 2022; U.S. Provisional Application Ser. No. 63/368,731, filed Jul. 18, 2022; U.S. Provisional Application Ser. No. 63/368,734, filed Jul. 18, 2022; U.S. Provisional Application Ser. No. 63/368,735, filed Jul. 18, 2022; U.S. Provisional Application Ser. No. 63/368,736, filed Jul. 18, 2022; U.S. Provisional Application Ser. No. 63/368,737, filed Jul. 18, 2022; U.S. Provisional Application Ser. No. 63/368,738, filed Jul. 18, 2022; U.S. Provisional Application Ser. No. 63/368,741, filed Jul. 18, 2022; U.S. Provisional Application Ser. No. 63/368,742, filed Jul. 18, 2022; U.S. Provisional Application Ser. No. 63/368,744, filed Jul. 18, 2022; U.S. application Ser. No. 18/297,346, filed Apr. 7, 2023; U.S. Provisional Application Ser. No. 63/495,198, filed Apr. 10, 2023, each of which are incorporated herein by reference in their entireties.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SEQUENCE LISTING STATEMENT

This application contains a sequence listing filed in electronic form in eXtensible Markup Language (XML) formate entitled J0356_99003.xml, created Aug. 8, 2023 and having a size of 2,053,139 bytes. The content of the sequence listing is incorporated herein in its entirety.

TECHNICAL FIELD

The present disclosure generally relates to systems, methods and compositions used for precise genome editing, including nucleic acid insertions, replacements, and deletions at targeted and precise genome sites, wherein said systems, methods, and compositions are based on novel and/or engineered class II/type V Clustered Regularly Interspaced Short Palindromic Repeats (CRISPR)-Cas systems.

BACKGROUND

Genome editing tools encompass a diverse set of technologies that can make many types of genomic alterations in various contexts. These technologies have evolved over the last couple of decades to provide a range of user-programmable editing tools that include ZFN (zinc finger) nuclease editing systems, meganuclease editing systems, and TALENS (transcription activator-like effector nucleases). The past decade has seen an explosive growth in a new generation of genome editing systems based on components from bacterial immune pathways, including CRISPR (clustered regularly interspaced short palindromic repeats) and the associated CRISPR-associated proteins (e.g., CRISPR-Cas9) (Jinek et al., "A programmable dual-RNA-guided DNA endonuclease in adaptive bacterial immunity," *Science*, Vol. 337 (6096), pp. 816-821), meganuclease editors (Boissel et al., "megaTALs: a rare-cleaving nuclease architecture for therapeutic genome engineering," *Nucleic Acids Research* 42: pp. 2591-2601) and bacterial retron systems (Schubert et al., "High-throughput functional variant screens via in vivo production of single-stranded DNA," *PNAS*, Apr. 27, 2021, Vol. 118(18), pp. 1-10). In particular, CRISPR-Cas9 has been derivatized in numerous ways to expand upon its guide RNA-based programmable double-strand cutting activity to form systems ranging from finding alternative CRISPR Cas nuclease enzymes having different PAM requirements and cutting properties (e.g., Cas12a, Cas12f, Cas13a, and Cas13b) to base editing (Komor et al., "Programmable editing of a target base in genomic DNA without double-stranded DNA cleavage," *Nature*, May 19, 2016, 533 (7603); pp. 420-424 [cytosine base editors or CBEs] and Gaudelli et al., "Programmable base editing of A-T to G-C in genomic DNA without DNA cleavage," *Nature*, Vol. 551, pp. 464-471 [adenine base editors or ABEs]) to prime editing (Anzalone et al., "Search-and-replace genome editing without double-strand breaks or donor DNA," *Nature*, December 2019, 576 (7789): pp. 149-157) to twin prime editing (Anzalone et al., "Programmable deletion, replacement, integration and inversion of large DNA sequences with twin prime editing," *Nature Biotechnology*, Dec. 9, 2021, vol. 40, pp. 731-740) to epigenetic editing (Kungulovski and Jeltsch, "Epigenome Editing: State of the Art, Concepts, and Perspective," *Trends in Genetics*, Vol. 32, 206, pp. 101-113) to CRISPR-directed integrase editing (Yarnell et al., "Drag-and-drop genome insertion of large sequences without double-stranded DNA cleavage using CRISPR-directed integrases," *Nature Biotechnology*, Nov. 24, 2022, doi.org/10.1038/s41587-022-01527-4 ("PASTE")).

In particular, application of CRISPR-associated systems ("CRISPR-Cas systems") in human therapeutics is anticipated to be curative in ameliorating various monogenic diseases and disorders. Current clinical trials are underway to treat, for instance, Transfusion-dependent β-thalassemia (TDT) and sickle cell disease (SCD) by the autologous transfusion of CRISPR/Cas9-edited CD34+ hematopoietic stem cells Frangoul, Haydar et al. "CRISPR-Cas9 Gene Editing for Sickle Cell Disease and β-Thalassemia." *The New England journal of medicine* vol. 384,3 (2021): 252-260. doi:10.1056/NEJMoa2031054 and ATTR amyloidosis Gillmore, Julian D et al. "CRISPR-Cas9 In Vivo Gene Editing for Transthyretin Amyloidosis." *The New England journal of medicine* vol. 385,6 (2021): 493-502. doi: 10.1056/NEJMoa2107454, which is incorporated herein by reference.

The potential of such CRISPR-Cas systems has sparked the discovery of many novel CRISPR-Cas variants where such systems have been classified into 2 classes (i.e., class I and II) and 6 types and 33 subtypes based on their genes, protein subunits and the structure of their gRNAs. Makarova, K. S., Wolf, Y. I., Iranzo, J. et al. Evolutionary classification of CRISPR-Cas systems: a burst of class 2 and derived variants. Nat Rev Microbiol 18, 67-83 (2020). doi:10.1038/s41579-019-0299-x, which is incorporated herein by reference.

Among the diverse CRISPR-Cas systems, class II has the most extensive applications in gene editing due to its earlier discovery and by virtue of it having only one effector protein. By contrast, the effector nucleases of the type V family are diverse due to extensive diversity over the N-terminus of the protein, as evident by comparing the crystal structures of Cas12a, Cas12b, and Cas12e type V nucleases (Tong et al., "The Versatile Type V CRISPR Effectors and Their Application Prospects," Front. Cell Dev. Biol., 2021, vol. 8). The C-terminus regions of the type V effector nucleases are more highly conserved, however, which comprise a conserved RuvC-like endonuclease (RuvC) domain. It is reported that the RuvC domain of type V effectors is derived from the TnpB protein encoded by autonomous or non-autonomous transposons (Shmakov et al., "Diversity and evolution of class 2 CRISPR-Cas systems," 2017, Nat. Rev. Microbiol. 15, 169-182. doi: 10.1038/nrmicro.2016.184). The type V systems are further subdivided into many subtypes, including types V-A to V-I, type V-K, type V-U, and CRISPR-CasΦ (Hajizadeh et al., "The expanding class 2 CRISPR toolbox: diversity, applicability, and targeting drawbacks," 2019, BioDrugs 33, 503-513. doi: 10.1007/s40259-019-00369-y). The corresponding effector nucleases in these various subtypes have shown a range of different substrates, including some that act only on double-stranded DNA (dsDNA), but also those that act on both dsDNA as well as single-stranded DNA (ssDNA), and those that act on single-stranded RNA (ssRNA). This multifunctionality has put the type V CRISPR-Cas system into the focus of recent studies.

While a number of CRISPR-Cas type V systems have been used for various applications, including gene editing, reported drawbacks have been published to indicate the need for improved CRISPR-Cas type V systems for suitability of desired applications. Therefore, there remains much room for improvement and design to achieve an effective type V CRISPR-Cas system for gene editing that bears sufficient editing efficiency, improved precision, better deliverability, and which remains affordable, easy to scale, and has improved ability to treat various genetic disorders and complex diseases.

SUMMARY

The present disclosure provides Cas TypeV-based gene editing systems for use in various applications, including precision gene editing in cells, tissues, organs, or organisms. In various embodiments, the Cas TypeV-based gene editing systems comprise (a) a Type V polypeptide and (b) a Type V guide RNA which is capable of associating with a Type V polypeptide to form a complex such that the complex localizes to a target nucleic acid sequence (e.g., a genomic or plasmid target sequence) and binds thereto. In various embodiments, the Type V polypeptide has a nuclease activity which results in the cutting of both strands of DNA.

In various embodiments, the Cas Type V polypeptide is a polypeptide selected from Table S15A, or a polypeptide having at least 70%, 75%, 80%, 85%, 90%, 95%, 99%, or 100% sequence identity with a polypeptide from Table S15A. In various other embodiments, the Cas Type V polypeptide is encoded by a polynucleotide sequence selected from Table S15B, or a polynucleotide having at least 70%, 75%, 80%, 85%, 90%, 95%, 99%, or 100% sequence identity with a polynucleotide of Table S15B. In various other embodiments, the Cas12a guide RNA is selected from any Cas Type V guide sequence disclosed in Table S15C, or a nucleic acid molecule having at least 70%, 75%, 80%, 85%, 90%, 95%, 99%, or 100% sequence identity with a Cas12a guide sequence of Table S15C.

In various embodiments, the Cas Type V guide RNA may comprise (a) a portion that binds or associates with a Cas Type V polypeptide and (b) a region that comprises a targeting sequence, i.e., a sequence which is complementary to target nucleic acid sequence. For Cas Type V guide RNA designs, just like for Cas9 guide RNA, the target sequence is typically next to a PAM sequence. But for Cas Type V, the PAM sequence in various embodiments is typically TTTV, where V typically represents A, C, or G. In various embodiments, the "V" of the TTTV is immediately adjacent to the most 5' base of the non-targeted strand side of the protospacer element. As for Cas9 guide RNA designs, the PAM sequence is typically not included in the guide RNA design.

In various embodiments, the guide RNA for Cas Type V is relatively short at only approximately 40-44 bases long. The part that base pairs to the protospacer in the target sequence is 20-24 bases in length, and there is also a constant about 20-base section that binds to Cas Type V.

In various embodiments, nomenclature for a Cas Type V guide RNA is referred to as a "crRNA" and there is no Cas9-like "tracrRNA" component.

In other aspects, the Cas Type V-based gene editing systems may comprise one or more additional accessory proteins having genome modifying functions, including recombinases, invertases, nucleases, polymerases, ligases, deaminases, reverse transcriptases, or epigenetic modifying functions. In various embodiments, the accessory proteins may be provided separately. In other embodiments, the accessory proteins may be fused to a Cas Type V nuclease, optionally with a linker.

In still another aspect, the disclosure provides delivery systems for introducing the Cas Type V-based gene editing systems or components thereof into cells, tissues, organs, or organisms. Depending on the chosen format, the Cas Type V-based gene editing systems and/or the individual or combined components thereof may be delivered as DNA molecules (e.g., encoded on one or more plasmids), RNA molecules (e.g., guide RNAs for targeting the Cas Type V protein or linear or circular mRNAs coding for the Cas Type V protein or accessory protein components of the Cas Type V-based gene editing systems), proteins (e.g., Cas12a polypeptides, accessory proteins having other functions (e.g., recombinases, nucleases, polymerases, ligases, deaminases, or reverse transcriptases), or protein-nucleic acid complexes (e.g., complexes between a guide RNA and a Cas Type V protein or fusion protein comprising a Cas Type V protein).

In another aspect, the present disclosure provides nucleic acid molecules encoding the Cas Type V-based gene editing systems or components thereof. In yet another aspect, the disclosure provides vectors for transferring and/or expressing said Cas Type V-based gene editing systems, e.g., under in vitro, ex vivo, and in vivo conditions. In still another aspect, the disclosure provides cell-delivery compositions and methods, including compositions for passive and/or active transport to cells (e.g., plasmids), delivery by virus-based recombinant vectors (e.g., AAV and/or lentivirus vectors), delivery by non-virus-based systems (e.g., liposomes and LNPs), and delivery by virus-like particles of the Cas Type V-based gene editing systems described herein. Depending on the delivery system employed, the Cas Type V-based gene editing systems described herein may be delivered in the form of DNA (e.g., plasmids or DNA-based virus vectors), RNA (e.g., guide RNA and mRNA delivered by LNPs), a mixture of DNA and RNA, protein (e.g., virus-like particles), and ribonucleoprotein (RNP) complexes. Any suitable combinations of approaches for delivering the components of the herein disclosed Cas Type V-based gene editing systems may be employed.

In other embodiments, the Cas Type V-based gene editing systems may comprise a template DNA comprising an edit, e.g., a single strand or double strand donor molecule (linear or circular) which may be used by the cell to repair a single or double cut lesion introduced by a Cas Type V-based gene editing systems by way of cellular repair processes, including homology-dependent repair (HDR) (e.g., in dividing cells) or non-homologous end joining (NHEJ) (in nondividing cells).

In one embodiment, each of the components of the Cas Type V-based gene editing systems is delivered by an all-RNA system, e.g., the delivery of one or more RNA molecules (e.g., mRNA and/or guide RNA) by one or more LNPs, wherein the one or more RNA molecules form the guide RNA and/or are translated into the polypeptide components (e.g., the Cas Type V polypeptides and/or any accessory proteins), and a DNA or RNA-encoded template DNA molecule (e.g., donor template), as appropriate or desired.

In yet another aspect, the disclosure provides methods for genome editing by introducing a Cas Type V-based gene editing system described herein into a cell (e.g., under in vitro, in vivo, or ex vivo conditions) comprising a target edit site, thereby resulting in an edit at the target edit. In other aspects, the disclosure provides formulations comprising any of the aforementioned components for delivery to cells and/or tissues, including in vitro, in vivo, and ex vivo delivery, recombinant cells and/or tissues modified by the recombinant Cas Type V-based gene editing systems and methods described herein, and methods of modifying cells by conducting genome editing using the herein disclosed Cas Type V-based gene editing systems.

The disclosure also provides methods of making the Cas Type V-based gene editing systems, their protein and nucleic acid molecule components, vectors, compositions and formulations described herein, as well as to pharmaceutical compositions and kits for modifying cells under in vitro, in vivo, and ex vivo conditions that comprise the herein disclosed genome editing and/or modification systems.

In various aspects, the invention provides an isolated or recombinant polynucleotide comprising or consisting of a nucleic acid sequence selected from the group consisting of:
(a) a nucleic acid sequence that encodes a Cas Type V polypeptide having the amino acid sequence of SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419);
(b) a nucleic acid sequence that encodes a polypeptide at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to a Cas Type V polypeptide of SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419);
(c) a nucleic acid sequence that is a degenerate variant of the nucleic acid sequence in (a) or (b); and
(d) a nucleic acid sequence that hybridizes under stringent conditions to the nucleic acid sequence in in (a) or (b).

In related aspects, the invention provides an isolated or recombinant guide RNA comprising or consisting of a nucleic acid sequence selected from the group consisting of:
(a) one or more crRNA direct repeat sequences or a reverse complement selected from (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO:122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541;
(b) 20 to 35 nucleotides or up to the length of the crRNA from the 3' end of the crRNA direct repeat sequences or a reverse complement (a) linked to a targeting guide attached to the 3' end of the direct repeat sequence that is of 16-30 nucleotides in length;
(c) (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563;
(d) a nucleic acid sequence that is a degenerate variant of (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563;
(e) a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 90%, at least 95%, at least 98%, at least 99% or at least 99.9% identical to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563; and
(f) a nucleic acid sequence that hybridizes under stringent conditions to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563.

In some embodiments, the isolated or recombinant polynucleotide comprising or consisting of a nucleic acid sequence encoding one or more Cas Type V polypeptides of the disclosure is paired with one or more cognate guide RNA of the disclosure.

In certain exemplary aspects, provided herein is a Cas Type V gene editing system comprising:
(a) one or more polypeptide sequences comprising at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of sequences selected from SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419); and
(b) one or more polynucleotide sequences comprising a guide RNA, wherein the guide RNA comprises a complementary sequence to that of a targeted polynucleotide sequence.

In various embodiments, disclosed is a method of modifying a targeted polynucleotide sequence, said method comprising:
(a) one or more polypeptide sequences comprising at least 45%, 46%, 47%, 48%, 49%, 50%, 51%, 52%, 53%, 54% 55%, 56%, 57%, 58%, 59%, 60%, 61%, 62%, 63%, 64%, or 65% sequence identity to any one of sequences selected from SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419); and
(b) one or more polynucleotide sequences comprising a guide RNA, wherein the guide RNA comprises a complementary sequence to that of a targeted polynucleotide sequence; and
(c) introducing into a host cell the one or more polypeptide sequences of (a) and the one or more polynucleotide sequences of (b) in a delivery vector; wherein the polypeptide sequence is configured to form a ribonucleoprotein complex with the guide RNA, and wherein the ribonucleoprotein complex modifies a targeted polynucleotide sequence.

In certain preferred embodiments, the method comprises contacting the host cell with a guide RNA, wherein the guide RNA optionally forms a ribonucleoprotein complex with the polypeptide and the guide RNA.

In various aspects, the present disclosure provides delivery of a Cas12a-based gene editing system described herein Cas12a in various viral and non-viral vectors. In certain preferred embodiments, the LNP comprises:
a) one or more ionizable lipids;
b) one or more structural lipids;
c) one or more PEGylated lipids; and
d) one or more phospholipids.

In certain embodiments, the LNP comprises one or more ionizable lipids selected from the group consisting of those disclosed in Table X.

Also provided herein are pharmaceutical compositions comprising a site-specific modification of a target region of a host cell genome comprising a Cas Type V-based gene editing system described herein Cas Type V comprising one or more Cas Type V polypeptides; one or more cognate guide RNA; and LNP suitable for therapeutic administration.

In various aspects, provided herein is a method of treating a subject in need thereof, comprising administering to the subject a pharmaceutical composition described herein. In some embodiments, the subject is ameliorated from a diseases or disorders including but not limited to various monogenic diseases or disorders.

In various embodiments, the disclosure relates to the following numbered paragraphs:
1. A genome editing system comprising:
   (a) a Cas Type V polypeptide or variant thereof, or a nucleic acid sequence encoding a Cas Type V polypeptide or variant thereof;
   (b) a second nucleic acid sequence encoding a guide RNA; wherein the Cas Type V polypeptide and the guide RNA form an RNA-protein complex; wherein the genome editing system optionally further comprises a donor nucleic acid sequence capable of modifying a target sequence.
2. The genome editing system of paragraph 1, wherein the Cas Type V polypeptide or variant thereof is a polypeptide selected from Table S15A (SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419)), or a polypeptide having at least 70%, 75%, 80%, 85%, 90%, 95%, 99%, or 100% sequence identity with a polypeptide from Table S15A (SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419)).
3. The genome editing system of paragraph 1, wherein the Cas12a polypeptide is encoded by a polynucleotide sequence selected from Table S15B (SEQ ID NO: 365 (No. ID405), SEQ ID NO: 75 (No. ID414), or SEQ ID NO: 565 (No. ID418), SEQ ID NO: 366 (No. ID406), SEQ ID NO: 331 (No. ID411), SEQ ID NO: 30 (No. ID415), or SEQ ID NO: 445 (No. ID419)), or a polynucleotide having at least 70%, 75%, 80%, 85%, 90%, 95%, 99%, or 100% sequence identity with a polypeptide from Table S15B (SEQ ID NO: 365 (No. ID405), SEQ ID NO: 75 (No. ID414), or SEQ ID NO:565 (No. ID418), SEQ ID NO: 366 (No. ID406), SEQ ID NO: 331 (No. ID411), SEQ ID NO: 30 (No. ID415), or SEQ ID NO: 445 (No. ID419)).
4. The genome editing system of paragraph 1, wherein the Cas Type V guide RNA is selected from any Cas Type V guide sequence disclosed in Table S15C (SEQ ID NO:28-29, 69-71, 355-360, 542-563), or a nucleic acid molecule having at least 70%, 75%, 80%, 85%, 90%, 95%, 99%, or 100% sequence identity with a Cas Type V guide sequence of Table S15C.
5. The genome editing system of paragraph 1, wherein the Cas Type V polypeptide or variant thereof is operably fused to an accessory domain.
6. The genome editing system of paragraph 5, wherein the accessory domain is a deaminase domain, nuclease domain, reverse transcriptase domain, integrase domain, recombinase domain, transposase domain, endonuclease domain, or exonuclease domain.
7. The genome editing system of paragraph 1, wherein the Cas Type V polypeptide or variant thereof is operably fused to a deaminase domain.
8. The genome editing system of paragraph 1, wherein the Cas Type V polypeptide or variant thereof is operably fused to a reverse transcriptase domain.

9. The genome editing system of paragraph 1, wherein the Cas Type V polypeptide or variant thereof is operably fused to a recombinase domain.

10. The genome editing system of paragraph 1, wherein the Cas Type V polypeptide or variant thereof is operably fused to an integrase domain.

11. The genome editing system of paragraph 1, wherein the Cas Type V polypeptide or variant thereof is operably fused to a transposase domain.

12. The genome editing system of paragraph 1, wherein the Cas Type V polypeptide or variant thereof is engineered to have an enhanced genome editing efficiency relative to a wildtype SpCas9.

13. The genome editing system of paragraph 12, wherein the enhanced genome editing efficiency comprises at least two to fivefold increase in editing efficiency relative to a wildtype SpCas9.

14. The genome editing system of any one of the above paragraphs wherein the donor nucleic acid sequence repairs the target region of the genome editing system genome cleaved by the RNA-protein complex.

15. The genome editing system of any one of the above paragraphs wherein the nucleic acid sequence encoding the Cas Type V polypeptide and the guide RNA are transiently expressed in the host cell genome.

16. The genome editing system of any one of the above paragraphs wherein the nucleic acid sequence encoding the Cas Type V polypeptide and the guide RNA are integrated into and expressed from the host cell genome.

17. The genome editing system of any one of the above paragraphs wherein the nucleic acid sequence encoding the Cas Type V polypeptide and the guide RNA are integrated into and expressed from a plasmid.

18. The genome editing system of any one of the above paragraphs wherein the genome editing system further comprises a donor nucleic acid sequence to modify a target region of the host cell genome.

19. The genome editing system of any one of the above paragraphs wherein administering the system to a host cell results in one or more edits.

20. The genome editing system of claim 19, wherein the one or more edits comprises an insertion, deletion, base change/substitution, or inversion, or a combination thereof.

21. The genome editing system of claim 19, wherein the one or more edits comprises a modification in the nucleobase sequence of a target nucleic acid molecule.

22. The genome editing system of claim 19, wherein the one or more edits comprises a whole-exon insertion, deletion, or substitution.

23. The genome editing system of claim 19, wherein the one or more edits comprises a whole-intron insertion, deletion, or substitution.

24. The genome editing system of claim 19, wherein the one or more edits comprises a whole-gene insertion, deletion, or substitution.

25. The genome editing system of claim 19, wherein the one or more edits comprises an edit to the sequence of a gene or to a region of a gene, e.g., an exon or intron.

26. The genome editing system of any one of the above paragraphs wherein the Cas Type V polypeptide recognizes a protospacer-adjacent motif (PAM).

27. The genome editing system of any one of the above paragraphs wherein the genome editing system installs one or more desired sequence modifications of one or more monogenic disorders or diseases.

28. The genome editing system of any one of the above paragraphs wherein the genome editing system installs one or more desired epigenetic modifications of one or more monogenic disorders or diseases.

29. The genome editing system of any one of the above paragraphs wherein the Cas Type V polypeptide comprises one or more modifications in one or more domains selected from (a) a nuclease domain (e.g., RuvC domain) and (b) a PAM-interacting domain.

30. The genome editing system of any one of the above paragraphs further comprising a delivery vector.

31. The genome editing system of paragraph 30, wherein the delivery vector is selected from viral vector is selected from a retroviral vector, a lentiviral vector, an adenoviral, an adeno-associated viral vector, vaccinia viral vector, poxviral vector, and herpes simplex viral vector.

32. The genome editing system of paragraph 30, wherein the delivery vector comprises a non-viral vector selected from cationic liposomes, lipid nanoparticles (LNPs), cationic polymers, vesicles, and gold nanoparticles.

33. The genome editing system of any one of the above paragraphs wherein the modification of the target sequence of the host cell genome comprises binding activity, cleavage activity, nickase activity, deaminase activity, reverse transcriptase activity, transcriptional activation activity, transcriptional inhibitory activity, or transcriptional epigenetic activity.

34. The genome editing system of any one of the above paragraphs wherein any of the nucleic acid molecules-including any guide RNA or donor DNA-comprises one or more chemical modifications selected from 2'-O-Me, 2'-F, and 2'F-ANA at 2'OH; 2'F-4'-C$\alpha$-OMe and 2',4'-di-C$\alpha$-OMe at 2' and 4' carbons; phosphodiester modifications comprising sulfide-based Phosphorothioate (PS) or acetate-based phosphonoacetate alterations; combinations of the ribose and phosphodiester modifications; locked nucleic acid (LNA), bridged nucleic acids (BNA), S-constrained ethyl (cEt), and unlocked nucleic acid (UNA); modifications to produce a phosphodiester bond between the 2' and 5' carbons (2',5'-RNA) of adjacent RNAs; and a butane 4-carbon chain link between adjacent RNAs.

35. The genome editing system of any one of the above paragraphs wherein any guide RNA comprises one or more chemical modifications selected from 2'-O-Me, 2'-F, and 2'F-ANA at 2'OH; 2'F-4'-C$\alpha$-OMe and 2',4'-di-C$\alpha$-OMe at 2' and 4' carbons; phosphodiester modifications comprising sulfide-based Phosphorothioate (PS) or acetate-based phosphonoacetate alterations; combinations of the ribose and phosphodiester modifications; locked nucleic acid (LNA), bridged nucleic acids (BNA), S-constrained ethyl (cEt), and unlocked nucleic acid (UNA); modifications to produce a phosphodiester bond between the 2' and 5' carbons (2',5'-RNA) of adjacent RNAs; and a butane 4-carbon chain link between adjacent RNAs.

36. The genome editing system of any one of the above paragraphs wherein any donor or template DNA comprises one or more chemical modifications selected from 2'-O-Me, 2'-F, and 2'F-ANA at 2'OH; 2'F-4'-C$\alpha$-OMe and 2',4'-di-C$\alpha$-OMe at 2' and 4' carbons; phosphodiester modifications comprising sulfide-based Phosphorothioate (PS) or acetate-based phosphonoacetate alterations; combinations of the ribose and phosphodiester modifications; locked nucleic acid (LNA), bridged nucleic acids (BNA), S-constrained ethyl (cEt), and unlocked nucleic acid (UNA); modifications to produce a phosphodiester bond between the 2' and 5' carbons (2',5'-RNA) of adjacent RNAs; and a butane 4-carbon chain link between adjacent nucleotides.

37. A method for editing the DNA of a host cell,
a) producing one or more compositions comprising:
1. a Cas Type V polypeptide or a nucleic acid sequence encoding a Cas Type V polypeptide;
2. a second nucleic acid sequence encoding a guide RNA, wherein the second nucleic acid sequence and the Cas Type V polypeptide form an RNA-protein complex; wherein the genome editing system optionally further comprises a donor nucleic acid sequence capable of modifying a target sequence; and
b) introducing the composition into a host cell;
c) optionally selecting for the host cell comprising the modification or the donor nucleic acid sequence into the host cell genome; and
d) optionally culturing the edited host cells under conditions sufficient for growth.

38. The method of paragraph 37, wherein the Cas Type V polypeptide is:
a. operably fused to a nuclease;
b. operably fused to a deaminase;
c. operably fused to a reverse transcriptase;
d. operably fused to a recombinase;
e. operably fused to a transposase;
f. operably fused to a epigenetic effector; or
g. operably fused to any combination of a, b, c, d, e and/or f.

39. The method of paragraph 37, further comprising quantifying or characterizing the editing of the target region.

40. The method of paragraph 37, wherein the method provides editing efficiency of greater than 10%, 20%, 30%, 40%, 50%, 60%, 70%, 80%, 90%, 95%, 99% relative to SpCas9.

41. The method of paragraph 37, further comprising introducing into the host cell a second donor nucleic acid sequence paired with a second guide RNA to modify the second target region of the host cell genome.

42. The method of paragraph 37 further comprising introducing into the host cell at least two desired modification sequences for multiplexing.

43. The method of paragraph 37 wherein the method comprises insertion or stable integration of the one or more desired modification sequence into the host cell genome.

44. The method of paragraph 37 wherein the host cell genome comprises a chromosome or chromosome and plasmid.

45. The method of paragraph 37 wherein the target region is modified by an insertion, deletion or alteration of one or more base pairs at the target region in the host cell genome.

46. The method of paragraph 37 wherein the one or more desired modification sequence is selected from one or more sequences associated with one or more monogenic disorders or diseases.

47. The method of paragraph 37 wherein the host cell is a primary human cell.

48. The method of paragraph 37 wherein the step of introducing into the host cell comprises a delivery vector operably linked to the genome editing system.

49. The method of paragraph 48 wherein the delivery vector is selected from viral vector is selected from a retroviral vector, a lentiviral vector, an adenoviral, an adeno-associated viral vector, vaccinia viral vector, poxviral vector, and herpes simplex viral vector.

50. The method of paragraph 48 wherein the delivery vector comprises a non-viral vectors selected from cationic liposomes, lipid nanoparticles (LNPs), cationic polymers, vesicles, and gold nanoparticles.

51. The method of paragraph 37 wherein the editing method results in enhanced editing efficiency and/or low cytotoxicity.

52. A gene editing construct comprising:
(a) an Cas Type V domain; (b) a reverse transcriptase domain; (c) a transcriptional modulating polypeptide; (d) a recombinase domain; (e) a transposase domain; or (f) any combination of a, b, c, d, e, or f.

53. The gene editing construct of claim 52, further comprising a donor nucleic acid sequence capable of modifying a target sequence; and In various aspects, the target region is modified by an insertion, deletion or alteration of one or more base pairs at the target region in the host cell genome.

In various embodiments, one or more desired modification sequence is selected from one or more sequences associated with one or more monogenic disorders or diseases.

In certain preferred embodiments, the methods and compositions provide editing efficiency of greater than 10%, 20%, 30%, 40%, 50%, 60%, 70%, 80%, 90%, 95%, 99% relative to SpCas9.

Related aspects provide for the use of a Cas Type V-based gene editing system described herein Cas Type Vin the application for plants, yeast, bacteria, and fungi and desired bioindustrial applications for producing value-added components in such systems in a recombinant manner.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. All rights to explicitly disclaim any embodiments that are the subject of any granted patent(s) of applicant in the lineage of this application or in any other lineage or in any prior filed application of any third party is explicitly reserved. Nothing herein is to be construed as a promise.

DESCRIPTION OF THE DRAWINGS

FIG. 23A-23E Top five most common editing outcomes observed in deep sequencing data of ID405, ID414, ID418 and LbaCas12a genomic targets in RUNX1 (FIG. 23A, top to bottom: ID405 (SEQ ID NO:1475, SEQ ID NO:1475, SEQ ID NO:1476, SEQ ID NO:1477, SEQ ID NO:1478, SEQ ID NO:1479, SEQ ID NO:1480), ID414 (SEQ ID NO:1475, SEQ ID NO:1475, SEQ ID NO:1476, SEQ ID NO:1478, SEQ ID NO:1481, SEQ ID NO:1482, SEQ ID NO:1483), ID418 (SEQ ID NO:1475, SEQ ID NO:1475, SEQ ID NO:1476, SEQ ID NO:1484, SEQ ID NO:1485, SEQ ID NO:1478, SEQ ID NO:1481), LbaCas12a (SEQ ID NO:1475, SEQ ID NO: 1475, SEQ ID NO:1476, SEQ ID NO:1478, SEQ ID NO:1484, SEQ ID NO:1486, SEQ ID NO:1477)); SCN1A (FIG. 23B, top to bottom: ID405 (SEQ ID NO:1487, SEQ ID NO:1487, SEQ ID NO:1488, SEQ ID NO:1489, SEQ ID NO:1490, SEQ ID NO:1491, SEQ ID NO:1492), ID414 (SEQ ID NO:1487, SEQ ID NO:1487, SEQ ID NO:1493, SEQ ID NO:1494, SEQ ID NO:1495, SEQ ID NO:1496, SEQ ID NO:1497), ID418 (SEQ ID NO:1487, SEQ ID NO:1487, SEQ ID NO:1498, SEQ ID NO:1491, SEQ ID NO:1489, SEQ ID NO:1499, SEQ ID NO:1498), LbaCas12a (SEQ ID NO:1487, SEQ ID NO:1487, SEQ ID NO:1498, SEQ ID NO:1491, SEQ ID NO:1489, SEQ ID NO:1499, SEQ ID NO:1488)); DNMT1 (FIG. 23C, top to bottom: ID405 (SEQ ID NO:1500, SEQ ID NO:1500, SEQ ID NO:1501, SEQ ID NO:1502, SEQ ID NO:1503, SEQ ID NO:1504, SEQ ID NO:1505), ID414 (SEQ ID NO:1500, SEQ ID NO:1500, SEQ ID NO:1503, SEQ ID NO:1501, SEQ ID NO:1502, SEQ ID NO:1504, SEQ ID NO:1506), ID418 (SEQ ID NO:1500, SEQ ID NO:1500, SEQ ID NO:1501, SEQ ID NO:1502, SEQ ID NO:1504, SEQ ID NO:1503, SEQ ID NO:1505), LbCas12a (SEQ ID NO:1500, SEQ ID NO:1500, SEQ ID NO:1503, SEQ ID NO:1502, SEQ ID NO:1501, SEQ ID NO:1504, SEQ ID NO:1505)); FANCF Site 1 (FIG. 23D, top to bottom: ID405 (SEQ ID NO:1519, SEQ ID NO:1519, SEQ ID NO:1507, SEQ ID NO:1508, SEQ ID NO:1509, SEQ ID NO:1510, SEQ ID NO:1511) ID414 (SEQ ID NO:1519, SEQ ID NO:1519, SEQ ID NO:1512, SEQ ID NO:1512, SEQ ID NO:1513, SEQ ID NO:1514, SEQ ID NO:1515), ID418 (SEQ ID NO:1519, SEQ ID NO:1519, SEQ ID NO:1512, SEQ ID NO:1507, SEQ ID NO:1516 SEQ ID NO:1517, SEQ ID NO:1518), LbCas12a (SEQ ID NO:1519, SEQ ID NO:1519, SEQ ID NO:1512, SEQ ID NO:1507, SEQ ID NO:1516, SEQ ID NO:1518, SEQ ID NO:1520)); and FANCF Site 2 (FIG. 23E, top to bottom: ID405 (SEQ ID NO:1521, SEQ ID NO:1521, SEQ ID NO:1522, SEQ ID NO:1523, SEQ ID NO:1524, SEQ ID NO:1525, SEQ ID NO:1526), ID414 (SEQ ID NO:1521, SEQ ID NO:1521, SEQ ID NO:1522, SEQ ID NO:1523, SEQ ID NO:1527, SEQ ID NO:1524, SEQ ID NO:1525), ID418 (SEQ ID NO:1521, SEQ ID NO:1521, SEQ ID NO:1522, SEQ ID NO:1523, SEQ ID NO:1524, SEQ ID NO:1527, SEQ ID NO:1525), LbCas12 (SEQ ID NO:1521, SEQ ID NO:1521, SEQ ID NO:1522, SEQ ID NO:1525, SEQ ID NO:1524, SEQ ID NO:1527, SEQ ID NO:1523)) genes as compared to reference sequences.

FIG. 31(SEQ ID NO:1546) shows a sequence alignment among each of the Cas12a orthologs provided in Table S15A and the canonical LbCas12a sequence of SEQ ID NO: 1385. Bolded-underlined residues are marked with an asterisk ("*") and denote a fully conserved amino acid residue present in all of the aligned sequences at that alignment position. The amino acid residue positions marked with a colon (":") denote aligned amino acid residues which are highly similar although not identically conserved. The highly similar residues are those where the substitutions among the sequences have strongly similar properties. The amino acid residue positions marked with a period (".") denote aligned amino acid residues which are moderately similar. The highly similar residues are those where the substitutions among the sequences have strongly similar properties. The moderately similar residues are those where the substitutions among the sequence have weakly similar properties. The underlined regions are referred to as "highly conserved regions" and include (a) at least one fully conserved residue, and (b) at least one highly similar or moderately similar residue. See Section K subsection Q for further description.

DETAILED DESCRIPTION

Figure 1A:
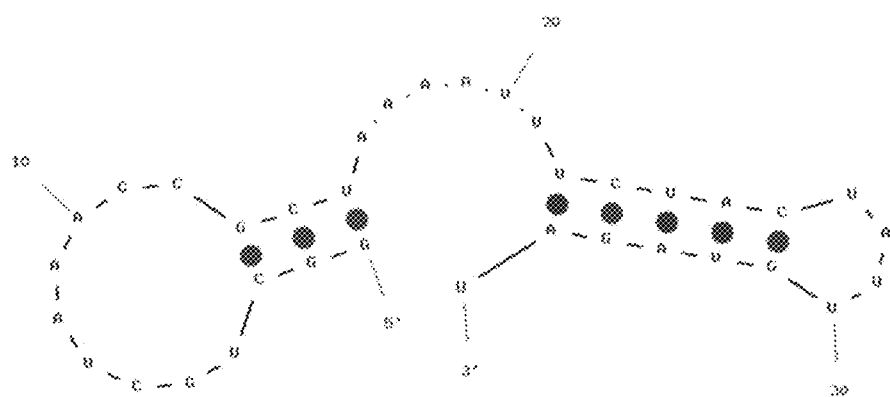
FIG. 1A-1C (SEQ ID NOs:13-15) are schemes depicting the predicted stem loop structures of crRNA sequences of the present disclosure corresponding to Group 1 sequences.

The present disclosure provides Cas TypeV-based gene editing systems for use in various applications, including precision gene editing in cells, tissues, organs, or organisms. In various embodiments, the Cas TypeV-based gene editing systems comprise (a) a Cas TypeV polypeptide and (b) a Cas TypeV guide RNA which is capable of associating with a Cas TypeV polypeptide to form a complex such that the complex localizes to a target nucleic acid sequence (e.g., a genomic or plasmid target sequence) and binds thereto. In various embodiments, the Cas TypeV polypeptide has a nuclease activity which results in the cutting of at least one strand of DNA.

In exemplary embodiments, the Cas TypeV systems and/or components thereof described herein are formulated as part of a lipid nanoparticle (LNP). In some embodiments, a lipid nanoparticle comprises an ionizable lipid, a structural lipid, a PEGylated lipid, and a phospholipid.

In various embodiments, the Cas12a polypeptide is a polypeptide selected from Table S15A (SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419)), or a polypeptide having at least 70%, 75%, 80%, 85%, 90%, 95%, 99%, or 100% sequence identity with a polypeptide from Table S15A (SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419)).

In various embodiments, the Cas Type V polypeptide is encoded by a polynucleotide sequence selected from Table S15B (SEQ ID NO: 365 (No. ID405), SEQ ID NO: 75 (No. ID414), or SEQ ID NO: 565 (No. ID418), SEQ ID NO: 366 (No. ID406), SEQ ID NO: 331 (No. ID411), SEQ ID NO: 30 (No. ID415), or SEQ ID NO: 445 (No. ID419)), or a polynucleotide having at least 70%, 75%, 80%, 85%, 90%, 95%, 99%, or 100% sequence identity with a polypeptide from Table S15B (SEQ ID NO: 365 (No. ID405), SEQ ID NO: 75 (No. ID414), or SEQ ID NO:565 (No. ID418), SEQ ID NO: 366 (No. ID406), SEQ ID NO: 331 (No. ID411), SEQ ID NO: 30 (No. ID415), or SEQ ID NO: 445 (No. ID419)).

In various embodiments, the Cas Type V guide RNA is selected from any Cas Type V guide sequence disclosed in Table S15C (SEQ ID NO:28-29, 69-71, 355-360, 542-563), or a nucleic acid molecule having at least 70%, 75%, 80%, 85%, 90%, 95%, 99%, or 100% sequence identity with a Cas Type V guide sequence of Table S15C (SEQ ID NO:28-29, 69-71, 355-360, 542-563).

In various embodiments, the Cas Type V guide RNA may comprise (a) a portion that binds or associates with a Cas Type V polypeptide and (b) a region that comprises a targeting sequence, i.e., a sequence which is complementary to target nucleic acid sequence. For Cas Type V guide RNA designs, just like for Cas9 guide RNA, the target sequence is typically next to a PAM sequence. But for Cas Type V, the PAM sequence in various embodiments is typically TTTV, where V typically represents A, C, or G. In various embodiments, the "V" of the TTTV is immediately adjacent to the most 5' base of the non-targeted strand side of the protospacer element. As for Cas9 guide RNA designs, the PAM sequence is typically not included in the guide RNA design.

In various embodiments, the guide RNA for Cas Type V is relatively short at only approximately 40-44 bases long. The part that base pairs to the protospacer in the target sequence is 20-24 bases in length, and there is also a constant about 20-base section that binds to Cas Type V.

In various embodiments, nomenclature for a Cas Type V guide RNA is referred to as a "crRNA" and there is no Cas9-like "tracrRNA" component.

In other aspects, the Cas Type V-based gene editing systems may comprise one or more additional accessory proteins having genome modifying functions, including recombinases, invertases, nucleases, polymerases, ligases, deaminases, reverse transcriptases, or epigenetic modifying functions. In various embodiments, the accessory proteins may be provided separately. In other embodiments, the accessory proteins may be fused to Cas Type V, optionally with a linker.

In still another aspect, the disclosure provides delivery systems for introducing the Cas Type V-based gene editing systems or components thereof into cells, tissues, organs, or organisms. Depending on the chosen format, the Cas Type V-based gene editing systems and/or the individual or combined components thereof may be delivered as DNA molecules (e.g., encoded on one or more plasmids), RNA molecules (e.g., guide RNAs for targeting the Cas Type V protein or linear or circular mRNAs coding for the Cas Type V protein or accessory protein components of the Cas Type V-based gene editing systems), proteins (e.g., Cas Type V polypeptides, accessory proteins having other functions (e.g., recombinases, nucleases, polymerases, ligases, deaminases, or reverse transcriptases), or protein-nucleic acid complexes (e.g., complexes between a guide RNA and a Cas Type V protein or fusion protein comprising a Cas Type V protein).

In another aspect, the present disclosure provides nucleic acid molecules encoding the Cas Type V-based gene editing systems or components thereof. In yet another aspect, the disclosure provides vectors for transferring and/or expressing said Cas Type V-based gene editing systems, e.g., under in vitro, ex vivo, and in vivo conditions. In still another aspect, the disclosure provides cell-delivery compositions and methods, including compositions for passive and/or active transport to cells (e.g., plasmids), delivery by virus-based recombinant vectors (e.g., AAV and/or lentivirus vectors), delivery by non-virus-based systems (e.g., liposomes and LNPs), and delivery by virus-like particles of the Cas Type V-based gene editing systems described herein. Depending on the delivery system employed, the Cas Type V-based gene editing systems described herein may be delivered in the form of DNA (e.g., plasmids or DNA-based virus vectors), RNA (e.g., guide RNA and mRNA delivered by LNPs), a mixture of DNA and RNA, protein (e.g., virus-like particles), and ribonucleoprotein (RNP) complexes. Any suitable combinations of approaches for delivering the components of the herein disclosed Cas Type V-based gene editing systems may be employed.

In other embodiments, the Cas Type V-based gene editing systems may comprise a template DNA comprising an edit, e.g., a single strand or double strand donor molecule (linear or circular) which may be used by the cell to repair a single or double cut lesion introduced by a Cas Type V-based gene editing systems by way of cellular repair processes, including homology-dependent repair (HDR) (e.g., in dividing cells) or non-homologous end joining (NHEJ) (in nondividing cells).

In one embodiment, each of the components of the Cas Type V-based gene editing systems is delivered by an all-RNA system, e.g., the delivery of one or more RNA molecules (e.g., mRNA and/or guide RNA) by one or more LNPs, wherein the one or more RNA molecules form the guide RNA and/or are translated into the polypeptide components (e.g., the Cas Type V polypeptides and/or any accessory proteins), and a DNA or RNA-encoded template DNA molecule (e.g., donor template), as appropriate or desired.

In yet another aspect, the disclosure provides methods for genome editing by introducing a Cas Type V-based gene editing system described herein into a cell (e.g., under in vitro, in vivo, or ex vivo conditions) comprising a target edit site, thereby resulting in an edit at the target edit. In other aspects, the disclosure provides formulations comprising any of the aforementioned components for delivery to cells and/or tissues, including in vitro, in vivo, and ex vivo delivery, recombinant cells and/or tissues modified by the recombinant Cas Type V-based gene editing systems and methods described herein, and methods of modifying cells by conducting genome editing using the herein disclosed Cas Type V-based gene editing systems.

The disclosure also provides methods of making the Cas Type V-based gene editing systems, their protein and nucleic acid molecule components, vectors, compositions and formulations described herein, as well as to pharmaceutical compositions and kits for modifying cells under in vitro, in vivo, and ex vivo conditions that comprise the herein disclosed genome editing and/or modification systems.

A. General Definitions

Unless otherwise defined, all terms of art, notations and other scientific terminology used herein are intended to have the meanings commonly understood by those of skill in the art to which this disclosure pertains. In some cases, terms with commonly understood meanings are defined herein for clarity and/or for ready reference, and the inclusion of such definitions herein should not necessarily be construed to represent a difference over what is generally understood in the art. The techniques and procedures described or referenced herein are generally well understood and commonly employed using conventional methodologies by those skilled in the art, such as, for example, the widely utilized molecular cloning methodologies described in Sambrook et al., Molecular Cloning: A Laboratory Manual 4th ed. (2012) Cold Spring Harbor Laboratory Press, Cold Spring Harbor, NY. As appropriate, procedures involving the use of commercially available kits and reagents are generally carried out in accordance with manufacturer-defined protocols and conditions unless otherwise noted.

An

The articles "a" and "an" are used herein to refer to one or to more than one (i.e., to at least one) of the grammatical object of the article. By way of example, "an element" means one element or more than one element.

About

"About" as used herein when referring to a measurable value such as an amount, a temporal duration, and the like, is meant to encompass variations of ±10%, as such variations are appropriate to perform the disclosed methods.

Biologically Active

As used herein, the term "biologically active" refers to a characteristic of an agent (e.g., DNA, RNA, or protein) that has activity in a biological system (including in vitro and in vivo biological system), and particularly in a living organism, such as in a mammal, including human and non-human mammals. For instance, an agent when administered to an organism has a biological effect on that organism, is considered to be biologically active.

Bulge

As used herein, the term "bulge" refers to a small region of unpaired base(s) that interrupts a "stem" of base-paired nucleotides. The bulge may comprise one or two single-stranded or unbase-paired nucleotides joined at both ends by base-paired nucleotides of the stem. The bulge can be symmetrical (viz., the two unbase-paired single-stranded regions have the same number of nucleotides), or asymmetrical (viz., the unbase-paired single stranded region(s) have different or unequal numbers of nucleotides), or there is only one unbase-paired nucleotide on one strand. A bulge can be described as A/B (such as a "2/2 bulge," or a "1/0 bulge") wherein A represents the number of unpaired nucleotides on the upstream strand of the stem, and B represents the number of unpaired nucleotides on the downstream strand of the stem. An upstream strand of a bulge is more 5' to a downstream strand of the bulge in the primary nucleotide sequence.

Cas12a or Cas12a Polypeptide

As used herein, the "Cas12a polypeptide", "Cas12a protein" or "Cas12a nuclease" refers to a RNA-binding site-directed CRISPR Cas TypeV polypeptide that recognizes and/or binds RNA and is targeted to a specific DNA sequence. An Cas12a system as described herein refers to a specific DNA sequence by the RNA molecule to which the Cas12a polypeptide or Cas12a protein is bound. The RNA molecule comprises a sequence that binds, hybridizes to, or is complementary to a target sequence within the targeted polynucleotide sequence, thus targeting the bound polypeptide to a specific location within the targeted polynucleotide sequence (the target sequence). "Cas12a" is a type of CRISPR Class II Type V nuclease. The specification may describe the polypeptides contemplated in the scope of this application as Cas12a polypeptides or alternatively as Cas TypeV polypeptides, or the like.

cDNA

As used herein, the term "cDNA" refers to a strand of DNA copied from an RNA template, e.g., by a reverse transcriptase.

Cleavage

As used herein, the term "cleavage" refers to the breakage of the covalent backbone of a DNA molecule. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends.

Cognate

The term "cognate" refers to two biomolecules that normally interact or co-exist in nature.

Complementary

As used herein, the terms "complementary" or "substantially complementary" are meant to refer to a nucleic acid (e.g., RNA, DNA) that comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. Standard Watson-Crick base-pairing includes: adenine (A) pairing with thymidine (T), adenine (A) pairing with uracil (U), and guanine (G) pairing with cytosine (C) [DNA, RNA]. In addition, for hybridization between two RNA molecules (e.g., dsRNA), and for hybridization of a DNA molecule with an RNA molecule (e.g., when a DNA target nucleic acid base pairs with a guide RNA, etc.): guanine (G) can also base pair with uracil (U). For example, G/U base-pairing is at least partially responsible for the degeneracy (i.e., redundancy) of the genetic code in the context of tRNA anti-codon base-pairing with codons in mRNA. Thus, in the context of this disclosure, a guanine (G) is considered complementary to both a uracil (U) and to an adenine (A). For example, when a G/U base-pair can be made at a given nucleotide position of a dsRNA duplex of a guide RNA molecule, the position is not considered to be non-complementary, but is instead considered to be complementary.

It is understood that the sequence of a polynucleotide need not be 100% complementary to that of its target nucleic acid to be specifically hybridizable or hybridizable. Moreover, a polynucleotide may hybridize over one or more segments such that intervening or adjacent segments are not involved in the hybridization event (e.g., a bulge, a loop structure or hairpin structure, etc.). A polynucleotide can comprise 60% or more, 65% or more, 70% or more, 75% or more, 80% or more, 85% or more, 90% or more, 95% or more, 98% or more, 99% or more, 99.5% or more, or 100% sequence complementarity to a target region within the target nucleic acid sequence to which it will hybridize. For example, an antisense nucleic acid in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656), the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489), and the like. Consisting essentially of Consisting Essentially of The phrase "consisting essentially of" is meant herein to exclude anything that is not the specified active component or components of a system, or that is not the specified active portion or portions of a molecule.

Control Sequences

The term "control sequences" is intended to include, at a minimum, all components whose presence is essential for expression, and can also include additional components whose presence is advantageous, for example, leader sequences and fusion partner sequences. Suitable expression vectors include, without limitation, plasmids and viral vectors derived from, for example, bacteriophage, baculoviruses, tobacco mosaic virus, herpes viruses, cytomegalovirus, retroviruses, vaccinia viruses, adenoviruses, and adeno-associated viruses. Numerous vectors and expression systems are commercially available, such as from Novagen (Madison, WI), Clontech (Palo Alto, CA), Stratagene (La Jolla, CA), and Invitrogen/Life Technologies (Carlsbad, CA). The present invention comprehends recombinant vectors that may include viral vectors, bacterial vectors, protozoan vectors, DNA vectors, or recombinants thereof.

Degenerate Variant

As used herein, the phrase "degenerate variant" of a reference nucleic acid sequence encompasses nucleic acid sequences that can be translated, according to the standard genetic code, to provide an amino acid sequence identical to that translated from the reference nucleic acid sequence. The term "degenerate oligonucleotide" or "degenerate primer" is used to signify an oligonucleotide capable of hybridizing with target nucleic acid sequences that are not necessarily identical in sequence but that are homologous to one another within one or more particular segments.

Engineered nucleic acid constructs of the present disclosure may be encoded by a single molecule (e.g., encoded by or present on the same plasmid or other suitable vector) or by multiple different molecules (e.g., multiple independently-replicating vectors).

DNA-Guided Nuclease

As used herein, an "DNA-guided nuclease" is a type of "programmable nuclease," and a specific type of "nucleic acid-guided nuclease." An example of a DNA-guided nuclease is reported in Varshney et al., DNA-guided genome editing using structure-guided endonucleases, Genome Biology, 2016, 17(1), 187, which may be used in the context of the present disclosure and is incorporated herein by reference. As used herein, the term "DNA-guided nuclease" or "DNA-guided endonuclease" refers to a nuclease that associates covalently or non-covalently with a guide RNA thereby forming a complex between the guide RNA and the DNA-guided nuclease. The guide RNA comprises a spacer sequence which comprises a nucleotide sequence having complementarity with a strand of a target DNA sequence. Thus, the DNA-guided nuclease is indirectly guided or programmed to localize to a specific site in a DNA molecule through its association with the guide RNA, which directly binds or anneals to a strand of the target DNA through its complementarity region via Watson-Crick base-pairing.

DNA Regulatory Sequences

As used herein, the terms "DNA regulatory sequences," "control elements," and "regulatory elements," can be used interchangeably herein to refer to transcriptional and translational control sequences, such as promoters, enhancers, polyadenylation signals, terminators, protein degradation signals, and the like, that provide for and/or regulate transcription of a non-coding sequence (e.g., guide RNA) or a coding sequence and/or regulate translation of a mRNA into an encoded polypeptide.

Domain

The term "domain" as used herein refers to a structure of a biomolecule that contributes to a known or suspected function of the biomolecule. Domains may be co-extensive with regions or portions thereof, domains may also include distinct, non-contiguous regions of a biomolecule. Examples of protein domains include, but are not limited to, an Ig domain, an extracellular domain, a transmembrane domain, and a cytoplasmic domain. [0062] As used herein, the term "molecule" means any compound, including, but not limited to, a small molecule, peptide, protein, sugar, nucleotide, nucleic acid, lipid, etc., and such a compound can be natural or synthetic.

Donor Nucleic Acid

By a "donor nucleic acid" or "donor polynucleotide" or "donor DNA" or "HDR donor DNA" it is meant a single-stranded DNA to be inserted at a site cleaved by a programmable nuclease (e.g., a CRISPR/Cas effector protein; a TALEN; a ZFN; a meganuclease) (e.g., after dsDNA cleavage, after nicking a target DNA, after dual nicking a target DNA, and the like). The donor polynucleotide can contain sufficient homology to a genomic sequence at the target site, e.g. 70%, 80%, 85%, 90%, 95%, or 100% homology with the nucleotide sequences flanking the target site, e.g., within about 200 bases or less of the target site, e.g., within about 190 bases or less of the target site, e.g., within about 180 bases or less of the target site, e.g., within about 170 bases or less of the target site, e.g., within about 160 bases or less of the target site, e.g., within about 150 bases or less of the target site, e.g., within about 140 bases or less of the target site, e.g., within about 130 bases or less of the target site, e.g., within about 120 bases or less of the target site, e.g., within about 110 bases or less of the target site, e.g., within about 100 bases or less of the target site, e.g., within about 90 bases or less of the target site, e.g., within about 80 bases or less of the target site, e.g., within about 70 bases or less of the target site, e.g., within about 60 bases or less of the target site, e.g., 50 bases or less of the target site, e.g., within about 30 bases, within about 15 bases, within about 10 bases, within about 5 bases, or immediately flanking the target site, to support homology-directed repair between it and the genomic sequence to which it bears homology.

Effective Amount

An "effective amount" as used herein, means an amount which provides a therapeutic or prophylactic benefit under the conditions of administration.

Encapsulation Efficiency

As used herein, "encapsulation efficiency" refers to the amount of a therapeutic and/or prophylactic that becomes part of a nanoparticle composition, relative to the initial total amount of therapeutic and/or prophylactic used in the preparation of a nanoparticle composition. For example, if 97 mg of a polynucleotide are encapsulated in a nanoparticle composition out of a total 100 mg of therapeutic and/or prophylactic initially provided to the composition, the encapsulation efficiency may be given as 97%. As used herein, "encapsulation" may refer to complete, substantial, or partial enclosure, confinement, surrounding, or encasement.

Encodes

As used herein, a DNA sequence that "encodes" a particular RNA is a DNA nucleotide sequence that is transcribed into RNA. A DNA polynucleotide may encode an RNA (mRNA) that is translated into protein (and therefore the DNA and the mRNA both encode the protein), or a DNA polynucleotide may encode an RNA that is not translated into protein (e.g. tRNA, rRNA, microRNA (miRNA), a "non-coding" RNA (ncRNA), a guide RNA, etc.).

Exosomes

As used herein, the term "exosomes" refer to small membrane bound vesicles with an endocytic origin. Without wishing to be bound by theory, exosomes are generally released into an extracellular environment from host/progenitor cells post fusion of multivesicular bodies the cellular plasma membrane. As such, exosomes can include components of the progenitor membrane in addition to designed components. Exosome membranes are generally lamellar, composed of a bilayer of lipids, with an aqueous internanoparticle space.

Expression Vector

As used herein, the term "expression vector" or "expression construct" refers to a vector that includes one or more expression control sequences, and an "expression control sequence" is a DNA sequence that controls and regulates the transcription and/or translation of another DNA sequence. Expression control sequences are sequences which control the transcription, post-transcriptional events and translation of nucleic acid sequences.

Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence.

Fusion Protein

The term "fusion protein" refers to a polypeptide comprising a polypeptide or fragment coupled to heterologous amino acid sequences optionally via an amino acid linker. Fusion proteins are useful because they can be constructed to contain two or more desired functional elements from two or more different proteins. A fusion protein comprises at least 10 contiguous amino acids from a polypeptide of interest, more preferably at least 20 or 30 amino acids, even more preferably at least 40, 50 or 60 amino acids, yet more preferably at least 75, 100 or 125 amino acids.

Fusions that include the entirety of the proteins of the present invention have particular utility. The heterologous polypeptide included within the fusion protein of the present invention is at least 6 amino acids in length, often at least 8 amino acids in length, and usefully at least 15, 20, and 25 amino acids in length. Fusions that include larger polypeptides, such as an IgG Fc region, and even entire proteins, such as the green fluorescent protein ("GFP") chromophore-containing proteins, have particular utility. Fusion proteins can be produced recombinantly by constructing a nucleic acid sequence which encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

Guide RNA

The RNA molecule that binds to the Cas12a polypeptide and targets the polypeptide to a specific location within the targeted polynucleotide sequence is referred to herein as the "guide RNA" or "guide RNA polynucleotide" (also referred to herein as a "guide RNA" or "gRNA" or "crRNA"). A guide RNA comprises two segments, a "DNA-targeting segment" and a "protein-binding segment." By "segment" it is meant a segment/section/region of a molecule, e.g., a contiguous stretch of nucleotides in an RNA. As an illustrative, non-limiting example, a protein-binding segment of a guide RNA can comprise base pairs 5-20 of the RNA molecule that is 40 base pairs in length; and the DNA-targeting segment can comprise base pairs 21-40 of the RNA molecule that is 40 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and may include regions of RNA molecules that are of any total length and may or may not include regions with complementarity to other molecules.

The DNA-targeting segment (or "DNA-targeting sequence") comprises a nucleotide sequence that is complementary to a specific sequence within a targeted polynucleotide sequence (the complementary strand of the targeted polynucleotide sequence) designated the "protospacer-like" sequence herein. The protein-binding segment (or "protein-binding sequence") interacts with a site-directed modifying polypeptide. When the site-directed modifying polypeptide is an Cas12a polypeptide, site-specific cleavage of the targeted polynucleotide sequence may occur at locations determined by both (i) base-pairing complementarity between the guide RNA and the targeted polynucleotide sequence; and (ii) a short motif (referred to as the protospacer adjacent motif (PAM)) in the targeted polynucleotide sequence.

Heterologous Nucleic Acid

As used herein, the term "heterologous nucleic acid" refers to a genotypically distinct entity from that of the rest of the entity to which it is compared or into which it is introduced or incorporated. For example, a polynucleotide introduced by genetic engineering techniques into a different cell type is a heterologous polynucleotide (e.g., DNA or RNA) and, if expressed, can encode a heterologous polypeptide. Similarly, a cellular sequence (e.g., a gene or portion thereof) that is incorporated into a viral vector is a heterologous nucleotide sequence with respect to the vector.

Homology

A protein has "homology" or is "homologous" to a second protein if the nucleic acid sequence that encodes the protein has a similar sequence to the nucleic acid sequence that encodes the second protein. Alternatively, a protein has homology to a second protein if the two proteins have "similar" amino acid sequences. (Thus, the term "homologous proteins" is defined to mean that the two proteins have similar amino acid sequences.) As used herein, homology between two regions of amino acid sequence (especially with respect to predicted structural similarities) is interpreted as implying similarity in function.

Sequence homology for polypeptides, which is also referred to as percent sequence identity, is typically measured using sequence analysis software. See, e.g., the Sequence Analysis Software Package of the Genetics Computer Group (GCG), University of Wisconsin Biotechnology Center, 910 University Avenue, Madison, Wis. 53705. Protein analysis software matches similar sequences using a measure of homology assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild-type protein and a mutein thereof. See, e.g., GCG Version 6.1.

A preferred algorithm when comparing a particular polypeptide sequence to a database containing a large number of sequences from different organisms is the computer program BLAST (Altschul et al., *J. Mol. Biol.* 215:403-410 (1990); Gish and States, *Nature Genet.* 3:266-272 (1993); Madden et al., *Meth. Enzymol.* 266:131-141 (1996); Altschul et al., *Nucleic Acids Res.* 25:3389-3402 (1997); Zhang and Madden, *Genome Res.* 7:649-656 (1997)), especially blastp or tblastn (Altschul et al., *Nucleic Acids Res.* 25:3389-3402 (1997)). Preferred parameters for BLASTp are: Expectation value: 10 (default); Filter: seg (default); Cost to open a gap: 11 (default); Cost to extend a gap: 1 (default); Max. alignments: 100 (default); Word size: 11 (default); No. of descriptions: 100 (default); Penalty Matrix: BLOWSUM62.

The length of polypeptide sequences compared for homology will generally be at least about 16 amino acid residues, usually at least about 20 residues, more usually at least about 24 residues, typically at least about 28 residues, and preferably more than about 35 residues. When searching a database containing sequences from a large number of different organisms, it is preferable to compare amino acid sequences. Database searching using amino acid sequences can be measured by algorithms other than blastp known in the art. For instance, polypeptide sequences can be compared using FASTA, a program in GCG Version 6.1.

FASTA provides alignments and percent sequence identity of the regions of the best overlap between the query and search sequences. Pearson, *Methods Enzymol.* 183:63-98 (1990) (incorporated by reference herein). For example, percent sequence identity between amino acid sequences can be determined using FASTA with its default parameters (a word size of 2 and the PAM250 scoring matrix), as provided in GCG Version 6.1, herein incorporated by reference.

When this disclosure speaks to a polypeptide having a percent identity with respect to another amino acid sequence (a reference amino acid sequence), such as a polypeptide at least 50%, at least 55%, at least 60%, at least 65%, at least 70%, at least 75%, at least 80%, at least 85%, at least 90%, at least 91%, at least 92%, at least 93%, at least 94%, at least 95, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to another amino acid sequence (a reference amino acid sequence), such as one of SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419), it is advantageous that in the polypeptide having a percent identity to the reference amino acid sequence conserved regions of the reference amino acid sequence (e.g., conserved when compared with other Cas12as, such as those identified herein) be preserved and/or that the polypeptide has at least one activity selected from endonuclease activity; endoribonuclease activity, or RNA-guided DNase activity and/or that the polypeptide of which comprises: a. one or more α-helical recognition lobe (REC) and a nuclease lobe (NUC); b. a Wedge (WED), α-helical recognition lobe (REC), PAM-interacting (PI), RuvC nuclease, Bridge Helix (BH) and NUC domains; or c. one or more domains selected from RuvC, REC, WED, BH, PI and NUC domains and/or that the polypeptide recognizes or binds crRNA(s) or is bound to crRNA(s), such as a crRNA sequence from Table S15C. Likewise, when this disclosure speaks to a nucleic acid sequence or molecule having a percent identity with respect to a nucleic acid sequence having a percent identity with respect to another nucleic acid sequence or molecule (a reference nucleic acid sequence), such as a nucleic acid sequence at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to another nucleic acid sequence (a reference nucleic acid sequence, such as a sequence selected from SEQ ID NO: 365 (No. ID405), SEQ ID NO: 74 (No. ID414), or SEQ ID NO: 565 (No. ID418), SEQ ID NO: 366 (No. ID406), SEQ ID NO: 331 (No. ID411), SEQ ID NO: 30 (No. ID415), or SEQ ID NO: 445 (No. ID419), it is advantageous that in the nucleic acid sequence that has a percent identity to the reference nucleic acid sequence that conserved regions of the reference nucleic acid sequence (e.g., conserved when compared with other Cas12as, such as those identified herein) be preserved and/or that in the polypeptide that is expressed from the nucleic acid sequence that has a percent identity to the reference nucleic acid sequence that the polypeptide contain conserved region(s) (e.g., conserved when compared with other Cas12as, such as those identified herein) and/or that the polypeptide has at least one activity selected from endonuclease activity; endoribonuclease activity, or RNA-guided DNase activity and/or that the polypeptide of which comprises: a. one or more α-helical recognition lobe (REC) and a nuclease lobe (NUC); b. a Wedge (WED), α-helical recognition lobe (REC), PAM-interacting (PI), RuvC nuclease, Bridge Helix (BH) and NUC domains; or c. one or more domains selected from RuvC, REC, WED, BH, PI and NUC domains and/or that the polypeptide recognizes or binds crRNA(s) or is bound to crRNA(s), such as a crRNA sequence from Table S15C.

Homology-Directed Repair

As used herein, "homology-directed repair (HDR)" refers to the specialized form DNA repair that takes place, for example, during repair of double-strand breaks in cells. This process requires nucleotide sequence homology, uses a "donor" molecule to template repair of a "target" molecule (i.e., the one that experienced the double-strand break), and leads to the transfer of genetic information from the donor to the target. Homology-directed repair may result in an alteration of the sequence of the target molecule (e.g., insertion, deletion, mutation), if the donor polynucleotide differs from the target molecule and part or all of the sequence of the donor polynucleotide is incorporated into the targeted polynucleotide sequence.

Identical

As used herein, the term "identical" refers to two or more sequences or subsequences which are the same. In addition, the term "substantially identical," as used herein, refers to two or more sequences which have a percentage of sequential units which are the same when compared and aligned for maximum correspondence over a comparison window, or designated region as measured using a comparison algorithm or by manual alignment and visual inspection. By way of example only, two or more sequences may be "substantially identical" if the sequential units are about 60% identical, about 65% identical, about 70% identical, about 75% identical, about 80% identical, about 85% identical, about 90% identical, or about 95% identical over a specified region. Such percentages to describe the "percent identity" of two or more sequences. The identity of a sequence can exist over a region that is at least about 75-100 sequential units in length, over a region that is about 50 sequential units in length, or, where not specified, across the entire sequence. This definition also refers to the complement of a test sequence.

Alternatively, substantially identical or similarity exists when a nucleic acid or fragment thereof hybridizes to another nucleic acid, to a strand of another nucleic acid, or to the complementary strand thereof, under stringent hybridization conditions. "Stringent hybridization conditions" and "stringent wash conditions" in the context of nucleic acid hybridization experiments depend upon a number of different physical parameters. Nucleic acid hybridization will be affected by such conditions as salt concentration, temperature, solvents, the base composition of the hybridizing species, length of the complementary regions, and the number of nucleotide base mismatches between the hybridizing nucleic acids, as will be readily appreciated by those skilled in the art. One having ordinary skill in the art knows how to vary these parameters to achieve a particular stringency of hybridization.

Isolated

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell. An "isolated nucleic acid" refers to a nucleic acid segment or fragment, which has been separated from sequences which flank it in a naturally occurring state, i.e., a DNA fragment, which has been removed from the sequences which are normally adjacent to the fragment, i.e., the sequences adjacent to the fragment in a genome in which it naturally occurs. The term also applies to nucleic acids which have been substantially purified from other components, which naturally accompany the nucleic acid, i.e., RNA or DNA or proteins, which naturally accompany it in the cell. The term therefore includes, for example, a recombinant DNA or RNA, which is incorporated into a vector, into an autonomously replicating plasmid or virus, or into the genomic DNA or RNA of a prokaryote or eukaryote, or which exists as a separate molecule (i.e., as a cDNA or a genomic or cDNA fragment produced by PCR or restriction enzyme digestion) independent of other sequences. it also includes a recombinant DNA or RNA, which is part of a hybrid gene encoding additional polypeptide sequence.

Isolated Protein

The term "isolated protein" or "isolated polypeptide" is a protein or polypeptide that by virtue of its origin or source of derivation (1) is not associated with naturally associated components that accompany it in its native state, (2) exists in a purity not found in nature, where purity can be adjudged with respect to the presence of other cellular material (e.g., is free of other proteins from the same species) (3) is expressed by a cell from a different species, or (4) does not occur in nature (e.g., it is a fragment of a polypeptide found in nature or it includes amino acid analogs or derivatives not found in nature or linkages other than standard peptide bonds). Thus, a polypeptide that is chemically synthesized or synthesized in a cellular system different from the cell from which it naturally originates will be "isolated" from its naturally associated components. A polypeptide or protein may also be rendered substantially free of naturally associated components by isolation, using protein purification techniques well known in the art. As thus defined, "isolated" does not necessarily require that the protein, polypeptide, peptide or oligopeptide so described has been physically removed from its native environment.

Lipid Nanoparticle (LNP)

As used herein, the term "lipid nanoparticle" or LNP refers to a type of lipid particle delivery system formed of small solid or semi-solid particles possessing an exterior lipid layer with a hydrophilic exterior surface that is exposed to the non-LNP environment, an interior space which may aqueous (vesicle like) or non-aqueous (micelle like), and at least one hydrophobic inter-membrane space. LNP membranes may be lamellar or non-lamellar and may be comprised of 1, 2, 3, 4, 5 or more layers. In some embodiments, LNPs may comprise a nucleic acid (e.g. Cas12a editing system) into their interior space, into the inter membrane space, onto their exterior surface, or any combination thereof. In some embodiments, an LNP of the present disclosure comprises an ionizable lipid, a structural lipid, a PEGylated lipid (aka PEG lipid), and a phospholipid. In alternative embodiments, an LNP comprises an ionizable lipid, a structural lipid, a PEGylated lipid (aka PEG lipid), and a zwitterionic amino acid lipid.

Further discuss of liposomes can be found, for example, in Tenchov et al., "Lipid Nanoparticles—From Liposomes to mRNA Vaccine Delivery, a Landscape of Diversity and Advancement," *ACS Nano*, 2021, 15, pp. 16982-17015 (the contents of which are incorporated by reference).

Linker

As used herein, the term "linker" refers to a molecule linking or joining two other molecules or moieties. The linker can be an amino acid sequence in the case of a linker joining two fusion proteins. For example, an RNA-guided nuclease (e.g., Cas12a) can be fused to a reverse transcriptase or deaminase by an amino acid linker sequence. The linker can also be a nucleotide sequence in the case of joining two nucleotide sequences together. For example, in the instant case, a guide RNA at its 5' and/or 3' ends may be linked by a nucleotide sequence linker to one or more nucleotide sequences (e.g., a RT template in the case of a prime editor guide RNA). In other embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

Liposomes

As used herein, the term "liposomes" refer to small vesicles that contain at least one lipid bilayer membrane surrounding an aqueous inner-nanoparticle space that is generally not derived from a progenitor/host cell.

Micelles

As used herein, the term "micelles" refer to small particles which do not have an aqueous intra-particle space.

Modified Derivative

A "modified derivative" refers to polypeptides or fragments thereof that are substantially homologous in primary structural sequence but which include, e.g., in vivo or in vitro chemical and biochemical modifications or which incorporate amino acids that are not found in the native polypeptide. Such modifications include, for example, acetylation, carboxylation, phosphorylation, glycosylation, ubiquitination, labeling, e.g., with radionuclides, and various enzymatic modifications, as will be readily appreciated by those skilled in the art. A variety of methods for labeling polypeptides and of substituents or labels useful for such purposes are well known in the art, and include radioactive isotopes such as $^{125}$I, $^{32}$P, $^{3}$S, and $^{3}$H, ligands which bind to labeled antiligands (e.g., antibodies), fluorophores, chemiluminescent agents, enzymes, and antiligands which can serve as specific binding pair members for a labeled ligand. The choice of label depends on the sensitivity required, ease of conjugation with the primer, stability requirements, and available instrumentation. Methods for labeling polypeptides are well known in the art. See, e.g., Ausubel et al., *Current Protocols in Molecular Biology*, Greene Publishing Associates (1992, and Supplements to 2002) (hereby incorporated by reference).

Modulating

By the term "modulating," as used herein, is meant mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

Mutated

The term "mutated" when applied to nucleic acid sequences means that nucleotides in a nucleic acid sequence may be inserted, deleted or changed compared to a reference nucleic acid sequence. A single alteration may be made at a locus (a point mutation) or multiple nucleotides may be inserted, deleted or changed at a single locus. In addition, one or more alterations may be made at any number of loci within a nucleic acid sequence. A nucleic acid sequence may be mutated by any method known in the art including but not limited to mutagenesis techniques such as "error-prone PCR" (a process for performing PCR under conditions where the copying fidelity of the DNA polymerase is low, such that a high rate of point mutations is obtained along the entire length of the PCR product; see, e.g., Leung et al., Technique, 1:11-15 (1989) and Caldwell and Joyce, PCR Methods Applic. 2:28-33 (1992)); and "oligonucleotide-directed mutagenesis" (a process which enables the generation of site-specific mutations in any cloned DNA segment of interest; see, e.g., Reidhaar-Olson and Sauer, Science 241:53-57 (1988)).

Nanoparticle

As used herein, the term "nanoparticle" refers to any particle ranging in size from 10-1,000 nm.

Non-Homologous End Joining

As used herein, "non-homologous end joining (NHEJ)" refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

Non-Peptide Analog

The term "non-peptide analog" refers to a compound with properties that are analogous to those of a reference polypeptide. A non-peptide compound may also be termed a "peptide mimetic" or a "peptidomimetic." See, e.g., Jones, *Amino Acid and Peptide Synthesis*, Oxford University Press (1992); Jung, *Combinatorial Peptide and Nonpeptide Libraries: A Handbook*, John Wiley (1997); Bodanszky et al., *Peptide Chemistry—A Practical Textbook*, Springer Verlag (1993); *Synthetic Peptides: A Users Guide*, (Grant, ed., W. H. Freeman and Co., 1992); Evans et al., *J. Med. Chem.* 30:1229 (1987); Fauchere, *J. Adv. Drug Res.* 15:29 (1986); Veber and Freidinger, *Trends Neurosci.,* 8:392-396 (1985); and references sited in each of the above, which are incorporated herein by reference. Such compounds are often developed with the aid of computerized molecular modeling. Peptide mimetics that are structurally similar to useful peptides of the present invention may be used to produce an equivalent effect and are therefore envisioned to be part of the present invention.

Nuclear Localization Sequence (NLS)

As used herein, the term"nuclear localization sequence" or "NLS" refers to an amino acid sequence that promotes import of a protein (e.g., a RNA-guided nuclease) into the cell nucleus, for example, by nuclear transport. Nuclear localization sequences are known in the art. For example, NLS sequences are described in Plank et al., international PCT application, PCT/EP2000/011690, filed Nov. 23, 2000, published as WO/2001/038547 on May 31, 2001, the contents of which are incorporated herein by reference for its disclosure of exemplary nuclear localization sequences.

Nucleic Acid

As used herein, the term "nucleic acid" or "nucleic acid molecule" or "nucleic acid sequence" or "polynucleotide" generally refer to deoxyribonucleic or ribonucleic oligonucleotides in either single- or double-stranded form. The term may (or may not) encompass oligonucleotides containing known analogues of natural nucleotides. The term also may (or may not) encompass nucleic acid-like structures with synthetic backbones, see, e.g., Eckstein, 1991; Baserga et ah, 1992; Milligan, 1993; WO 97/03211; WO 96/39154; Mata, 1997; Strauss-Soukup, 1997; and Samstag, 1996. The term encompasses both ribonucleic acid (RNA) and DNA, including cDNA, genomic DNA, synthetic, synthesized (e.g., chemically synthesized) DNA, and/or DNA (or RNA) containing nucleic acid analogs. The nucleotides Adenine (A), Thymine (T), Guanine (G) and Cytosine (C) also may (or may not) encompass nucleotide modifications, e.g., methylated and/or hydroxylated nucleotides, e.g., Cytosine (C) encompasses 5-methylcytosine and 5-hydroxymethylcytosine. The nucleic acid can be in any topological conformation. For instance, the nucleic acid can be single-stranded, double-stranded, triple-stranded, quadruplexed, partially double-stranded, branched, hairpinned, circular, or in a padlocked conformation.

Nucleic Acid-Guided Nuclease

As used herein, the term "nucleic acid-guided nuclease" or "nucleic acid-guided endonuclease" refers to a nuclease (e.g., Cas12a) that associates covalently or non-covalently with a guide nucleic acid (e.g., a guide RNA or a guide DNA) thereby forming a complex between the guide nucleic acid and the nucleic acid-guided nuclease. The guide nucleic acid comprises a spacer sequence which comprises a nucleotide sequence having complementarity with a strand of a target DNA sequence. Thus, the nucleic acid-guided nuclease is indirectly guided or programmed to localize to a specific site in a DNA molecule through its association with the guide nucleic acid, which directly binds or anneals to a strand of the target DNA through its complementarity region via Watson-Crick base-pairing. In some embodiments, the nucleic acid-guided nuclease will include a DNA-binding activity (e.g., as in the case for CRISPR Cas12a). Most commonly, the nucleic acid-guided nuclease is programmed by associating with a guide RNA molecule and in such cases the nuclease may be called "RNA-guided nuclease." When programmed by a guide DNA, the nuclease may be called a "DNA-guided nuclease." Nucleic acid-guided, RNA-guided, or DNA-guided nucleases may also be referred to as "programmable nucleases," which also include other classes of programmable nucleases which associate with specific DNA sequences through amino acid/nucleotide sequence recognition (e.g., zinc fingers nucleases (ZFN) and transcription activator like effector nucleases (TALEN)) rather than through guide RNAs. In addition, any nuclease contemplated herein may also be engineered to remove, inactivate, or otherwise eliminate one or more nuclease activities (e.g., by introducing a nuclease-inactivating mutation in the active site(s) of a nuclease, e.g., in the RuvC domain of a Cas12a). A nuclease that has been modified to remove, inactivate, or otherwise eliminate all nuclease activity may be referred to as a "dead" nuclease. A dead nuclease is not able to cut either strand of a double-stranded DNA molecule. A nuclease that has been modified to remove, inactivate, or otherwise eliminate at least one nuclease activity but which still retains at least one nuclease activity may be referred to as a "nickase" nuclease. A nickase nuclease cuts one strand of a double-stranded DNA molecule, but not both strands. For example, a CRISPR Cas9 naturally comprises two distinct nuclease activity domains, namely, the HNH domain and the RuvC domain. The HNH domain cuts the strand of DNA bound to the guide RNA and the RuvC domain cuts the protospacer strand. One can obtain a nickase Cas9 by inactivating either the HNH domain or the RuvC domain. One can obtain a dead Cas9 by inactivating both the HNH domain and the RuvC domain. Other RNA-guided nuclease may be similarly converted to nickases and/or dead nucleases by inactivating one or more of the existing nuclease domains.

Off-Target Effects

"Off-target effects" refer to non-specific genetic modifications that can occur when the CRISPR nuclease binds at a different genomic site than its intended target due to mismatch tolerance Hsu, P., Scott, D., Weinstein, J. et al. DNA targeting specificity of RNA-guided Cas9 nucleases. *Nat Biotechnol* 31, 827-832 (2013). doi.org/10.1038/nbt.2647

Operably Linked

As used herein, the term "operably linked" or "under transcriptional control," when used in conjunction with the description of a promoter, refers to the correct location and orientation in relation to a polynucleotide (e.g., a coding sequence) to control the initiation of transcription by RNA polymerase and expression of the coding sequence, such as one for the msr gene, msd gene, and/or the ret gene. Other transcriptional control regulatory elements (e.g., enhancer sequences, transcription factor binding sites) may also be operably linked to a gene if their location relative to a gene controls or regulates the expression of the gene.

PEG Lipid

As used herein, a "PEG lipid" or "PEGylated lipid" refers to a lipid comprising a polyethylene glycol component.

Peptide

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

Promoter

As used herein, the term "promoter" is art-recognized and refers to a nucleic acid molecule with a sequence recognized by the cellular transcription machinery and which is able to initiate transcription of a downstream gene. A promoter can be constitutively active, meaning that the promoter is always active in a given cellular context, or conditionally active, meaning that the promoter is only active in the presence of a specific condition. For example, a conditional promoter may only be active in the presence of a specific protein that connects a protein associated with a regulatory element in the promoter to the basic transcriptional machinery, or only in the absence of an inhibitory molecule. Within the promoter sequence will be found a transcription initiation site, as well as protein binding domains responsible for the binding of RNA polymerase. Eukaryotic promoters will often, but not always, contain "TATA" boxes and "CAT" boxes. Various promoters, including inducible promoters, may be used to drive expression by the various vectors of the present disclosure.

Programmable Nuclease

As used herein, the term "programmable nuclease" is meant to refer to a polypeptide that has the property of selective localization to a specific desired nucleotide sequence target in a nucleic acid molecule (e.g., to a specific gene target) due to one or more targeting functions. Such targeting functions can include one or more DNA-binding domains, such as zinc finger domains characteristic of many different types of DNA binding proteins or TALE domains characteristic of TALEN proteins. Such targeting function may also include the ability to associate and/or form a complex with a guide RNA, which then localizes to a specific site on the DNA which bears a sequence that is complementary to a portion of the guide RNA (i.e., the spacer of the guide RNA). In some embodiments, the programmable nuclease may be a single protein which comprises both a domain that binds directly (e.g., a ZF protein) or indirectly (e.g., an RNA-guided protein) to a target DNA site, as well as a nuclease domain. In other embodiments, the programmable nuclease may be a composite of two or more separate proteins or domains (from different proteins) which together provide the necessary functions of selective DNA binding and nuclease activity. For example, the programmable nuclease may comprise a (a) nuclease-inactive RNA-guided nuclease (which still is capable of binding a guide RNA, localizing to a target DNA, and binding to the target DNA, but not capable of cutting or nicking the strands) fused to a (b) nuclease protein or domain, such as a FokI nuclease.

Polypeptide

The term "polypeptide" encompasses both naturally-occurring and non-naturally-occurring proteins, and fragments, muteins, derivatives and analogs thereof. A polypeptide may be monomeric or polymeric. Further, a polypeptide may comprise a number of different domains each of which has one or more distinct activities.

Polypeptide Fragment

The term "polypeptide fragment" as used herein refers to a polypeptide that has a deletion, e.g., an amino-terminal and/or carboxy-terminal deletion compared to a full-length polypeptide. In a preferred embodiment, the polypeptide fragment is a contiguous sequence in which the amino acid sequence of the fragment is identical to the corresponding positions in the naturally-occurring sequence. Fragments typically are at least 5, 6, 7, 8, 9 or 10 amino acids long, preferably at least 12, 14, 16 or 18 amino acids long, more preferably at least 20 amino acids long, more preferably at least 25, 30, 35, 40 or 45, amino acids, even more preferably at least 50 or 60 amino acids long, and even more preferably at least 70 amino acids long.

Polypeptide Mutant

A "polypeptide mutant" or "mutein" refers to a polypeptide whose sequence contains an insertion, duplication, deletion, rearrangement or substitution of one or more amino acids compared to the amino acid sequence of a native or wild-type protein. A mutein may have one or more amino acid point substitutions, in which a single amino acid at a position has been changed to another amino acid, one or more insertions and/or deletions, in which one or more amino acids are inserted or deleted, respectively, in the sequence of the naturally-occurring protein, and/or truncations of the amino acid sequence at either or both the amino or carboxy termini. A mutein may have the same but preferably has a different biological activity compared to the naturally-occurring protein. A mutein has at least 85% overall sequence homology to its wild-type counterpart. Even more preferred are muteins having at least 90% overall sequence homology to the wild-type protein. In an even more preferred embodiment, a mutein exhibits at least 95% sequence identity, even more preferably 98%, even more preferably 99% and even more preferably 99.9% overall sequence identity.

Sequence homology may be measured by any common sequence analysis algorithm, such as Gap or Bestfit.

Amino acid substitutions can include those which: (1) reduce susceptibility to proteolysis, (2) reduce susceptibility to oxidation, (3) alter binding affinity for forming protein complexes, (4) alter binding affinity or enzymatic activity, and (5) confer or modify other physicochemical or functional properties of such analogs.

As used herein, the twenty conventional amino acids and their abbreviations follow conventional usage. See *Immunology—A Synthesis* (Golub and Gren eds., Sinauer Associates, Sunderland, Mass., $2^{nd}$ ed. 1991), which is incorporated by reference. "X" indicates any amino acid. Unless otherwise indicated, "B" indicates Asx (Aspartic acid or asparagine) and "Z" indicates Glx (glutamic acid or glutamine). In certain consensus sequences, where specifically indicated, strings of contiguous Zs, e.g. "ZZZZZZ" indicate amino acids that can be any amino acid or absent (distinguished from "any amino acid). Stereoisomers (e.g., D-amino acids) of the twenty conventional amino acids, unnatural amino acids such as α-, α-disubstituted amino acids, N-alkyl amino acids, and other unconventional amino acids may also be suitable components for polypeptides of the present invention. Examples of unconventional amino acids include: 4-hydroxyproline, γ-carboxyglutamate, ε—N, N,N-trimethyllysine, ε—N-acetyllysine, O-phosphoserine, N-acetylserine, N-formylmethionine, 3-methylhistidine, 5-hydroxylysine, N-methylarginine, and other similar amino acids and imino acids (e.g., 4-hydroxyproline). In the polypeptide notation used herein, the left-hand end corresponds to the amino terminal end and the right-hand end corresponds to the carboxy-terminal end, in accordance with standard usage and convention.

Recombinant

The term "recombinant" refers to a biomolecule, e.g., a gene or protein, that (1) has been removed from its naturally occurring environment, (2) is not associated with all or a portion of a polynucleotide in which the gene is found in nature, (3) is operatively linked to a polynucleotide which it is not linked to in nature, or (4) does not occur in nature. The term "recombinant" can be used in reference to cloned DNA isolates, chemically synthesized polynucleotide analogs, or polynucleotide analogs that are biologically synthesized by heterologous systems, as well as proteins and/or mRNAs encoded by such nucleic acids.

As used herein, an endogenous nucleic acid sequence in the genome of an organism (or the encoded protein product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous (originating from the same host cell or progeny thereof) or exogenous (originating from a different host cell or progeny thereof). By way of example, a promoter sequence can be substituted (e.g., by homologous recombination) for the native promoter of a gene in the genome of a host cell, such that this gene has an altered expression pattern. This gene would now become "recombinant" because it is separated from at least some of the sequences that naturally flank it.

A nucleic acid is also considered "recombinant" if it contains any modifications that do not naturally occur to the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

Recombinant Host Cell

The term "recombinant host cell" (or simply "host cell"), as used herein, is intended to refer to a cell into which a recombinant vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein. A recombinant host cell may be an isolated cell or cell line grown in culture or may be a cell which resides in a living tissue or organism.

Suitable methods of genetic modification such as "transformation" include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et al., Adv Drug Deliv Rev. 2012 Sep. 13. pii: 50169-409X(12)00283-9. doi: 10.1016/j.addr.2012.09.023), and the like. The choice of method of genetic modification is generally dependent on the type of cell being transformed and the circumstances under which the transformation is taking place (e.g., in vitro, ex vivo, or in vivo). A general discussion of these methods can be found in Ausubel, et al., Short Protocols in Molecular Biology, 3rd ed., Wiley & Sons, 1995.

Recombinant Nucleic Acid

A "recombinant nucleic acid" or "recombinant nucleotide" refers to a molecule that is constructed by joining nucleic acid molecules, which optionally may self-replicate in a live cell. Recombinant nucleic acids and synthetic nucleic acids also include those molecules that result from the replication of either of the foregoing.

Region

The term "region" as used herein refers to a physically contiguous portion of the primary structure of a biomolecule. In the case of proteins, a region is defined by a contiguous portion of the amino acid sequence of that protein.

RNA-Guided Nuclease

As used herein, an "RNA-guided nuclease" is a type of "programmable nuclease," and a specific type of "nucleic acid-guided nuclease." As used herein, the term "RNA-guided nuclease" or "RNA-guided endonuclease" refers to a nuclease that associates covalently or non-covalently with a guide RNA thereby forming a complex between the guide RNA and the RNA-guided nuclease. The guide RNA comprises a spacer sequence which comprises a nucleotide sequence having complementarity with a strand of a target DNA sequence. Thus, the RNA-guided nuclease is indirectly guided or programmed to localize to a specific site in a DNA molecule through its association with the guide RNA, which directly binds or anneals to a strand of the target DNA through its complementarity region via Watson-Crick base-pairing.

Sequence Identity

As used herein, the term "sequence identity" refers to the overall relatedness between polymeric molecules, e.g., between polynucleotide molecules (e.g., DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). For example, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. In other examples, the length of sequence identity comparison may be over a stretch of at least about nine nucleotides, usually at least about 20 nucleotides, more usually at least about 24 nucleotides, typically at least about 28 nucleotides, more typically at least about 32 nucleotides, and preferably at least about 36 or more nucleotides. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna. CMP matrix. Methods commonly employed to determine percent identity between sequences include, but are not limited to those disclosed in Carillo, H. and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., Nucleic Acids Research, 12(1), 387 (1984)), BLASTP, BLASTN, and FASTA (Altschul et al., *J. Mol. Biol.* 215: 403-410 (1990);

Gish and States, *Nature Genet.* 3:266-272 (1993); Madden et al., *Meth. Enzymol.* 266:131-141 (1996); Altschul et al., *Nucleic Acids Res.* 25:3389-3402 (1997); Zhang and Madden, *Genome Res.* 7:649-656 (1997)), (Altschul et al., *Nucleic Acids Res.* 25:3389-3402 (1997)). Polynucleotide sequences, for instance, can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990) (hereby incorporated by reference in its entirety). Percent sequence identity between nucleic acid sequences, for instance, can be determined using FASTA with its default parameters (a word size of 6 and the NOPAM factor for the scoring matrix) or using Gap with its default parameters as provided in GCG Version 6.1.

Specific Binding

"Specific binding" refers to the ability of two molecules to bind to each other in preference to binding to other molecules in the environment. Typically, "specific binding" discriminates over adventitious binding in a reaction by at least two-fold, more typically by at least 10-fold, often at least 100-fold. Typically, the affinity or avidity of a specific binding reaction, as quantified by a dissociation constant, is about $10^{-7}$ M or stronger (e.g., about $10^{-8}$ M, $10^{-9}$ M or even stronger).

Stem and Loop

As used herein, the term "stem" refers to two or more base pairs, such as 3, 4, 5, 6, 7, 8, 9, 10, 11, 12, 13, 14, 15, 16, 17, 18, 19, 20 or more base pairs, formed by inverted repeat sequences connected at a "tip," where the more 5' or "upstream" strand of the stem bends to allows the more 3' or "downstream" strand to base-pair with the upstream strand. The number of base pairs in a stem is the "length" of the stem. The tip of the stem is typically at least 3 nucleotides, but can be 4, 5, 6, 7, 8, 9, 10, 11, 12, 13, 14, 15 or more nucleotides.

Larger tips with more than 5 nucleotides are also referred to as a "loop." An otherwise continuous stem may be interrupted by one or more bulges as defined herein. The number of unpaired nucleotides in the bulge(s) are not included in the length of the stem. The position of a bulge closest to the tip can be described by the number of base pairs between the bulge and the tip (e.g., the bulge is 4 bps from the tip). The position of the other bulges (if any) further away from the tip can be described by the number of base pairs in the stem between the bulge in question and the tip, excluding any unpaired bases of other bulges in between. As used herein, the term "loop" in the polynucleotide refers to a single stranded stretch of one or more nucleotides, such as 2, 3, 4, 5, 6, 7, 8, 9, or 10 nucleotides, wherein the most 5' nucleotide and the most 3' nucleotide of the loop are each linked to a base-paired nucleotide in a stem.

A "stem-loop structure" or a "hairpin" refers to a nucleic acid having a secondary structure that includes a region of nucleotides which are known or predicted to form a double strand (stem portion) that is linked on one side by a region of predominantly single-stranded nucleotides (loop portion). Such structures are well known in the art and these terms are used consistently with their known meanings in the art. As is known in the art, a stem-loop structure does not require exact base-pairing. Thus, the stem may include one or more base mismatches. Alternatively, the base-pairing may be exact, i.e., not include any mismatches.

As used herein, the term "operably linked" or "under transcriptional control," when used in conjunction with the description of a promoter, refers to the correct location and orientation in relation to a polynucleotide (e.g., a coding sequence) to control the initiation of transcription by RNA polymerase and expression of the coding sequence.

Stringent Hybridization

In general, "stringent hybridization" is performed at about 25° C. below the thermal melting point (Tm) for the specific DNA hybrid under a particular set of conditions. "Stringent washing" is performed at temperatures about 5° C. lower than the Tm for the specific DNA hybrid under a particular set of conditions. The Tm is the temperature at which 50% of the target sequence hybridizes to a perfectly matched probe. See Sambrook et al., Molecular Cloning: A Laboratory Manual, 2d ed., Cold Spring Harbor Laboratory Press, Cold Spring Harbor, N.Y. (1989), page 9.51, hereby incorporated by reference. For purposes herein, "stringent conditions" are defined for solution phase hybridization as aqueous hybridization (i.e., free of formamide) in 6×SSC (where 20×SSC contains 3.0 M NaCl and 0.3 M sodium citrate), 1% SDS at 65° C. for 8-12 hours, followed by two washes in 0.2×SSC, 0.1% SDS at 65° C. for 20 minutes. It will be appreciated by the skilled worker that hybridization at 65° C. will occur at different rates depending on a number of factors including the length and percent identity of the sequences which are hybridizing. Hybridization does not require the sequence of the polynucleotide to be 100% complementary to the target polynucleotide. Hybridization also includes one or more segments such that intervening or adjacent segments that are not involved in the hybridization event (e.g., a loop structure or hairpin structure).

The nucleic acids (also referred to as polynucleotides) of this present invention may include both sense and antisense strands of RNA, cDNA, genomic DNA, and synthetic forms and mixed polymers of the above. They may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.) Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. Other modifications can include, for example, analogs in which the ribose ring contains a bridging moiety or other structure such as the modifications found in "locked" nucleic acids.

Subject

As used herein, the term "subject" refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development. The terms "individual," "subject," "host," and "patient," used interchangeably herein.

Synthetic Nucleic Acid

A "synthetic or artificial nucleic acid" refers nucleic acids that are non-naturally occurring sequences. Such sequences do not originate from, or are not known to be present in any living organism (e.g., based on sequence search in existing sequence databases).

Targeted Polynucleotide Sequence

As used herein "targeted polynucleotide sequence" refers to a DNA polynucleotide that comprises a "target site" or "target sequence." The terms "target site," "target sequence," "target protospacer DNA," or "protospacer-like sequence" are used interchangeably herein to refer to a nucleic acid sequence present in a targeted polynucleotide sequence to which a DNA-targeting segment of a guide RNA will recognize and/or bind, provided sufficient conditions for binding exist. For example, the target site (or target sequence) 5'-GAGCATATC-3' within a targeted polynucleotide sequence is targeted by (or is bound by, or hybridizes with, or is complementary to) the RNA sequence 5'-GAUAUGCUC-3'. Suitable DNA/RNA binding conditions include physiological conditions normally present in a cell.

Other suitable DNA/RNA binding conditions (e.g., conditions in a cell-free system) are known in the art; see, e.g., Sambrook, supra. The strand of the targeted polynucleotide sequence that is complementary to and hybridizes with the guide RNA is referred to as the "complementary strand" and the strand of the targeted polynucleotide sequence that is complementary to the "complementary strand" (and is therefore not complementary to the guide RNA) is referred to as the "noncomplementary strand" or "non-complementary strand."

Target Site

As used herein, a "target site" as used herein is a polynucleotide (e.g., DNA such as genomic DNA) that includes a site or specific locus ("target site" or "target sequence") targeted by a Cas12a gene editing system disclosed herein. In the context of a Cas12a gene editing system disclosed herein that comprise an RNA-guided nuclease, a target sequence is the sequence to which the guide sequence of a guide nucleic acid (e.g., guide RNA) will hybridize. For example, the target site (or target sequence) 5'-GTCAATGGACC-3' (SEQ ID NO:1472) within a target nucleic acid is targeted by (or is bound by, or hybridizes with, or is complementary to) the sequence 5'-GGTCCATTGAC-3' (SEQ ID NO:1473). Suitable hybridization conditions include physiological conditions normally present in a cell. For a double stranded target nucleic acid, the strand of the target nucleic acid that is complementary to and hybridizes with the guide RNA is referred to as the "complementary strand" or "target strand"; while the strand of the target nucleic acid that is complementary to the "target strand" (and is therefore not complementary to the guide RNA) is referred to as the "non-target strand" or "non-complementary strand."

Therapeutic

The term "therapeutic" as used herein means a treatment and/or prophylaxis. A therapeutic effect is obtained by suppression, diminution, remission, or eradication of at least one sign or symptom of a disease or disorder state.

Therapeutically Effective Amount

The term "therapeutically effective amount" refers to the amount of the subject compound that will elicit the biological or medical response of a tissue, system, or subject that is being sought by the researcher, veterinarian, medical doctor or other clinician. The term "therapeutically effective amount" includes that amount of a compound that, when administered, is sufficient to prevent development of, or alleviate to some extent, one or more of the signs or symptoms of the disorder or disease being treated. The therapeutically effective amount will vary depending on the compound, the disease and its severity and the age, weight, etc., of the subject to be treated.

Treat or Treatment

To "treat" a disease as the term is used herein, means to reduce the frequency or severity of at least one sign or symptom of a disease or disorder experienced by a subject.

Treatment

As Used Herein, the Terms "Treatment," "Treat," and "Treating," Refer to a Clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

Upstream and Downstream

As used herein, the terms "upstream" and "downstream" are terms of relativity that define the linear position of at least two elements located in a nucleic acid molecule (whether single or double-stranded) that is orientated in a 5'-to-3' direction. A first element is said to be upstream of a second element in a nucleic acid molecule where the first element is positioned somewhere that is 5' to the second element. Conversely, a first element is downstream of a second element in a nucleic acid molecule where the first element is positioned somewhere that is 3' to the second element.

Variant

As used herein the term "variant" should be taken to mean the exhibition of qualities that have a pattern that deviates from what occurs in nature, e.g., a variant retron RT is retron RT comprising one or more changes in amino acid residues as compared to a wild type retron RT amino acid sequence. The term "variant" encompasses homologous proteins having at least 75%, or at least 80%, or at least 85%, or at least 90%, or at least 95%, or at least 99% percent identity with a reference sequence and having the same or substantially the same functional activity or activities as the reference sequence. The term also encompasses mutants, truncations, or domains of a reference sequence, and which display the same or substantially the same functional activity or activities as the reference sequence.

Vector

As used herein, the term "vector" permits or facilitates the transfer of a polynucleotide from one environment to another. It is a replicon such as a plasmid, phage, or cosmid into which another DNA segment may be inserted so as to bring about the replication of the inserted segment. Generally, a vector is capable of replication when associated with the proper control elements. The term "vector" may include cloning and expression vectors, as well as viral vectors and integrating vectors.

Wild Type

As used herein the term "wild type" is a term of the art understood by skilled persons and means the typical form of an organism, strain, gene, protein, or characteristic as it occurs in nature as distinguished from mutant or variant forms B. Chemical Definitions Alkyl "Alkyl" refers to a straight or branched hydrocarbon chain radical consisting solely of carbon and hydrogen atoms, which is saturated or unsaturated (i.e., contains one or more double and/or triple bonds), having from one to thirty or more carbon atoms (e.g., C1-C24 alkyl), one to twelve carbon atoms (C1-C12 alkyl), one to eight carbon atoms (C1-C8 alkyl) or one to six carbon atoms (C1-C6 alkyl) and which is attached to the rest of the molecule by a single bond, e.g., methyl, ethyl, n propyl, 1-methylethyl (iso propyl), n butyl, n pentyl, 1,1 dimethylethyl (t butyl), 3 methylhexyl, 2 methylhexyl, ethenyl, propyl enyl, but-1-enyl, pent-1-enyl, penta-1,4-dienyl, ethynyl, propynyl, butynyl, pentynyl, hexynyl, and the like. Alkyl groups that include one or more units of unsaturation (one or more double and/or triple bond) can be C2-C24, C2-C12, C2-C8 or C2-C6 groups, for example. Unless specifically stated otherwise, an alkyl group is optionally substituted. The term "alkyl," by itself or as part of another substituent means, unless otherwise stated, a straight or branched chain hydrocarbon having the number of carbon atoms designated (i.e., C1-6 means one to six carbon atoms) and includes straight, branched chain, or cyclic substituent groups.

Alkoxy

For example, the term "alkoxy" employed alone or in combination with other terms means, unless otherwise stated, an alkyl group having the designated number of carbon atoms, as defined above, connected to the rest of the molecule via an oxygen atom, such as, for example, methoxy, ethoxy, 1-propoxy, 2-propoxy (isopropoxy) and the higher homologs and isomers. Preferred are (C1-C3) alkoxy, particularly ethoxy and methoxy.

Alkylamino

As used herein, the terms "alkoxy," "alkylamino" and "alkylthio" are used in their conventional sense, and refer to alkyl groups linked to molecules via an oxygen atom, an amino group, a sulfur atom, respectively.

Alkylene

"Alkylene" or "alkylene chain" refers to a straight or branched divalent hydrocarbon chain consisting solely of carbon and hydrogen, which is saturated or unsaturated (i.e., contains one or more double (alkenylene) and/or triple bonds (alkynylene)), and having, for example, from one to thirty or more carbon atoms (e.g., C1-C24 alkylene), one to fifteen carbon atoms (C1-C15 alkylene), one to twelve carbon atoms (C1-C12 alkylene), one to eight carbon atoms (C1-C8 alkylene), one to six carbon atoms (C1-C6 alkylene), two to four carbon atoms (C2-C4 alkylene), one to two carbon atoms (C1-C2 alkylene), e.g., methylene, ethylene, propylene, n-butylene, ethenylene, propenylene, n-butenylene, propynylene, n-butynylene, and the like. Alkylene groups that include one or more units of unsaturation (one or more double and/or triple bond) can be C2—C24, C2-C12, C2-C8 or C2-C6 groups, for example. The alkylene chain is attached to the rest of the molecule through a single or double bond and to the radical group through a single or double bond. The points of attachment of the alkylene chain to the rest of the molecule and to the radical group can be through one carbon or any two carbons within the chain. Unless stated otherwise specifically in the specification, an alkylene chain may be optionally substituted.

Amino Aryl

As used herein, the term "amino aryl" refers to an aryl moiety which contains an amino moiety. Such amino moieties may include, but are not limited to primary amines, secondary amines, tertiary amines, quaternary amines, masked amines, or protected amines. Such tertiary amines, masked amines, or protected amines may be converted to primary amine or secondary amine moieties. Additionally, the amine moiety may include an amine-like moiety which has similar chemical characteristics as amine moieties, including but not limited to chemical reactivity.

Aromatic

As used herein, the term "aromatic" refers to a carbocycle or heterocycle with one or more polyunsaturated rings and having aromatic character, i.e. having (4n+2) delocalized p (pi) electrons, where n is an integer.

Aryl

As used herein, the term "aryl," employed alone or in combination with other terms, means, unless otherwise stated, a carbocyclic aromatic system containing one or more rings (typically one, two or three rings) wherein such rings may be attached together in a pendent manner, such as a biphenyl, or may be fused, such as naphthalene. Examples include phenyl, anthracyl, and naphthyl. Preferred are phenyl and naphthyl, most preferred is phenyl.

Cycloalkylene

"Cycloalkylene" is a divalent cycloalkyl group. Unless otherwise stated specifically in the specification, a cycloalkylene group may be optionally substituted.

Cycloalkyl

"Cycloalkyl" or "carbocyclic ring" refers to a stable non aromatic monocyclic or polycyclic hydrocarbon radical consisting solely of carbon and hydrogen atoms, which may include fused or bridged ring systems, having from three to fifteen carbon atoms, preferably having from three to ten carbon atoms, and which is saturated or unsaturated and attached to the rest of the molecule by a single bond. Monocyclic radicals include, for example, cyclopropyl, cyclobutyl, cyclopentyl, cyclohexyl, cycloheptyl, and cyclooctyl. Polycyclic radicals include, for example, adamantyl, norbornyl, decalinyl, 7,7 dimethyl bicyclo[2.2.1] heptanyl, and the like. Unless specifically stated otherwise, a cycloalkyl group is optionally substituted.

Halo

As used herein, the term "halo" or "halogen" alone or as part of another substituent means, unless otherwise stated, a fluorine, chlorine, bromine, or iodine atom, preferably, fluorine, chlorine, or bromine, more preferably, fluorine or chlorine.

Heteroalkyl

As used herein, the term "heteroalkyl" by itself or in combination with another term means, unless otherwise stated, a stable straight or branched chain alkyl group consisting of the stated number of carbon atoms and one or two or more heteroatoms typically selected from the group consisting of O, N, Si, P, and S, and wherein the nitrogen and sulfur atoms may be optionally oxidized and the nitrogen heteroatom may be a primary, secondary, tertiary or quaternary nitrogen. The heteroatom(s) may be placed at any position of the heteroalkyl group, including between the rest of the heteroalkyl group and the fragment to which it is attached, as well as attached to the most distal carbon atom in the heteroalkyl group. Examples of heteroalkyl groups include: —O—CH2-CH2-CH3, —CH2-CH2-CH2-OH, —CH2-CH2-NH—CH3, —CH2-S—CH2-CH3, and —CH2CH2-S(=O)—CH3. Up to two heteroatoms may be consecutive, such as, for example, —CH2-NH—OCH3, or —CH2-CH2-S—S—CH3.

Heteroaryl

As used herein, the term "heteroaryl" or "heteroaromatic" refers to aryl groups which contain at least one heteroatom typically selected from N, O, Si, P, and S; wherein the nitrogen and sulfur atoms may be optionally oxidized, and the nitrogen atom(s) may be optionally tertiary or quaternized. Heteroaryl groups may be substituted or unsubstituted. A heteroaryl group may be attached to the remainder of the molecule through a heteroatom. A polycyclic heteroaryl may include one or more rings that are partially saturated. Examples include tetrahydroquinoline, 2,3-dihydrobenzofuryl, 1-pyrrolyl, 2-pyrrolyl, 3-pyrrolyl, 3-pyrazolyl, 2-imidazolyl, 4-imidazolyl, pyrazinyl, 2-oxazolyl, 4-oxazolyl, 2-phenyl-4-oxazolyl, 5-oxazolyl, 3-isoxazolyl, 4-isoxazolyl, 5-isoxazolyl, 2-thiazolyl, 4-thiazolyl, 5-thiazolyl, 2-furyl, 3-furyl, 2-thienyl, 3-thienyl, 2-pyridyl, 3-pyridyl, 4-pyridyl, 2-pyrimidyl, 4-pyrimidyl, 5-benzothiazolyl, purinyl, 2-benzimidazolyl, 5-indolyl, 1-isoquinolyl, 5-isoquinolyl, 2-quinoxalinyl, 5-quinoxalinyl, 3-quinolyl, and 6-quinolyl. Examples of non-aromatic heterocycles include monocyclic groups such as aziridine, oxirane, thiirane, azetidine, oxetane, thietane, pyrrolidine, pyrroline, imidazoline, pyrazolidine, dioxolane, sulfolane, 2,3-dihydrofuran, 2,5-dihydrofuran, tetrahydrofuran, thiophane, piperidine, 1,2,3,6-tetrahydropyridine, 1,4-dihydropyridine, piperazine, morpholine, thiomorpholine, pyran, 2,3-dihydropyran, tetrahydropyran, 1,4-dioxane, 1,3-dioxane, homopiperazine, homopiperidine, 1,3-dioxepane, 4,7-dihydro-1,3-dioxepin and hexamethyleneoxide. Examples of heteroaryl groups include pyridyl, pyrazinyl, pyrimidinyl (particularly 2- and 4-pyrimidinyl), pyridazinyl, thienyl, furyl, pyrrolyl (particularly 2-pyrrolyl), imidazolyl, thiazolyl, oxazolyl, pyrazolyl (particularly 3- and 5-pyrazolyl), isothiazolyl, 1,2,3-triazolyl, 1,2,4-triazolyl, 1,3,4-triazolyl, tetrazolyl, 1,2,3-thiadiazolyl, 1,2,3-oxadiazolyl, 1,3,4-thiadiazolyl and 1,3,4-oxadiazolyl. Examples of polycyclic heterocycles include indolyl (particularly 3-, 4-, 5-, 6- and 7-indolyl), indolinyl, quinolyl, tetrahydroquinolyl, isoquinolyl (particularly 1- and 5-isoquinolyl), 1,2,3,4-tetrahydroisoquinolyl, cinnolinyl, quinoxalinyl (particularly 2- and 5-quinoxalinyl), quinazolinyl, phthalazinyl, 1,8-naphthyridinyl, 1,4-benzodioxanyl, coumarin, dihydrocoumarin, 1,5-naphthyridinyl, benzofuryl (particularly 3-, 4-, 5-, 6- and 7-benzofuryl), 2,3-dihydrobenzofuryl, 1,2-benzisoxazolyl, benzothienyl (particularly 3-, 4-, 5-, 6-, and 7-benzothienyl), benzoxazolyl, benzothiazolyl (particularly 2-benzothiazolyl and 5-benzothiazolyl), purinyl, benzimidazolyl (particularly 2-benzimidazolyl), benztriazolyl, thioxanthinyl, carbazolyl, carbolinyl, acridinyl, pyrrolizidinyl, and quinolizidinyl. The aforementioned listing of heterocyclyl and heteroaryl moieties is intended to be representative and not limiting.

Heterocyclyl

As used herein, the term "heterocyclyl" or "heterocyclic ring" refers to a stable 3- to 18-membered non-aromatic ring radical which consists of two to twelve carbon atoms and from one to six heteroatoms typically selected from the group consisting of N, O, Si, P, and S. Unless stated otherwise specifically in the specification, the heterocyclyl radical may be a monocyclic, bicyclic, tricyclic or tetracyclic ring system, which may include fused or bridged ring systems; and the nitrogen, carbon or sulfur atoms in the heterocyclyl radical may be optionally oxidized; the nitrogen atom may be optionally quaternized; and the heterocyclyl radical may be partially or fully saturated. Examples of such heterocyclyl radicals include, but are not limited to, dioxolanyl, thienyl[1,3]dithianyl, decahydroisoquinolyl, imidazolinyl, imidazolidinyl, isothiazolidinyl, isoxazolidinyl, morpholinyl, octahydroindolyl, octahydroisoindolyl, 2-oxopiperazinyl, 2-oxopiperidinyl, 2-oxopyrrolidinyl, oxazolidinyl, piperidinyl, piperazinyl, 4-piperidonyl, pyrrolidinyl, pyrazolidinyl, quinuclidinyl, thiazolidinyl, tetrahydrofuryl, trithianyl, tetrahydropyranyl, thiomorpholinyl, thiamorpholinyl, 1-oxo-thiomorpholinyl, and 1,1-dioxothiomorpholinyl. Unless specifically stated otherwise, a heterocyclyl group may be optionally substituted.

Substituents

As described herein, compounds of the present disclosure may contain "optionally substituted" moieties. In general, the term "substituted", whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at every position. Combinations of substituents envisioned by this disclosure are preferably those that result in the formation of stable or chemically feasible compounds. The term "stable", as used herein, refers to compounds that are not substantially altered when subjected to conditions to allow for their production, detection, and, in certain embodiments, their recovery, purification, and use for one or more of the purposes disclosed herein.

Suitable monovalent substituents on a substitutable carbon atom of an "optionally substituted" group are independently halogen; (CH2)0-4R°; (CH2)0-4OR°; O(CH2)0-4R°, —O—(CH2)0-4C(O)OR°; (CH2)0-4CH(OR°)2; (CH2)0-4SR°; (CH2)0-4Ph, which may be substituted with R°; (CH2)0-4O(CH2)0-1Ph which may be substituted with R°; CH=CHPh, which may be substituted with R°; (CH2)0-4O(CH2)0-1-pyridyl which may be substituted with R°; NO2; CN; N3; (CH2)0-4N(R°)2; (CH2)0-4N(R°)C(O)R°; N(R°)C(S)R°; (CH2)0-4N(R°)C(O)NR°2; N(R°)C(S)NR°2; (CH2)0-4N(R°)C(O)OR°; N(R°)N(R°)C(O)R°; N(R°)N(R°)C(O)NR°2; N(R°)N(R°)C(O)OR°; (CH2)0-4C(O)R°; C(S)R°; (CH2)0-4C(O)OR°; (CH2)0-4C(O)SR°; (CH2)0-4C(O)OSiR°3; (CH2)0-4OC(O)R°; OC(O)(CH2)0-4SR°, SC(S)SR°; (CH2)0-4SC(O)R°; (CH2)0-4C(O)NR°2; C(S)NR°2; —C(S)SR°; SC(S)SR°, (CH2)0-4OC(O)NR°2; C(O)N(OR°)R°; C(O)C(O)R°; C(O)CH2C(O)R°; C(NOR°)R°; (CH2)0-4SSR°; (CH2)0-4S(O)2R°; (CH2)0-4S(O)2OR°; (CH2)0-4OS(O)2R°; S(O)2NR°2; (CH2)0-4S(O)R°; N(R°)S(O)2NR°2; N(R°)S(O)2R°; N(OR°)R°; C(NH)NR°2; P(O)2R°; P(O)R°2; OP(O)R°2; OP(O)(OR°)2; SiR°3; (C1-4 straight or branched alkylene)O N(R°)2; or —(C1-4 straight or branched alkylene)C(O)O—N(R°)2, wherein each R° may be substituted as defined below and is independently hydrogen, C1-6 aliphatic, CH2Ph, O(CH2)0-1Ph, CH2-(5-6 membered heteroaryl ring), or a 5-6-membered saturated, partially unsaturated, or aryl ring having 0-4 heteroatoms independently selected from nitrogen, oxygen, or sulfur, or, notwithstanding the definition above, two independent occurrences of R°, taken together with their intervening atom(s), form a 3-12-membered saturated, partially unsaturated, or aryl mono- or bicyclic ring having 0-4 heteroatoms independently selected from nitrogen, oxygen, or sulfur, which may be substituted as defined below.

Suitable monovalent substituents on R° (or the ring formed by taking two independent occurrences of R° together with their intervening atoms), are independently halogen, (CH2)0-2R●, -(haloR●), (CH2)0-2OH, (CH2)0-2OR●, (CH2)0-2CH(OR●)2; O(haloR●), CN, N3, (CH2)0-2C(O)R●, (CH2)0-2C(O)OH, (CH2)0-2C(O)OR●, —(CH2)0-2SR', (CH2)0-2SH, (CH2)0-2NH2, (CH2)0-2NHR●, (CH2)0-2NR'2, NO2, SiR●3, OSiR●3, C(O)SR●, (C1-4 straight or branched alkylene)C(O)OR●, or SSR● wherein each R● is unsubstituted or where preceded by "halo" is substituted only with one or more halogens, and is independently selected from C1-4 aliphatic, CH2Ph, O(CH2)0-1Ph, or a 5-6-membered saturated, partially unsaturated, or aryl ring having 0-4 heteroatoms independently selected from nitrogen, oxygen, or sulfur. Suitable divalent substituents on a saturated carbon atom of R° include =O and =S.

Suitable divalent substituents on a saturated carbon atom of an "optionally substituted" group include the following: =O, =S, =NNR*2, NNHC(O)R*, =NNHC(O)OR*, =NNHS(O)2R*, =NR*, =NOR*, O(C(R*2))2-3O—, or —S(C(R*2))2-3S—, wherein each independent occurrence of R* is selected from hydrogen, C1-6 aliphatic which may be substituted as defined below, or an unsubstituted 5-6-membered saturated, partially unsaturated, or aryl ring having 0-4 heteroatoms independently selected from nitrogen, oxygen, or sulfur. Suitable divalent substituents that are bound to vicinal substitutable carbons of an "optionally substituted" group include: O(CR*2)2-3O—, wherein each independent occurrence of R* is selected from hydrogen, C1-6 aliphatic which may be substituted as defined below, or an unsubstituted 5-6-membered saturated, partially unsaturated, or aryl ring having 0-4 heteroatoms independently selected from nitrogen, oxygen, or sulfur.

Suitable substituents on the aliphatic group of R* include halogen, R●, -(haloR●), OH, OR●, O(haloR●), CN, C(O)OH, C(O)OR●, NH2, —NHR●, —NR●2, or —NO2, wherein each R● is unsubstituted or where preceded by "halo" is substituted only with one or more halogens, and is independently C1-4 aliphatic, CH2Ph, O(CH2)0-1Ph, or a 5-6-membered saturated, partially unsaturated, or aryl ring having 0-4 heteroatoms independently selected from nitrogen, oxygen, or sulfur.

Suitable substituents on a substitutable nitrogen of an "optionally substituted" group include —R†, NR†2, C(O)R†, C(O)OR†, C(O)C(O)R†, C(O)CH2C(O)R†, S(O)2R†, S(O)2NR†2, C(S)NR†2, C(NH)NR†2, or —N(R†)S(O)2R†; wherein each R† is independently hydrogen, C1-6 aliphatic which may be substituted as defined below, unsubstituted OPh, or an unsubstituted 5-6-membered saturated, partially unsaturated, or aryl ring having 0-4 heteroatoms independently selected from nitrogen, oxygen, or sulfur, or, notwithstanding the definition above, two independent occurrences of R†, taken together with their intervening atom(s) form an unsubstituted 3-12-membered saturated, partially unsaturated, or aryl mono- or bicyclic ring having 0-4 heteroatoms independently selected from nitrogen, oxygen, or sulfur.

Suitable substituents on the aliphatic group of RT are independently halogen, R●, -(haloR●), OH, OR●, O(haloR●), CN, C(O)OH, C(O)OR●, NH2, NHR●, NR●2, or NO2, wherein each R● is unsubstituted or where preceded by "halo" is substituted only with one or more halogens, and is independently C1-4 aliphatic, CH2Ph, O(CH2)0-1Ph, or a 5-6-membered saturated, partially unsaturated, or aryl ring having 0-4 heteroatoms independently selected from nitrogen, oxygen, or sulfur.

Heteroatoms such as nitrogen may have hydrogen substituents and/or any permissible substituents of organic compounds described herein which satisfy the valences of the heteroatoms. It is understood that "substitution" or "substituted" includes the implicit proviso that such substitution is in accordance with permitted valence of the substituted atom and the substituent, and that the substitution results in a stable compound, i.e., a compound that does not spontaneously undergo transformation, for example, by rearrangement, cyclization, or elimination.

In a broad aspect, the permissible substituents include acyclic and cyclic, branched and unbranched, carbocyclic and heterocyclic, aromatic and nonaromatic substituents of organic compounds. Illustrative substituents include, for example, those described herein. The permissible substituents can be one or more and the same or different for appropriate organic compounds. The heteroatoms such as nitrogen may have hydrogen substituents and/or any permissible substituents of organic compounds described herein which satisfy the valencies of the heteroatoms.

In various embodiments, the substituent is selected from alkoxy, aryloxy, alkyl, alkenyl, alkynyl, amide, amino, aryl, arylalkyl, carbamate, carboxy, cyano, cycloalkyl, ester, ether, formyl, halogen, haloalkyl, heteroaryl, heterocyclyl, hydroxyl, ketone, nitro, phosphate, sulfide, sulfinyl, sulfonyl, sulfonic acid, sulfonamide, and thioketone, each of which optionally is substituted with one or more suitable substituents. In some embodiments, the substituent is selected from alkoxy, aryloxy, alkyl, alkenyl, alkynyl, amide, amino, aryl, arylalkyl, carbamate, carboxy, cycloalkyl, ester, ether, formyl, haloalkyl, heteroaryl, heterocyclyl, ketone, phosphate, sulfide, sulfinyl, sulfonyl, sulfonic acid, sulfonamide, and thioketone, wherein each of the alkoxy, aryloxy, alkyl, alkenyl, alkynyl, amide, amino, aryl, arylalkyl, carbamate, carboxy, cycloalkyl, ester, ether, formyl, haloalkyl, heteroaryl, heterocyclyl, ketone, phosphate, sulfide, sulfinyl, sulfonyl, sulfonic acid, sulfonamide, and thioketone can be further substituted with one or more suitable substituents.

Examples of substituents include, but are not limited to, halogen, azide, alkyl, aralkyl, alkenyl, alkynyl, cycloalkyl, hydroxyl, alkoxyl, amino, nitro, sulfhydryl, imino, amido, phosphonate, phosphinate, carbonyl, carboxyl, silyl, ether, alkylthio, sulfonyl, sulfonamido, ketone, aldehyde, thioketone, ester, heterocyclyl, —CN, aryl, aryloxy, perhaloalkoxy, aralkoxy, heteroaryl, heteroaryloxy, heteroarylalkyl, heteroaralkoxy, azido, alkylthio, oxo, acylalkyl, carboxy esters, carboxamido, acyloxy, aminoalkyl, alkylaminoaryl, alkylaryl, alkylaminoalkyl, alkoxyaryl, arylamino, aralkylamino, alkylsulfonyl, carboxamidoalkylaryl, carboxamidoaryl, hydroxyalkyl, haloalkyl, alkylaminoalkylcarboxy, aminocarboxamidoalkyl, cyano, alkoxyalkyl, perhaloalkyl, arylalkyloxyalkyl, and the like. In some embodiments, the substituent is selected from cyano, halogen, hydroxyl, and nitro.

Throughout the disclosure, chemical substituents described in Markush structures are represented by variables. Where a variable is given multiple definitions as applied to different Markush formulas in different sections of the disclosure, it is to be understood that each definition should only apply to the applicable formula in the appropriate section of the disclosure.

Abbreviations

As used herein, the following abbreviations and initialisms have the indicated meanings:

| | |
|---|---|
| MC3 | 4-(dimethylamino)-butanoic acid, (10Z,13Z)-1-(9Z,12Z)-9,12-octadecadien-1-yl-10,13-nonadecadien-1-yl ester |
| DSPC | 1,2-distearoyl-sn-glycero-3-phosphocholine |
| DMG | 1,2-Dimyristoyl-rac-glycero-3-methanol |
| DOMG-PEG | R-3-[(ω-methoxy-poly(ethyleneglycol))carbamoyl)]-1,2-dimyristyloxypropyl-3-amine |
| DLPE | 1,2-Dilauroyl-sn-Glycero-3-Phosphoethanolamine |
| DMPE | 1,2-Dimyristoyl-sn-Glycero-3-Phosphoethanolamine |
| DPPC | 1,2-dipalmitoyl-sn-glycero-3-phosphocholine |
| DSPE | 1,2-distearoyl-sn-glycero-3-phosphoethanolamine |
| DDAB | Didodecyldimethylammonium bromide |
| EPC | 1,2-dioleoyl-sn-glycero-3-ethylphosphocholine |
| 14PA | 1,2-dimyristoyl-sn-glycero-3-phosphate |
| 18BMP | bis(monooleoylglycero)phosphate |
| DODAP | 1,2-dioleoyl-3-dimethylammonium-propane |
| DOTAP | 1,2-dioleoyl-3-trimethylammonium-propane |
| C12-200 | 1,1'-((2-(4-(2-((2-(bis(2-hydroxydodecyl)amino)ethyl)(2-hydroxydodecyl)amino)ethyl)piperazin-1-yl)ethyl)azanediyl)bis(dodecan-2-ol) |

The details of one or more embodiments of the disclosure are set forth in the accompanying description below. Although any materials and methods similar or equivalent to those described herein can be used in the practice or testing of the present disclosure, the preferred materials and methods are now described. Other features, objects and advantages of the disclosure will be apparent from the description. In the description, the singular forms also include the plural unless the context clearly dictates otherwise. Unless defined otherwise, all technical and scientific terms used herein have the same meaning as commonly understood by one of ordinary skill in the art to which this disclosure belongs. In the case of conflict, the present description will control.

C. Cas12a (or Cas Type V) Sequences

The present disclosure provides Cas12a (or Cas Type V) polypeptides and nucleic acid molecules encoding same for use in the Cas12a-based gene editing systems described herein for use in various applications, including precision gene editing in cells, tissues, organs, or organisms. In various embodiments, the Cas12a-based gene editing systems comprise (a) a Cas12a (or Cas Type V) polypeptide (or a nucleic acid molecule encoding a Cas12a (or Cas Type V) polypeptide) and (b) a Cas12a (or Cas Type V) guide RNA which is capable of associating with a Cas12a (or Cas Type V) polypeptide to form a complex such that the complex localizes to a target nucleic acid sequence (e.g., a genomic or plasmid target sequence) and binds thereto. In various embodiments, the Cas12a (or Cas Type V) polypeptide has a nuclease activity which results in the cutting of both strands of DNA.

As outlined in B. Paul, Biomedical Journal, Vol. 43, No. 1, February 2020 pages 8-17, the CRISPR-Cas systems are classified into two classes (Classes 1 and 2) that are subdivided into six types (types I through VI). Class 1 (types I, III and IV) systems use multiple Cas proteins in their CRISPR ribonucleoprotein effector nucleases and Class 2 systems (types II, V and VI) use a single Cas protein. Class 1 CRISPR-Cas systems are most commonly found in bacteria and archaea, and comprise ~90% of all identified CRISPR-Cas loci. The Class 2 CRISPR-Cas systems, comprising the remaining ~10%, exists almost exclusively in bacteria, and assemble a ribonucleoprotein complex, consisting of a CRISPR RNA (crRNA) and a Cas protein. The crRNA contains information to target a specific DNA sequence. These multidomain effector proteins achieve interference by complementarity between the crRNA and the target sequence after recognition of the PAM (Protospacer Adjacent Motif) sequence, which is adjacent to the target DNA. These ribonucleoprotein complexes have been redesigned for precise genome editing by providing a crRNA with a redesigned guide sequence, which is complementary to the sequence of the targeted DNA. The most widely characterized CRISPR-Cas system is the type II subtype II-A that is found in Streptococcus pyogenes (Sp), which uses the protein SpCas9, Cas9 was the first Cas-protein engineered for use in gene editing. Class 2 type V is further classified into 4 subtypes (V-A, V-B, V-C, V-U). At present, V-C and V-U remain widely uncharacterised and no structural information on these systems is available. V-A encodes the protein Cas12a (also known as Cpf1) and recently several high resolution structures of Cas12a have provided an insight into its working mechanism.

Type II (e.g., Cas9) and type V (e.g., Cas12a) CRISPR-Cas systems possess a characteristic Ruv-C like nuclease domain, which has been shown to be related to IS605 family transposon encoded TnpB proteins. Crystallographic and cryo-EM data reveal that Cas12a adopts a bilobed structure formed by the REC and Nuc lobes. The REC lobe is comprised of REC1 and REC2 domains, and the Nuc lobe is comprised of the RuvC, the PAM-interacting (PI) and the WED domains, and additionally, the bridge helix (BH). The RuvC endonuclease domain of this effector protein is made up of three discontinuous parts (RuvC I-III). The RNase site for processing its own crRNA is situated in the WED-III subdomain, and the DNase site is located in the interface between the RuvC and the Nuc domains. These structural studies have also shown that the only the 5' repeat region of the crRNA is involved in the assembly of the binary complex. The 19/20 nt repeat region forms a pseudoknot structure through intramolecular base pairing. The crRNA is stabilized through interactions with the WED, RuvC and REC2 domains of the endonuclease, as well as two hydrated Mg2+ ions. This binary interference complex is then responsible for recognizing and degrading foreign DNA.

PAM recognition is a critical initial step in identifying a prospective DNA molecule for degradation since the PAM allows the CRISPR-Cas systems to distinguish their own genomic DNA from invading nucleic acids. Cas12a employs a multistep quality control mechanism to ensure the accurate and precise recognition of target spacer sequences. The WED II-III, REC1 and PAM-interacting domains are responsible for PAM recognition and for initiating the hybridization of the DNA target with the crRNA. After recognition of the dsDNA by WED and REC1 domains, the conserved loop-lysine helix-loop (LKL) region in the PI domain, containing three conserved lysines (K667, K671, K677 in FnCas12a), inserts the helix into the PAM duplex with assistance from two conserved prolines in the LKL region. Structural studies show the helix is inserted at an angle of 45° with respect to the dsDNA longitudinal axis, promoting the unwinding of the helical dsDNA. The critical positioning of the three conserved lysines on the dsDNA initiates the uncoupling of the Watson-Crick interaction between the base pairs of the dsDNA after the PAM. The target dsDNA unzipping allows the hybridization of the crRNA with the strand containing the PAM, the 'target strand (TS), while the uncoupled DNA strand, non-target strand (NTS), is conducted towards the DNase site by the PAM-interacting domain. Cas12a has been shown to efficiently target spacer sequences following 5'T-rich PAM sequence. The PAM for LbCas12a and AsCas12a has a sequence of 5'-TTTN-3' and for FnCas12a a sequence of 5'-TTN-3' and is situated upstream of the 5'end of the non-target strand. It has also been shown that in addition to the canonical 5'-TTTN-3' PAM, Cas12a also exhibits relaxed PAM recognition for suboptimal C-containing PAM sequences by forming altered interactions with the targeted DNA duplex.

Thus, Cas12a is another class II CRISPR/Cas system RNA-guided nuclease with similarities to Cas9 and may be used analogously. Unlike Cas9, Cas12a does not require a tracrRNA and only depends on a crRNA in its guide RNA, which provides the advantage that shorter guide RNAs can be used with Cas12a for targeting than Cas9. Cas12a is capable of cleaving either DNA or RNA. The PAM sites recognized by Cas12a have the sequences 5'-YTN-3' (where "Y" is a pyrimidine and "N" is any nucleobase) or 5'-TTN-3', in contrast to the G-rich PAM site recognized by Cas9. Cas12a cleavage of DNA produces double-stranded breaks with a sticky-ends having a 4 or 5 nucleotide overhang. For further discussion of Cas12a, see, e.g., Ledford et al. (2015) Nature. 526 (7571):17-17, Zetsche et al. (2015) Cell. 163 (3):759-771, Murovec et al. (2017) Plant Biotechnol. J. 15(8):917-926, Zhang et al. (2017) Front. Plant Sci. 8:177, Fernandes et al. (2016) Postepy Biochem. 62(3):315-326; herein incorporated by reference.

Any Cas12a (or Cas Type V) polypeptide or variant thereof may be used in the present disclosure, including those described in the herein tables and provided in the accompanying sequence listing.

In various embodiments, the Cas12a (or Cas Type V) polypeptide is a polypeptide selected from Table S15A (SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419)), or a polypeptide having at least 70%, 75%, 80%, 85%, 90%, 95%, 99%, or 100% sequence identity with a polypeptide from Table S15A (SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419)).

In various embodiments, the Cas12a (or Cas Type V) polypeptide is encoded by a polynucleotide sequence selected from Table S15B (SEQ ID NO: 365 (No. ID405), SEQ ID NO: 75 (No. ID414), or SEQ ID NO: 565 (No. ID418), SEQ ID NO: 366 (No. ID406), SEQ ID NO: 331 (No. ID411), SEQ ID NO: 30 (No. ID415), or SEQ ID NO: 445 (No. ID419)), or a polynucleotide having at least 70%, 75%, 80%, 85%, 90%, 95%, 99%, or 100% sequence identity with a polypeptide from Table S15B (SEQ ID NO: 365 (No. ID405), SEQ ID NO: 75 (No. ID414), or SEQ ID NO:565 (No. ID418), SEQ ID NO: 366 (No. ID406), SEQ ID NO: 331 (No. ID411), SEQ ID NO: 30 (No. ID415), or SEQ ID NO: 445 (No. ID419)).

Any Cas12a (or Cas Type V) polypeptide may be utilized with the compositions described herein. The Cas12a editing systems contemplated herein are not meant to be limiting in any way. The Cas12a editing systems disclosed herein may comprise a canonical or naturally-occurring Cas12a, or any ortholog Cas12a protein, or any variant Cas12a protein—including any naturally occurring variant, mutant, or otherwise engineered version of Cas12a—that is known or which can be made or evolved through a directed evolutionary or otherwise mutagenic process. In various embodiments, the Cas12a or Cas12a variants can have a nickase activity, i.e., only cleave of strand of the target DNA sequence. In other embodiments, the Cas12a or Cas12a variants have inactive nucleases, i.e., are "dead" Cas12a proteins. Other variant Cas12a proteins that may be used are those having a smaller molecular weight than the canonical Cas12a (e.g., for easier delivery) or having modified amino acid sequences or substitutions.

In various aspects, the present invention provides one or more modifications of Cas12a (or Cas Type V) polypeptides, including, for example, mutations to increase sufficiency and/or efficiency and modification of the Cas12a. In some embodiments, one or more domains of the Cas12a are modified, e.g., RuvC, REC, WED, BH, PI and NUC domains. In certain preferred embodiments, the modifications provide editing efficiency of greater than 10%, 20%, 30%, 40%, 50%, 60%, 70%, 80%, 90%, 95%, 99% relative to SpCas9. Even more preferably, the methods and compositions provide enhanced transduction efficiency and/or low cytotoxicity.

The Cas12a (or Cas Type V) gene editing systems and therapeutics described herein may comprise one or more nucleic acid components (e.g., a guide RNA or a coding RNA that encodes a component of the Cas12a system) which may be codon optimized.

For example, a nucleotide sequence (e.g., as part of an RNA payload) encoding a nucleobase editing system of the disclosure is codon optimized. Codon optimization methods are known in the art. For example, a protein encoding sequence of any one or more of the sequences provided herein may be codon optimized. Codon optimization, in some embodiments, may be used to match codon frequencies in target and host organisms to ensure proper folding; bias GC content to increase mRNA stability or reduce secondary structures; minimize tandem repeat codons or base runs that may impair gene construction or expression; customize transcriptional and translational control regions; insert or remove protein trafficking sequences; remove/add post translation modification sites in encoded protein (e.g., glycosylation sites); add, remove or shuffle protein domains; insert or delete restriction sites; modify ribosome binding sites and mRNA degradation sites; adjust translational rates to allow the various domains of the protein to fold properly; or reduce or eliminate problem secondary structures within the polynucleotide. Codon optimization tools, algorithms and services are known in the art-non-limiting examples include services from GeneArt (Life Technologies), DNA2.0 (Menlo Park Calif) and/or proprietary methods. In some embodiments, the protein encoding sequence is optimized using optimization algorithms. In some embodiments, a codon optimized sequence shares less than 95% sequence identity to a naturally-occurring or wild-type sequence (e.g., a naturally-occurring or wild-type mRNA sequence encoding a nucleobase editing enzyme). In some embodiments, a codon optimized sequence shares less than 90% sequence identity to a naturally-occurring or wild-type sequence (e.g., a naturally-occurring or wild-type mRNA sequence encoding a nucleobase editing enzyme). In some embodiments, a codon optimized sequence shares less than 85% sequence identity to a naturally-occurring or wild-type sequence (e.g., a naturally-occurring or wild-type mRNA sequence encoding a nucleobase editing enzyme). In some embodiments, a codon optimized sequence shares less than 80% sequence identity to a naturally-occurring or wild-type sequence (e.g., a naturally-occurring or wild-type mRNA sequence encoding a nucleobase editing enzyme). In some embodiments, a codon optimized sequence shares less than 75% sequence identity to a naturally-occurring or wild-type sequence (e.g., a naturally-occurring or wild-type mRNA sequence encoding a nucleobase editing enzyme).

In some embodiments, a codon optimized sequence shares between 65% and 85% (e.g., between about 67% and about 85% or between about 67% and about 80%) sequence identity to a naturally-occurring or wild-type sequence (e.g., a naturally-occurring or wild-type mRNA sequence encoding a nucleobase editing enzyme). In some embodiments, a codon optimized sequence shares between 65% and 75% or about 80% sequence identity to a naturally-occurring or wild-type sequence (e.g., a naturally-occurring or wild-type mRNA sequence encoding a nucleobase editing enzyme). When transfected into mammalian cells, the modified mRNA payloads have a stability of between 12-18 hours, or greater than 18 hours, e.g., 24, 36, 48, 60, 72, or greater than 72 hours.

In some embodiments, a codon optimized RNA may be one in which the levels of G/C are enhanced. The G/C-content of nucleic acid molecules (e.g., mRNA) may influence the stability of the RNA. RNA having an increased amount of guanine (G) and/or cytosine (C) residues may be functionally more stable than RNA containing a large amount of adenine (A) and thymine (T) or uracil (U) nucleotides. As an example, WO02/098443 discloses a pharmaceutical composition containing an mRNA stabilized by sequence modifications in the translated region. Due to the degeneracy of the genetic code, the modifications work by substituting existing codons for those that promote greater RNA stability without changing the resulting amino acid. The approach is limited to coding regions of the RNA.

In some embodiments, the disclosure provides engineered Cas12a variants or mutants which have been modified by introducing one or more amino acid substitutions into a baseline sequence (e.g., a wildtype sequence).

Any available methods may be utilized to obtain or construct a variant or mutant Cas12a protein. The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art (e.g., site-directed mutagenesis or directed evolution engineering), and are provided by, for example, Green and Sambrook, Molecular Cloning: A Laboratory Manual (4th ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is the normal result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. Mutations also embrace "gain-of-function" mutations, which confer an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Because of their nature, gain-of-function mutations are usually dominant.

Mutations can be introduced into a reference Cas12a protein using site-directed mutagenesis. Older methods of site-directed mutagenesis known in the art rely on sub-cloning of the sequence to be mutated into a vector, such as an M13 bacteriophage vector, that allows the isolation of single-stranded DNA template. In these methods, one anneals a mutagenic primer (i.e., a primer capable of annealing to the site to be mutated but bearing one or more mismatched nucleotides at the site to be mutated) to the single-stranded template and then polymerizes the complement of the template starting from the 3' end of the mutagenic primer. The resulting duplexes are then transformed into host bacteria and plaques are screened for the desired mutation. More recently, site-directed mutagenesis has employed PCR methodologies, which have the advantage of not requiring a single-stranded template. In addition, methods have been developed that do not require sub-cloning. Several issues must be considered when PCR-based site-directed mutagenesis is performed. First, in these methods it is desirable to reduce the number of PCR cycles to prevent expansion of undesired mutations introduced by the polymerase. Second, a selection must be employed in order to reduce the number of non-mutated parental molecules persisting in the reaction. Third, an extended-length PCR method is preferred in order to allow the use of a single PCR primer set. And fourth, because of the non-template-dependent terminal extension activity of some thermostable polymerases it is often necessary to incorporate an end-polishing step into the procedure prior to blunt-end ligation of the PCR-generated mutant product.

Mutations may also be introduced by directed evolution processes, such as phage-assisted continuous evolution (PACE) or phage-assisted noncontinuous evolution (PANCE). The term "phage-assisted continuous evolution (PACE)," as used herein, refers to continuous evolution that employs phage as viral vectors. The general concept of PACE technology has been described, for example, in International PCT Application, PCT/US2009/056194, filed Sep. 8, 2009, published as WO 2010/028347 on Mar. 11, 2010;

International PCT Application, PCT/US2011/066747, filed Dec. 22, 2011, published as WO 2012/088381 on Jun. 28, 2012; U.S. Pat. No. 9,023,594, issued May 5, 2015, International PCT Application, PCT/US2015/012022, filed Jan. 20, 2015, published as WO 2015/134121 on Sep. 11, 2015, and International PCT Application, PCT/US2016/027795, filed Apr. 15, 2016, published as WO 2016/168631 on Oct. 20, 2016, the entire contents of each of which are incorporated herein by reference. Variant Cas12as may also be obtain by phage-assisted non-continuous evolution (PANCE)," which as used herein, refers to non-continuous evolution that employs phage as viral vectors. PANCE is a simplified technique for rapid in vivo directed evolution using serial flask transfers of evolving 'selection phage' (SP), which contain a gene of interest to be evolved, across fresh *E. coli* host cells, thereby allowing genes inside the host *E. coli* to be held constant while genes contained in the SP continuously evolve. Serial flask transfers have long served as a widely-accessible approach for laboratory evolution of microbes, and, more recently, analogous approaches have been developed for bacteriophage evolution. The PANCE system features lower stringency than the PACE system.

The disclosure contemplates any engineered Cas12a variants or mutants which have been modified by introducing one or more amino acid substitutions into a baseline sequence, including conservative substitutions of one amino acid for another. For example, mutation of an amino acid with a hydrophobic side chain (e.g., alanine, valine, isoleucine, leucine, methionine, phenylalanine, tyrosine, or tryptophan) may be changed to a second amino acid with a different hydrophobic side chain (e.g., alanine, valine, isoleucine, leucine, methionine, phenylalanine, tyrosine, or tryptophan). For example, a mutation of an alanine to a threonine (e.g., a A262T mutation) may also include a mutation from an alanine to an amino acid that is similar in size and chemical properties to a threonine, for example, serine. As another example, mutation of an amino acid with a positively charged side chain (e.g., arginine, histidine, or lysine) may include a mutation to a second amino acid with a different positively charged side chain (e.g., arginine, histidine, or lysine). As another example, mutation of an amino acid with a polar side chain (e.g., serine, threonine, asparagine, or glutamine) may also include a mutation to a second amino acid with a different polar side chain (e.g., serine, threonine, asparagine, or glutamine). Additional similar amino acid pairs include, but are not limited to, the following: phenylalanine and tyrosine; asparagine and glutamine; methionine and cysteine; aspartic acid and glutamic acid; and arginine and lysine. The skilled artisan would recognize that such conservative amino acid substitutions may only have minor effects on protein structure and may be well tolerated without compromising function. In some embodiments, any amino acid mutations provided herein from one amino acid to a threonine may be an amino acid mutation to a serine. In some embodiments, any amino acid mutations provided herein from one amino acid to an arginine may be an amino acid mutation to a lysine. In some embodiments, any amino acid mutations provided herein from one amino acid to an isoleucine, may be an amino acid mutation to an alanine, valine, methionine, or leucine. In some embodiments, any amino acid mutations provided herein from one amino acid to a lysine may be an amino acid mutation to an arginine. In some embodiments, any amino acid mutations provided herein from one amino acid to an aspartic acid may be an amino acid mutation to a glutamic acid or asparagine. In some embodiments, any amino acid mutations provided herein from one amino acid to a valine may be an amino acid mutation to an alanine, isoleucine, methionine, or leucine. In some embodiments, any amino acid mutations provided herein from one amino acid to a glycine may be an amino acid mutation to an alanine. It should be appreciated, however, that additional conserved amino acid residues would be recognized by the skilled artisan and any of the amino acid mutations to other conserved amino acid residues are also within the scope of this disclosure. The amino acid substitutions may also be non-conservative amino acid substitutions.

In various embodiments, an Alanine (A) residue of a Cas12a protein may be substituted with any one of the following amino acids: Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Arginine (R) residue of a Cas12a protein may be substituted with any one of the following amino acids: Alanine (A); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Asparagine (N) residue of a Cas12a protein may be substituted with any one of the following amino acids: Alanine (A); Arginine (R); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Aspartic Acid (D) residue of a Cas12a protein may be substituted with any one of the following amino acids: Alanine (A); Arginine (R); Asparagine (N); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Cysteine (C) residue of a Cas12a protein may be substituted with any one of the following amino acids: Alanine (A); Arginine (R); Asparagine (N); Aspartic Acid (D); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Glutamic acid (E) residue of a Cas12a protein may be substituted with any one of the following amino acids: Alanine (A); Arginine (R); Asparagine (N); Aspartic Acid (D); Cysteine (C); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Glutamine (N) residue of a Cas12a protein may be substituted with any one of the following amino acids: Alanine (A); Arginine (R); Asparagine (N); Aspartic Acid (D); Cysteine (C); Glutamic acid (E); Glycine (G); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Glycine (G) residue of a Cas12a protein may be substituted with any one of the following amino acids: Alanine (A); Arginine (R); Asparagine (N); Aspartic Acid (D); Cysteine (C); Glutamic acid (E); Glutamine (N); Histidine (H); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Histidine (H) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Isoleucine (I); Leucine (L); Lysine (K); Methionine (M); Phenylalanine (F); Proline (P); Serine (S); Threonine (T); Tryptophan (W); Tyrosine (Y); or Valine (V).

In another embodiment, an Isoleucine (I) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Leucine (L); Lysine (K); Methionine (M); Phenylalanine (F); Proline (P); Serine (S); Threonine (T); Tryptophan (W); Tyrosine (Y); or Valine (V).

In another embodiment, an Leucine (L) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Lysine (K); Methionine (M); Phenylalanine (F); Proline (P); Serine (S); Threonine (T); Tryptophan (W); Tyrosine (Y); or Valine (V).

In another embodiment, an Lysine (K) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Methionine (M); Phenylalanine (F); Proline (P); Serine (S); Threonine (T); Tryptophan (W); Tyrosine (Y); or Valine (V).

In another embodiment, an Methionine (M) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Phenylalanine (F); Proline (P); Serine (S); Threonine (T); Tryptophan (W); Tyrosine (Y); or Valine (V).

In another embodiment, an Phenylalanine (F) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Proline (P); Serine (S); Threonine (T); Tryptophan (W); Tyrosine (Y); or Valine (V).

In another embodiment, an Proline (P) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Serine (S); Threonine (T); Tryptophan (W); Tyrosine (Y); or Valine (V).

In another embodiment, an Serine (S) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Threonine (T); Tryptophan (W); Tyrosine (Y); or Valine (V).

In another embodiment, an Threonine (T) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Tryptophan (W); Tyrosine (Y); or Valine (V).

In another embodiment, an Tryptophan (W) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tyrosine (Y); or Valine (V).

In another embodiment, an Tyrosine (Y) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); Tryptophan (W); or Valine (V).

In another embodiment, an Valine (V) residue of a Cas12a protein may be substituted with any one of the following amino acids: Alanine (A); Arginine (R); Asparagine (N); Aspartic Acid (D); Cysteine (C); Glutamic acid (E); Glutamine (N); Glycine (G); Histidine (H); Isoleucine (I); Leucine (L); Lysine (K); Methionine (M); Phenylalanine (F); Proline (P); Serine (S); Threonine (T); or Tryptophan (W).

In addition, the amino acid substitutions may include that of any non-naturally occurring amino acid analog or amino acid derivative that are known in the art.

While not intending to be limiting, the following are exemplary embodiments of mutant variants contemplated by the instant specification and Examples and which are based on Cas12a ID405 (SEQ ID NO: 334), Cas12a ID414 (SEQ ID NO: 58), and Cas12a ID418 (SEQ ID NO: 564). It will be appreciated that any of the following specific substitutions and/or combinations of specific substitutions may be introduced into the corresponding amino acid residues (as determined by a sequence alignment) of any other Type V nuclease enzyme disclosed herein.

Variants Based on ID405 (SEQ ID NO: 334)

In various embodiments, the Cas12a may be a Cas12a variant based on ID405 (SEQ ID NO: 334), and may including any of the following substitutions and in any combination (or any amino acid sequence having at least 70%, 75%, 80%, 85%, 90%, 95%, 99%, or up to 100% sequence identity with SEQ ID NO: 334 having any of the following substitutions):

a D169 substitution;
a C554 substitution;
a N559 substitution;
a Q565 substitution;
a L860 substitution;
a R950 substitution; and/or
a R954 substitution.

In various embodiments, the Cas12a may be a Cas12a variant based on ID405 (SEQ ID NO: 334), and may including any of the following substitutions and in any combination (or any amino acid sequence having at least 70%, 75%, 80%, 85%, 90%, 95%, 99%, or up to 100% sequence identity with SEQ ID NO: 334 having any of the following substitutions):
 a D169R substitution;
 a C554N substitution;
 a C554R substitution;
 a N559R substitution;
 a Q565R substitution;
 a L860Q substitution;
 a R950K substitution; and/or
 a R954A substitution.

In various embodiments, the Cas12a may be a Cas12a variant based on ID405 (SEQ ID NO: 334), and may including any of the following substitutions and in any combination (or any amino acid sequence having at least 70%, 75%, 80%, 85%, 90%, 95%, 99%, or up to 100% sequence identity with SEQ ID NO: 334 having any of the following substitutions):
 a D169 substitution;
 a D169/R950/R954 substitution set;
 a D169/N559/Q565 substitution set;
 a C554 substitution;
 a C554 substitution; and/or
 a L860 substitution.

In various embodiments, the Cas12a may be a Cas12a variant based on ID405 (SEQ ID NO: 334), and may including any of the following substitutions and in any combination (or any amino acid sequence having at least 70%, 75%, 80%, 85%, 90%, 95%, 99%, or up to 100% sequence identity with SEQ ID NO: 334 having any of the following substitutions):
 a D169R substitution;
 a D169R/R950K/R954A substitution set;
 a D169R/N559R/Q565R substitution set;
 a C554R substitution;
 a C554N substitution; and/or
 a L860Q substitution.

The full amino acid and protein coding sequences of these mutant nucleases are provided in Section K at subsection P (Cas12a Mutant Type V nuclease and associated sequences).
Variants Based on ID414 (SEQ ID NO: 58)

In various embodiments, the Cas12a may be a Cas12a variant based on ID414 (SEQ ID NO: 58), and may including any of the following substitutions and in any combination (or any amino acid sequence having at least 70%, 75%, 80%, 85%, 90%, 95%, 99%, or up to 100% sequence identity with SEQ ID NO: 58 having any of the following substitutions):
 a T154 substitution;
 a N531 substitution;
 a G546 substitution;
 a K542 substitution;
 a S802 substitution;
 a R887 substitution; and/or
 a R891 substitution.

In various embodiments, the Cas12a may be a Cas12a variant based on ID414 (SEQ ID NO: 58), and may including any of the following substitutions and in any combination (or any amino acid sequence having at least 70%, 75%, 80%, 85%, 90%, 95%, 99%, or up to 100% sequence identity with SEQ ID NO: 58 having any of the following substitutions):
 a T154R substitution;
 a N531R substitution;
 a G546R substitution;
 a K542R substitution;
 a S802L substitution;
 a R887K substitution; and/or
 a R891A substitution.

In various embodiments, the Cas12a may be a Cas12a variant based on ID414 (SEQ ID NO: 58), and may including any of the following substitutions and in any combination (or any amino acid sequence having at least 70%, 75%, 80%, 85%, 90%, 95%, 99%, or up to 100% sequence identity with SEQ ID NO: 58 having any of the following substitutions):
 a T154 substitution;
 a T154/R887/R891 substitutions;
 a T154/G536/K542 substitutions;
 a N531/S802 substitutions;
 a N531 substitution; and/or
 a S802 substitution.

In various embodiments, the Cas12a may be a Cas12a variant based on ID414 (SEQ ID NO: 58), and may including any of the following substitutions and in any combination (or any amino acid sequence having at least 70%, 75%, 80%, 85%, 90%, 95%, 99%, or up to 100% sequence identity with SEQ ID NO: 58 having any of the following substitutions):
 a T154R substitution;
 a T154R/R887K/R891A substitutions;
 a T154R/G536R/K542R substitutions;
 a N531R/S802L substitutions;
 a N531R substitution; and/or
 a S802L substitution.

The full amino acid and protein coding sequences of these mutant nucleases are provided in Section K at subsection P (Cas12a Mutant Type V nuclease and associated sequences).
Variants Based on ID418 (SEQ ID NO: 564)

In various embodiments, the Cas12a may be a Cas12a variant based on ID418 (SEQ ID NO: 564), and may including any of the following substitutions and in any combination (or any amino acid sequence having at least 70%, 75%, 80%, 85%, 90%, 95%, 99%, or up to 100% sequence identity with SEQ ID NO: 564 having any of the following substitutions):
 a D161 substitution;
 a N527 substitution;
 a T532 substitution;
 a K538 substitution;
 a Q799 substitution;
 a R888 substitution; and/or
 a R892 substitution.

In various embodiments, the Cas12a may be a Cas12a variant based on ID418 (SEQ ID NO: 564), and may including any of the following substitutions and in any combination (or any amino acid sequence having at least 70%, 75%, 80%, 85%, 90%, 95%, 99%, or up to 100% sequence identity with SEQ ID NO: 564 having any of the following substitutions):
 a D161R substitution;
 a N527R substitution;
 a T532R substitution;
 a K538R substitution;
 a Q799L substitution;
 a R888K substitution; and/or
 a R892A substitution.

In various embodiments, the Cas12a may be a Cas12a variant based on ID418 (SEQ ID NO: 564), and may including any of the following substitutions and in any combination (or any amino acid sequence having at least 70%, 75%, 80%, 85%, 90%, 95%, 99%, or up to 100% sequence identity with SEQ ID NO: 564 having any of the following substitutions):

a D161 substitution;
a D161/R888/R892 substitution;
a D161/T532/K538 substitution;
a N527/Q799 substitution;
a N527 substitution; and/or
a Q799 substitution.

In various embodiments, the Cas12a may be a Cas12a variant based on ID418 (SEQ ID NO: 564), and may including any of the following substitutions and in any combination (or any amino acid sequence having at least 70%, 75%, 80%, 85%, 90%, 95%, 99%, or up to 100% sequence identity with SEQ ID NO: 564 having any of the following substitutions):

a D161R substitution;
a D161R/R888K/R892A substitution;
a D161R/T532R/K538R substitution;
a N527R/Q799L substitution;
a N527R substitution; and/or
a Q799L substitution.

The full amino acid and protein coding sequences of these mutant nucleases are provided in Section K, subsection P (Cas12a Mutant Type V nuclease and associated sequences).

In addition, various embodiments of variant Cas12a orthologs are described in subsection Q of Secion K.

In addition, embodiments of Cas12a mutant variants based on ID405, ID414, and ID418 are described in the computational approach to directed mutagenesis described in Example 14.

Figure 31:
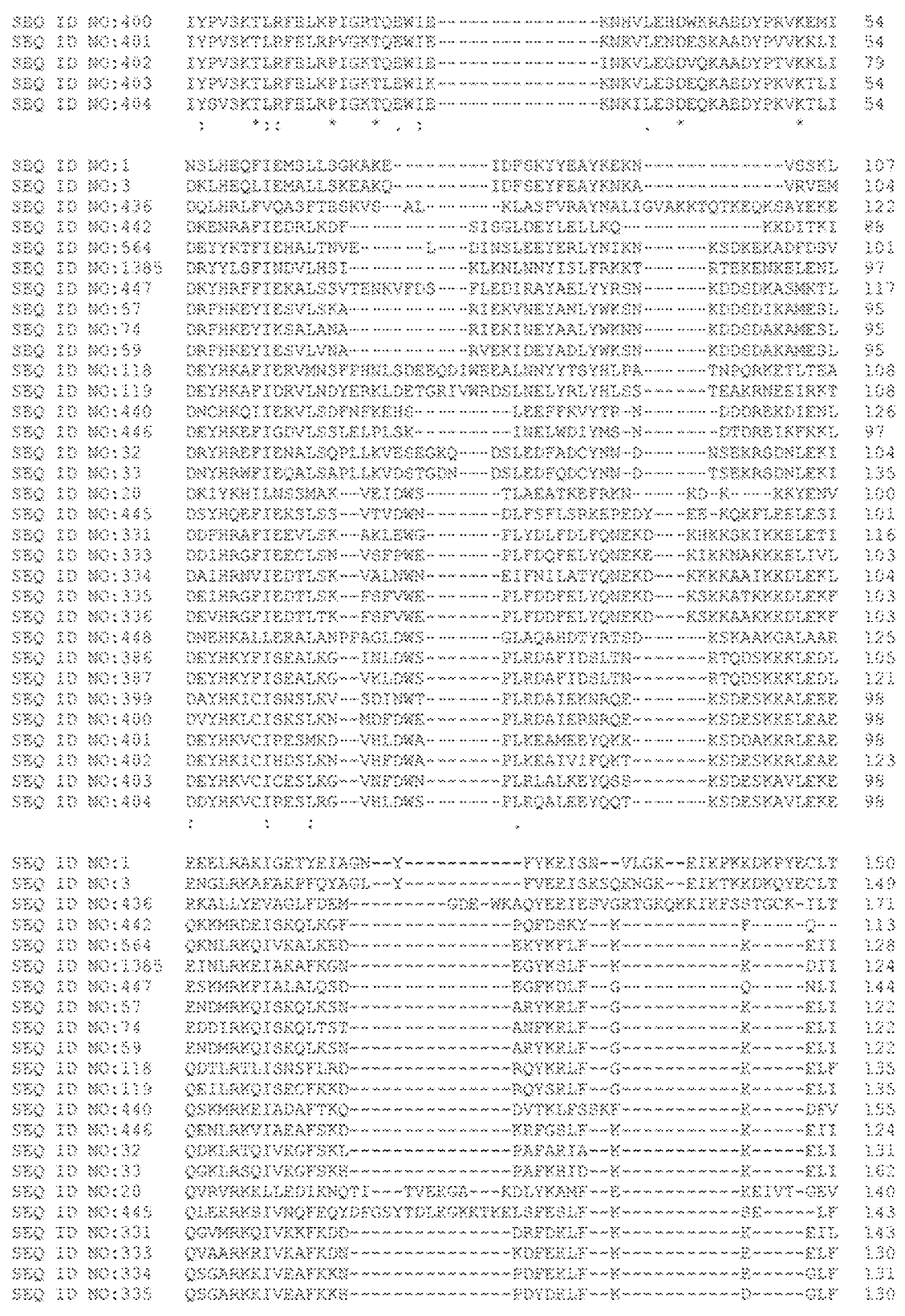
Figure 31:
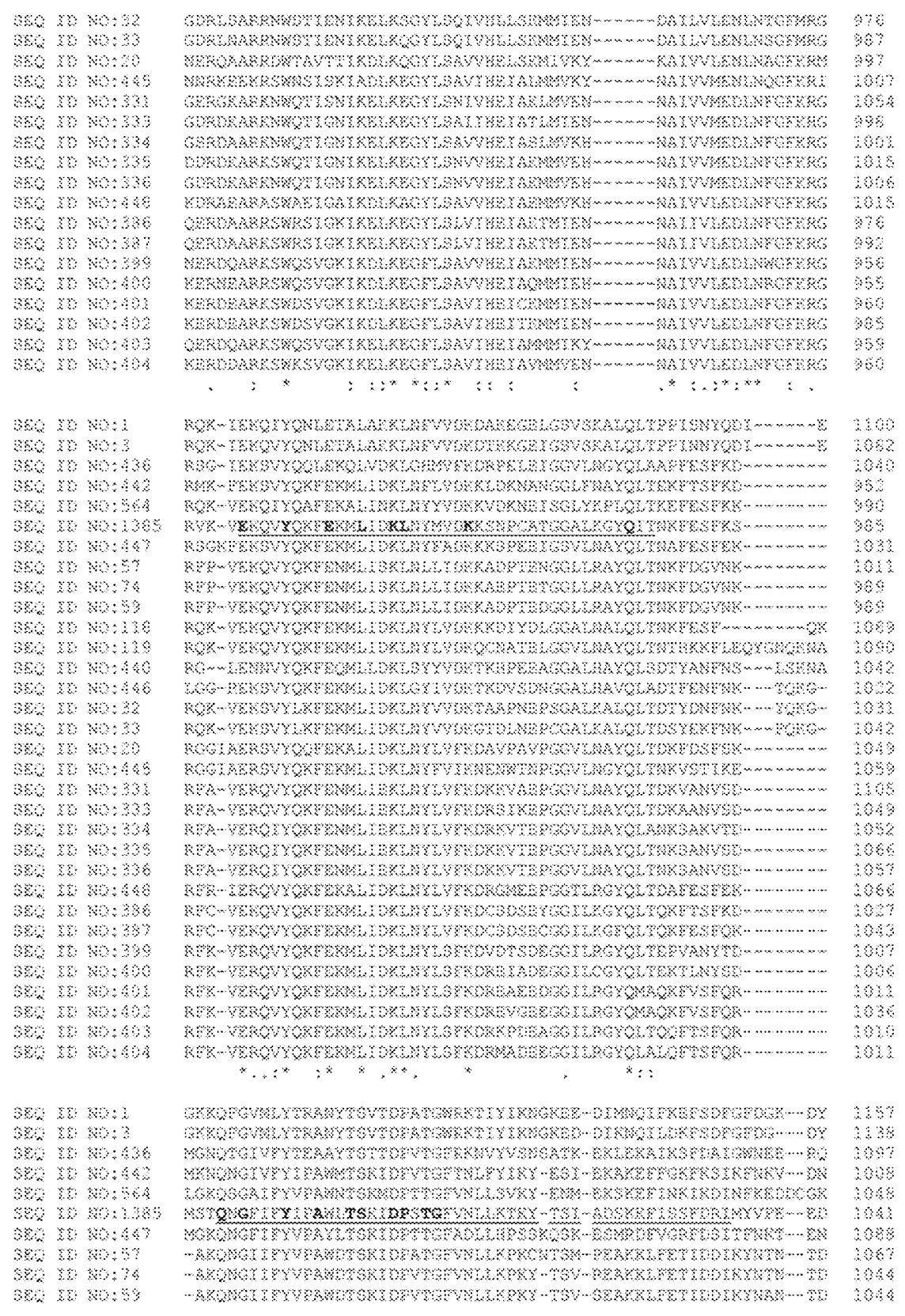

It is noted that when this disclosure speaks to a polypeptide (including anywhere in this specification, including in the Appendix A and the Examples) having a percent identity with respect to another amino acid sequence (a reference amino acid sequence), such as a polypeptide at least 50%, at least 55%, at least 60%, at least 65%, at least 70%, at least 75%, at least 80%, at least 85%, at least 90%, at least 91%, at least 92%, at least 93%, at least 94%, at least 95, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to another amino acid sequence (a reference amino acid sequence), such as one of SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419), it is advantageous that in the polypeptide having a percent identity to the reference amino acid sequence conserved regions of the reference amino acid sequence (e.g., conserved when compared with other Cas12as, such as those identified herein, such as described in the multi-sequences alignment of FIG. 31) be preserved and/or that the polypeptide has at least one activity selected from endonuclease activity; endoribonuclease activity, or RNA-guided DNase activity and/or that the polypeptide of which comprises: a. one or more α-helical recognition lobe (REC) and a nuclease lobe (NUC); b. a Wedge (WED), α-helical recognition lobe (REC), PAM-interacting (PI), RuvC nuclease, Bridge Helix (BH) and NUC domains; or c. one or more domains selected from RuvC, REC, WED, BH, PI and NUC domains and/or that the polypeptide recognizes or binds crRNA(s) or is bound to crRNA(s), such as a crRNA sequence from Table S15C. Likewise, when this disclosure speaks to a nucleic acid sequence or molecule having a percent identity with respect to a nucleic acid sequence having a percent identity with respect to another nucleic acid sequence or molecule (a reference nucleic acid sequence), such as a nucleic acid sequence at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to another nucleic acid sequence (a reference nucleic acid sequence, such as a sequence selected from SEQ ID NO: 365 (No. ID405), SEQ ID NO: 74 (No. ID414), or SEQ ID NO: 565 (No. ID418), SEQ ID NO: 366 (No. ID406), SEQ ID NO: 331 (No. ID411), SEQ ID NO: 30 (No. ID415), or SEQ ID NO: 445 (No. ID419), it is advantageous that in the nucleic acid sequence that has a percent identity to the reference nucleic acid sequence that conserved regions of the reference nucleic acid sequence (e.g., conserved when compared with other Cas12as, such as those identified herein) be preserved and/or that in the polypeptide that is expressed from the nucleic acid sequence that has a percent identity to the reference nucleic acid sequence that the polypeptide contain conserved region(s) (e.g., conserved when compared with other Cas12as, such as those identified herein) and/or that the polypeptide has at least one activity selected from endonuclease activity; endoribonuclease activity, or RNA-guided DNase activity and/or that the polypeptide of which comprises: a. one or more α-helical recognition lobe (REC) and a nuclease lobe (NUC); b. a Wedge (WED), α-helical recognition lobe (REC), PAM-interacting (PI), RuvC nuclease, Bridge Helix (BH) and NUC domains; or c. one or more domains selected from RuvC, REC, WED, BH, PI and NUC domains and/or that the polypeptide recognizes or binds crRNA(s) or is bound to crRNA(s), such as a crRNA sequence from Table S15C.

D. Cas12a (or Cas Type V) Guide RNA Sequences

Cas12a (Cas Type V) Guide Sequences

The present disclosure further provides guide RNAs for use in accordance with the disclosed nucleic acid programmable DNA binding proteins (e.g., Cas12a) for use in methods of editing. The disclosure provides guide RNAs that are designed to recognize target sequences. Such gRNAs may be designed to have guide sequences (or "spacers") having complementarity to a target sequence. Such gRNAs may be designed to have not only a guide sequences having complementarity to a target sequence to be edited, but also to have a backbone sequence that interacts specifically with the nucleic acid programmable DNA binding protein.

In various aspects, provided are one or more guide RNA sequences. In preferred embodiments, the gRNA is cleaved and processed into one or more intermediate crRNAs, which are subsequently processed into one or more mature crRNAs. In some embodiments, the gRNA comprises a precursor CRISPR RNAs (pre-crRNA) encoding one or more crRNAs or one or more intermediate or mature crRNAs, each guide RNA comprising at a minimum a repeat-spacer in the 5' to 3' direction, wherein the repeat comprises a stem-loop structure and the spacer comprises a DNA-targeting segment complementary to a target sequence in the targeted polynucleotide sequence. In certain embodiments, the gRNA is cleaved by a RNase activity of the Cas12a polypeptide into one or more mature crRNAs, each comprising at least one repeat and at least one spacer.

In other embodiments, one or more repeat-spacer directs the Cas12a (or Cas Type V) polypeptides to two or more distinct sites in the targeted polynucleotide sequence. Preferably, the gRNA is cleaved and processed into one or more intermediate crRNAs, which are subsequently processed into one or more mature crRNAs. More preferably, the pre-crRNA or intermediate crRNA are processed into mature crRNA by an Cas12a (or Cas Type V) polypeptide, and the mature crRNA becomes available for directing the Cas12a (or Cas Type V) endonuclease activity. In alternative embodiments, the gRNA is linked to a single or double strand DNA donor template, and the donor template is cleaved from the gRNA by the Cas12a (or Cas Type V) polypeptide. The donor polynucleotide template remains linked to gRNA while the Cas12a (or Cas Type V) polypeptide cleaves gRNA to liberate intermediate or mature crRNAs.

In exemplary embodiments, the Cas12a (or Cas Type V) system comprises one or more guide RNA comprising:

(a) one or more crRNA direct repeat sequences or a reverse complement selected from (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO:122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541;

(b) 20 to 35 nucleotides or up to the length of the crRNA from the 3' end of the crRNA direct repeat sequences or a reverse complement (a) linked to a targeting guide attached to the 3' end of the direct repeat sequence that is of 16-30 nucleotides in length;

(c) (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO: 92-95; (Group 7) SEQ ID NO: 112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563;

(d) a nucleic acid sequence that is a degenerate variant of (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO: 112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563;

(e) a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 90%, at least 95%, at least 98%, at least 99% or at least 99.9% identical to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563; and (f) a nucleic acid sequence that hybridizes under stringent conditions to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563.

In preferred embodiments, the Cas12a (or Cas Type V) proteins target and cleave targeted polynucleotides that is complementary to a cognate guide RNA. In certain embodiments, the guide RNA comprises crRNA, which includes the natural CRISPR array. Such variants are derived from the first direct repeat, a "leader" sequence and involved in signaling or the direct repeat retains genetic diversity that doesn't affect functionality. The direct repeat is degenerate, generally near the 3' end of the repeat array.

In various embodiments, the crRNA comprises about 15-40 nucleotides or direct repeat sequences comprising about 20-30 nucleotides. In exemplary embodiments, the direct repeat is selected from (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO: 122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541. More preferably, the crRNA comprises a guide segment of 16-26 nucleotides or 20-24 nucleotides. Accordingly, in various embodiments, the crRNA of the Cas12a genome editing systems hybridizes to one or more targeted polynucleotide sequence. In certain preferred embodiments, the crRNA is 43-nucleotides. In other embodiments, the crRNA is made up of a 20-nucleotide 5'-handle and a 23-nucleotide leader sequence. In certain embodiments, the leader sequence comprises a seed region and 3' termini, both of which are complementary to the target region in the genome Li, Bin et al. "Engineering CRISPR-Cpf1 crRNAs and mRNAs to maximize genome editing efficiency." *Nature biomedical engineering* vol. 1,5 (2017): 0066. doi: 10.1038/s41551-017-0066.

A single crRNA-guided endonuclease and has the ribonuclease activity to process its pre-crRNA into mature crRNA Zetsche, Bernd et al. "A Survey of Genome Editing Activity for 16 Cas12a Orthologs." *The Keio journal of medicine* vol. 69,3 (2020): 59-65. doi:10.2302/kjm.2019-0009-OA; Fonfara, Ines et al. "The CRISPR-associated DNA-cleaving enzyme Cpf1 also processes precursor CRISPR RNA." *Nature* vol. 532,7600 (2016): 517-21. doi: 10.1038/nature17945, which enables multiplex editing in a single crRNA transcript. Campa, Carlo C et al. "Multiplexed genome engineering by Cas12a and CRISPR arrays encoded on single transcripts." *Nature methods* vol. 16,9 (2019): 887-893. doi:10.1038/s41592-019-0508-6; Zetsche, Bernd et al. "Multiplex gene editing by CRISPR-Cpf1 using a single crRNA array." *Nature biotechnology* vol. 35,1 (2017): 31-34. doi:10.1038/nbt.3737

Preferably, the crRNA-guided endonuclease provides alteration of numerous loci in host cell genomes.

More preferably, the Cas12a (or Cas Type V) comprises multiplexing performed using two methods. One method involves expressing many single gRNAs under different small RNA promoters either in same vector or in different vectors. Another method, multiple single gRNAs are fused with a tRNA recognition sequence, which are expressed as a single transcript under one promoter.

In some embodiments, the guide RNA may be 15-100 nucleotides in length and comprise a sequence of at least 10, at least 15, or at least 20 contiguous nucleotides that is complementary to a target nucleotide sequence. The guide RNA may comprise a spacer sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target nucleotide sequence. In some cases, the guide sequence has a length in a range of from 17-30 nucleotides (nt) (e.g., from 17-25, 17-22, 17-20, 19-30, 19-25, 19-22, 19-20, 20-30, 20-25, or 20-22 nt). In some cases, the guide sequence has a length in a range of from 17-25 nucleotides (nt) (e.g., from 17-22, 17-20, 19-25, 19-22, 19-20, 20-25, or 20-22 nt). In some cases, the guide sequence has a length of 17 or more nt (e.g., 18 or more, 19 or more, 20 or more, 21 or more, or 22 or more nt; 19 nt, 20 nt, 21 nt, 22 nt, 23 nt, 24 nt, 25 nt, etc.). In some cases, the guide sequence has a length of 19 or more nt (e.g., 20 or more, 21 or more, or 22 or more nt; 19 nt, 20 nt, 21 nt, 22 nt, 23 nt, 24 nt, 25 nt, etc.). In some cases, the guide sequence has a length of 17 nt. In some cases, the guide sequence has a length of 18 nt. In some cases, the guide sequence has a length of 19 nt. In some cases, the guide sequence has a length of 20 nt. In some cases, the guide sequence has a length of 21 nt. In some cases, the guide sequence has a length of 22 nt. In some cases, the guide sequence has a length of 23 nt.

In some cases, the spacer sequence has a length of from 15 to 50 nucleotides (e.g., from 15 nucleotides (nt) to 20 nt, from 20 nt to 25 nt, from 25 nt to 30 nt, from 30 nt to 35 nt, from 35 nt to 40 nt, from 40 nt to 45 nt, or from 45 nt to 50 nt).

A subject guide RNA can interact with a target nucleic acid (e.g., double stranded DNA (dsDNA), single stranded DNA (ssDNA), single stranded RNA (ssRNA), or double stranded RNA (dsRNA)) in a sequence-specific manner via hybridization (i.e., base pairing).

The guide RNA can be modified to hybridize to any desired target sequence (e.g., while taking the PAM into account, e.g., when targeting a dsDNA target) within a target nucleic acid (e.g., a eukaryotic target nucleic acid such as genomic DNA). In some cases, the percent complementarity between the spacer sequence of the guide and the target site of the target nucleic acid is 60% or more (e.g., 65% or more, 70% or more, 75% or more, 80% or more, 85% or more, 90% or more, 95% or more, 97% or more, 98% or more, 99% or more, or 100%). In some cases, the percent complementarity between the spacer and the target site of the target nucleic acid is 80% or more (e.g., 85% or more, 90% or more, 95% or more, 97% or more, 98% or more, 99% or more, or 100%). In some cases, the percent complementarity between the spacer and the target site of the target nucleic acid is 90% or more (e.g., 95% or more, 97% or more, 98% or more, 99% or more, or 100%). In some cases, the percent complementarity between the spacer and the target site of the target nucleic acid is 100%.

In some cases, the percent complementarity between the spacer sequence and the target site of the target nucleic acid is 100% over an at least 5-nucleotide contiguous region of the spacer. In some cases, the percent complementarity between the guide sequence and the target site of the target nucleic acid over an at least 6-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 7-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 8-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 9-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 10-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 11-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 12-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 13-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 14-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 15-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 16-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 17-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 18-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 19-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 20-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 21-nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 22-nucleotide contiguous region of the spacer is 60% or more (e.g., 70% or more, 75% or more, 80% or more, 85% or more, 90% or more, 95% or more, 97% or more, 98% or more, 99% or more, or 100%).

In some cases, the percent complementarity between the spacer sequence and the target site of the target nucleic acid is 100% over an at least 5-10 nucleotide contiguous region of the spacer. In some cases, the percent complementarity between the guide sequence and the target site of the target nucleic acid over an at least 6-11 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 7-12 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 8-13 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 9-14 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 10-15 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 11-16 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 12-17 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 13-18 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 14-19 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 15-20 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 16-21 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 17-22 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 18-23 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 19-24 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 20-25 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 21-26 nucleotide contiguous region of the spacer is 60% or more (e.g., 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid over an at least 22-27 nucleotide contiguous region of the spacer is 60% or more (e.g., 70% or more, 75% or more, 80% or more, 85% or more, 90% or more, 95% or more, 97% or more, 98% or more, 99% or more, or 100%).

In various embodiments, the guide RNAs may have a scaffold or core region that complexes with a cognate nucleic acid programmable DNA binding protein (e.g., CRISPR Cas9 or Cas12a). In some cases, a guide scaffold can have two stretches of nucleotides that are complementary to one another and hybridize to form a double stranded RNA duplex (dsRNA duplex). Thus, in some cases, the protein binding segment of a guide RNA includes a dsRNA duplex. In some embodiments, the dsRNA duplex region includes a range of from 5-25 base pairs (bp) (e.g., from 5-22, 5-20, 5-18, 5-15, 5-12, 5-10, 5-8, 8-25, 8-22, 8-18, 8-15, 8-12, 12-25, 12-22, 12-18, 12-15, 13-25, 13-22, 13-18, 13-15, 14-25, 14-22, 14-18, 14-15, 15-25, 15-22, 15-18, 17-25, 17-22, or 17-18 bp, e.g., 5 bp, 6 bp, 7 bp, 8 bp, 9 bp, 10 bp, etc.). In some cases, the dsRNA duplex region includes a range of from 6-15 base pairs (bp) (e.g., from 6-12, 6-10, or 6-8 bp, e.g., 6 bp, 7 bp, 8 bp, 9 bp, 10 bp, etc.). In some cases, the duplex region includes 5 or more bp (e.g., 6 or more, 7 or more, or 8 or more bp). In some cases, the duplex region includes 6 or more bp (e.g., 7 or more, or 8 or more bp). In some cases, not all nucleotides of the duplex region are paired, and therefore the duplex forming region can include a bulge. The term "bulge" herein is used to mean a stretch of nucleotides (which can be one nucleotide) that do not contribute to a double stranded duplex, but which are surround 5' and 3' by nucleotides that do contribute, and as such a bulge is considered part of the duplex region. In some cases, the dsRNA includes 1 or more bulges (e.g., 2 or more, 3 or more, 4 or more bulges). In some cases, the dsRNA duplex includes 2 or more bulges (e.g., 3 or more, 4 or more bulges). In some cases, the dsRNA duplex includes 1-5 bulges (e.g., 1-4, 1-3, 2-5, 2-4, or 2-3 bulges).

Thus, in some cases, the stretches of nucleotides that hybridize to one another to form the dsRNA duplex in a guide scaffold region have 70%-100% complementarity (e.g., 75%-100%, 80%-10%, 85%-100%, 90%-100%, 95%-100% complementarity) with one another. In some cases, the stretches of nucleotides that hybridize to one another to form the dsRNA duplex have 70%-100% complementarity (e.g., 75%-100%, 80%-10%, 85%-100%, 90%-100%, 95%-100% complementarity) with one another. In some cases, the stretches of nucleotides that hybridize to one another to form the dsRNA duplex have 85%-100% complementarity (e.g., 90%-100%, 95%-100% complementarity) with one another. In some cases, the stretches of nucleotides that hybridize to one another to form the dsRNA duplex have 70%-95% complementarity (e.g., 75%-95%, 80%-95%, 85%-95%, 90%-95% complementarity) with one another. In other words, in some cases, the dsRNA duplex includes two stretches of nucleotides that have 70%-100% complementarity (e.g., 75%-100%, 80%-10%, 85%-100%, 90%-100%, 95%-100% complementarity) with one another. In some cases, the dsRNA duplex includes two stretches of nucleotides that have 85%-100% complementarity (e.g., 90%-100%, 95%-100% complementarity) with one another. In some cases, the dsRNA duplex includes two stretches of nucleotides that have 70%-95% complementarity (e.g., 75%-95%, 80%-95%, 85%-95%, 90%-95% complementarity) with one another.

In various embodiments, the scaffold region of a guide RNA can also include one or more (1, 2, 3, 4, 5, etc.) mutations relative to a naturally occurring scaffold region. For example, in some cases a base pair can be maintained while the nucleotides contributing to the base pair from each segment can be different. In some cases, the duplex region of a subject guide RNA includes more paired bases, less paired bases, a smaller bulge, a larger bulge, fewer bulges, more bulges, or any convenient combination thereof, as compared to a naturally occurring duplex region (of a naturally occurring guide RNA).

Examples of various guide RNAs can be found in the art, and in some cases variations similar to those introduced into Cas9 guide RNAs can also be introduced into guide RNAs of the present disclosure (e.g., mutations to the dsRNA duplex region, extension of the 5' or 3' end for added stability for to provide for interaction with another protein, and the like). For example, see Jinek et al., Science. 2012 Aug. 17; 337(6096):816-21; Chylinski et al., RNA Biol. 2013 May; 10(5):726-37; Ma et al., Biomed Res Int. 2013; 2013:270805; Hou et al., Proc Natl Acad Sci USA. 2013 Sep. 24; 110(39):15644-9; Jinek et al., Elife. 2013; 2:e00471; Pattanayak et al., Nat Biotechnol. 2013 September; 31(9):839-43; Qi et al, Cell. 2013 Feb. 28; 152(5): 1173-83; Wang et al., Cell. 2013 May 9; 153(4):910-8; Auer et al., Genome Res. 2013 Oct. 31; Chen et al., Nucleic Acids Res. 2013 Nov. 1; 41(20):e19; Cheng et al., Cell Res. 2013 October; 23(10):1163-71; Cho et al., Genetics. 2013 November; 195(3):1177-80; DiCarlo et al., Nucleic Acids Res. 2013 April; 41(7):4336-43; Dickinson et al., Nat Methods. 2013 October; 10(10):1028-34; Ebina et al., Sci Rep. 2013; 3:2510; Fujii et. al, Nucleic Acids Res. 2013 Nov. 1; 41(20):e187; Hu et al., Cell Res. 2013 November; 23(11): 1322-5; Jiang et al., Nucleic Acids Res. 2013 Nov. 1; 41(20):e188; Larson et al., Nat Protoc. 2013 November; 8(11):2180-96; Mali et. at., Nat Methods. 2013 October; 10(10):957-63; Nakayama et al., Genesis. 2013 December; 51(12):835-43; Ran et al., Nat Protoc. 2013 November; 8(11):2281-308; Ran et al., Cell. 2013 Sep. 12; 154(6):1380-9; Upadhyay et al., G3 (Bethesda). 2013 Dec. 9; 3(12):2233-8; Walsh et al., Proc Natl Acad Sci USA. 2013 Sep. 24; 110(39):15514-5; Xie et al., Mol Plant. 2013 Oct. 9; Yang et al., Cell. 2013 Sep. 12; 154(6):1370-9; Briner et al., Mol Cell. 2014 Oct. 23; 56(2):333-9; and U.S. patents and patent applications: U.S. Pat. Nos. 8,906,616; 8,895,308; 8,889, 418; 8,889,356; 8,871,445; 8,865,406; 8,795,965; 8,771, 945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety.

Guide RNA Modifications

In one embodiment, the guide RNAs contemplated herein comprise non-naturally occurring nucleic acids and/or non-naturally occurring nucleotides and/or nucleotide analogs, and/or chemical modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide RNA component nucleic acid comprises ribonucleotides and non-ribonucleotides. In one such embodiment, a guide RNA component comprises one or more ribonucleotides and one or more deoxyribonucleotides. In an embodiment of the invention, the guide RNA (including pegRNA) component comprises one or more non-naturally occurring nucleotide or nucleotide analog such as a nucleotide with phosphorothioate linkage, a locked nucleic acid (LNA) nucleotides comprising a methylene bridge between the 2' and 4' carbons of the ribose ring, or bridged nucleic acids (BNA).

Other examples of modified nucleotides include 2'-O-methyl analogs, 2'-deoxy analogs, or 2'-fluoro analogs. Further examples of modified bases include, but are not limited to, 2-aminopurine, 5-bromo-uridine, pseudouridine, inosine, 7-methylguanosine. Examples of coRNA chemical modifications include, without limitation, incorporation of 2'-O-methyl (M), 2'-O-methyl 3'phosphorothioate (MS), S-constrained ethyl(cEt), or 2'-O-methyl 3'thioPACE (MSP) at one or more terminal nucleotides. Such chemically modified oRNA components can comprise increased stability and increased activity as compared to unmodified oRNA components, though on-target vs. off-target specificity is not predictable. (See, Hendel, 2015, Nat Biotechnol. 33(9):985-9, doi: 10.1038/nbt.3290, published online 29 Jun. 2015 Ragdarm et al., 0215, PNAS, E7110-E7111; Allerson et al., J. Med. Chem. 2005, 48:901-904; Bramsen et al., Front. Genet., 2012, 3:154; Deng et al., PNAS, 2015, 112: 11870-11875; Sharma et al., Med Chem Comm., 2014, 5: 1454-1471; Hendel et al., Nat. Biotechnol. (2015) 33(9): 985-989; Li et al., Nature Biomedical Engineering, 2017, 1, 0066 D01: 10.1038/s41551-017-0066). In one embodiment, the 5' and/or 3' end of a guide RNA (including pegRNA) component is modified by a variety of functional moieties including fluorescent dyes, polyethylene glycol, cholesterol, proteins, or detection tags. (See Kelly et al., 2016, J. Biotech. 233:74-83). In one embodiment, a guide RNA (including pegRNA) component comprises ribonucleotides in a region that binds to a target sequence and one or more deoxyribonucleotides and/or nucleotide analogs in a region that binds to a nucleic acid programmable DNA binding protein (e.g., Cas9 nickase).

In an embodiment, deoxyribonucleotides and/or nucleotide analogs are incorporated in engineered guide RNA component structures. In one embodiment, 3-5 nucleotides at either the 3' or the 5' end of a guide RNA component is chemically modified. In one embodiment, only minor modifications are introduced in the seed region, such as 2'-F modifications. In one embodiment, 2'-F modification is introduced at the 3' end of a guide RNA component. In one embodiment, three to five nucleotides at the 5' and/or the 3' end of the reRNA component are chemically modified with 2'-O-methyl (M), 2'-O-methyl 3' phosphorothioate (MS), S-constrained ethyl(cEt), or 2'-O-methyl 3' thioPACE (MSP). Such modification can enhance genome editing efficiency (see Hendel et al., Nat. Biotechnol. (2015) 33(9): 985-989). In one embodiment, all of the phosphodiester bonds of a guide RNA (including pegRNA) component are substituted with phosphorothioates (PS) for enhancing levels of gene disruption. In one embodiment, more than five nucleotides at the 5' and/or the 3' end of the guide RNA (including pegRNA) component are chemically modified with 2'-O-Me, 2'-F or S-constrained ethyl(cEt). Such chemically modified guide RNA (including pegRNA) component can mediate enhanced levels of gene disruption (see Ragdarm et al., 0215, PNAS, E7110-E7111). In an embodiment of the invention, a guide RNA (including pegRNA) component is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide RNA (including pegRNA) component by a linker, such as an alkyl chain. In one embodiment, the chemical moiety of the modified nucleic acid component can be used to attach the guide RNA (including pegRNA) component to another molecule, such as DNA, RNA, protein, or nanoparticles. Such chemically modified guide RNA (including pegRNA) component can be used to identify or enrich cells generically edited by a gene editing system described herein.

Other guide RNA modifications are described in Kim, D. Y., Lee, J. M., Moon, S. B. et al. Efficient CRISPR editing with a hypercompact Cas12f1 and engineered guide RNAs delivered by adeno-associated virus. Nat Biotechnol 40, 94-102 (2022).

Accordingly, in various aspects of the invention, the guide RNA are modified in one or more locations within the molecule. MS1, an internal penta(uridinylate) (UUUUU) sequence in the tracrRNA; MS2, the 3' terminus of the crRNA; MS3, the 'stem 1' region of the tracrRNA; MS4, the tracrRNA-crRNA complementary region; and MS5, the 'stem 2' region of the tracrRNA.

Various aspects of the invention provide methods and compositions for improved guide RNA stability via chemical modifications. Braasch, D. A., Jensen, S., Liu, Y., Kaur, K., Arar, K., White, M. A., et al. (2003). RNA interference in mammalian cells by chemically-modified RNA. *Biochemistry* 42, 7967-7975. doi: 10.1021/bi0343774. Chiu, Y. L., and Rana, T. M. (2003). siRNA function in RNAi: a chemical modification analysis. RNA 9, 1034-1048. doi: 10.1261/rna.5103703. Behlke, M. A. (2008). Chemical modification of siRNAs for in vivo use. *Oligonucleotides* 18, 305-319. doi: 10.1089/oli.2008.0164. Bennett, C. F., and Swayze, E. E. (2010). RNA targeting therapeutics: molecular mechanisms of antisense oligonucleotides as a therapeutic platform. *Annu. Rev. Pharmacol. Toxicol.* 50, 259-293. doi: 10.1146/annurev.pharmtox.010909.105654. Deleavey, G. F., and Damha, M. J. (2012). Designing chemically modified oligonucleotides for targeted gene silencing. *Chem. Biol.* 19, 937-954. doi: 10.1016/j.chembiol.2012.07.011. Lennox, K. A., and Behlke, M. A. (2020). Chemical modifications in RNA interference and CRISPR/Cas genome editing reagents. *Methods Mol. Biol.* 2115, 23-55. doi: 10.1007/978-1-0716-0290-4-2.

For instance, Hendel et al. improved guide RNA stability by chemically modifying gRNA ends to reduce degradation by exonucleases, RNA nuclease. Hendel, A., Bak, R. O., Clark, J. T., Kennedy, A. B., Ryan, D. E., Roy, S., et al. (2015a). Chemically modified guide RNAs enhance CRISPR-Cas genome editing in human primary cells. *Nat. Biotechnol.* 33, 985-989. doi: 10.1038/nbt.3290. Chemical modifications of gRNAs may enable more efficient and safer gene-editing in primary cells suitable for clinical applications.

A review of types of chemical modifications are provided in the table below. Allen, Daniel et al. "Using Synthetically Engineered Guide RNAs to Enhance CRISPR Genome Editing Systems in Mammalian Cells." *Frontiers in genome editing* vol. 2 617910. 28 Jan. 2021, doi:10.3389/fgeed.2020.617910.

| Modification(s) | Modification location | Effect on genome editing efficiency | References |
| --- | --- | --- | --- |
| M | Terminal residues | ↑# | Hendel et al., 2015a; Rahdar et al., 2015 |
| MS | Terminal residues | ↑# | Hendel et al., 2015a; Basila et al., 2017; Finn et al., 2018 |
| | Spacer (PAM-distal region) | ↑* | Yin et al., 2017; Finn et al., 2018; Mir et al., 2018 |
| | Spacer (tracrRNA-binding region) | ↑* | Yin et al., 2017; Finn et al., 2018; Mir et al., 2018 |
| | Spacer (Seed region) | ↓ | Yin et al., 2017; Mir et al., 2018 |
| MSP | Terminal residues | ↑# | Hendel et al., 2015a |
| cEt | Spacer (PAM-distal region) | ↑ | Rahdar et al., 2015 |
| | Spacer (tracrRNA-binding) | ↑ | Rahdar et al., 2015 |
| | Spacer (Seed region) | ↓ | Rahdar et al., 2015 |
| 2'-F | Spacer (PAM-distal region) | ↑ | Rahdar et al., 2015 |
| | Spacer (tracrRNA-binding) | ↑ | Rahdar et al., 2015 |
| | Spacer (Seed region) | ↓ | Rahdar et al., 2015; O''Reilly et al., 2019 |
| 2'-F + PS | Spacer (PAM-distal region) | ↑ | Yin et al., 2017; Mir et al., 2018 |
| | Spacer (tracrRNA-binding) | ↑ | Yin et al., 2017; Mir et al., 2018 |
| | Spacer (Seed region) | ↓ | Yin et al., 2017; Mir et al., 2018 |
| | Spacer (Seed region, Cas9-non-interacting residues) | ↑* | Yin et al., 2017; Mir et al., 2018 |
| PS | Whole crRNA | ↑ | Rahdar et al., 2015 |

*additionally validated in vivo
additionally validated in human primary cells
2'-O-methyl (M or 2'-O-Me); 2'-O-methyl 3' phosphorothioate (MS); 2'-O-methyl 3'-thioPACE(MSP); S-constrained etnyl (cEt); 2'-fluoro (2'-F); and phosphorothioate (PS).

Accordingly, in various embodiments of the present invention, the genome editing system comprising a guide RNA and further comprises one or more chemical modifications selected from, but not limited to the modifications in the above table.

In exemplary embodiments, chemical modifications to the guide RNA (including pegRNA) include modifications on the ribose rings and phosphate backbone of guide RNA (including pegRNA) and modifications at the 2'OH include 2'-O-Me, 2'-F, and 2'F-ANA. More extensive ribose modifications include 2'F-4'-Cα-OMe and 2',4'-di-Cα-OMe combine modification at both the 2' and 4' carbons. Phosphodiester modifications include sulfide-based Phosphorothioate (PS) or acetate-based phosphonoacetate alterations. Combinations of the ribose and phosphodiester modifications have given way to formulations such as 2'-O-methyl 3'phosphorothioate (MS), or 2'-O-methyl-3'-thioPACE (MSP), and 2'-O-methyl-3'-phosphonoacetate (MP) RNAs. Locked and unlocked nucleotides such as locked nucleic acid (LNA), bridged nucleic acids (BNA), S-constrained ethyl (cEt), and unlocked nucleic acid (UNA) are examples of sterically hindered nucleotide modifications. Modifications to make a phosphodiester bond between the 2' and 5' carbons (2',5'-RNA) of adjacent RNAs as well as a butane 4-carbon chain link between adjacent RNAs have been described.

In certain embodiments, the guide RNA comprises one or more hairpins as depicted in the appended Drawings. Preferably, the guide RNA comprises 0-10 hairpins. In some embodiments, the guide RNA comprises 1-3 hairpins. In some embodiments, the guide RNA comprises 2 hairpins. More preferably, a hairpin comprises 6-20 ribonucleotides.

Modification of the sgRNA is also an efficient way of enhancing the efficiency of the CRISPR-Cas systems. Kim, Daesik et al. "Evaluating and Enhancing Target Specificity of Gene-Editing Nucleases and Deaminases." *Annual review of biochemistry* vol. 88 (2019): 191-220. doi:10.1146/annurev-biochem-013118-111730. For instance, adding a "U4AU6" motif at the end of the crRNA Bin Moon, Su et al. "Highly efficient genome editing by CRISPR-Cpf1 using CRISPR RNA with a uridinylate-rich 3'-overhang." *Nature communications* vol. 9,1 3651. 7 Sep. 2018, doi:10.1038/s41467-018-06129-w or using a pol-II-driven truncated pre-tRNA Zhang, Xuhua et al. "Genetic editing and interrogation with Cpf1 and caged truncated pre-tRNA-like crRNA in mammalian cells." *Cell discovery* vol. 4 36. 10 Jul. 2018, doi:10.1038/s41421-018-0035-0 have been demonstrated.

Accordingly, various embodiments provide for the modification of the sgRNA to enhance the efficiency of the CRISPR-Cas12a systems and modifications to express the crRNA to improve the activity of the CRISPR-Cas12a system.

Additional embodiments provide guide RNA modifications including but not limited to one or more chemical modifications selected from 2'-O-Me, 2'-F, and 2'F-ANA at 2'OH; 2'F-4'-Cα-OMe and 2',4'-di-Cα-OMe at 2' and 4' carbons; phosphodiester modifications comprising sulfide-based Phosphorothioate (PS) or acetate-based phosphonoacetate alterations; combinations of the ribose and phosphodiester modifications; locked nucleic acid (LNA), bridged nucleic acids (BNA), S-constrained ethyl (cEt), and unlocked nucleic acid (UNA); modifications to produce a phosphodiester bond between the 2' and 5' carbons (2',5'-RNA) of adjacent RNAs; and a butane 4-carbon chain link between adjacent RNAs.

In still other embodiments, the guide RNAs disclosed herein may be modified by introducing additional RNA motifs into the guide RNAs, e.g., at the 5' and 3' termini of the guide RNAs. Such structures may include, but are not limited to RNA hairpins, RNA step-loops, RNA quadruplexes, cap structures, and poly(A) tails, or ribozyme functions and the like. Also, guide RNAs could also be modified to include one or more nuclear localization sequences.

Additional RNA motifs could also improve function or stability of the guide RNAs. Addition of dimerization motifs—such as kissing loops or a GNRA tetraloop/tetraloop receptor pair—at the 5' and 3' termini of the guide RNAs could also result in effective circularization of the guide RNAs, improving stability. Additionally, it is envisioned that addition of these motifs could enable the physical separation of guide RNA components, e.g., separation of the Cas12a binding region from the spacer sequence. Short 5' extensions or 3' extensions to the guide RNAs that form a small toehold hairpin at either or both ends of the guide RNAs could also compete favorably against the annealing of intracomplementary regions along the length of the guide RNAs. Finally, kissing loops could also be used to recruit other RNAs or proteins to the genomic site targeted by the guide RNA.

Guide RNAs could be further improved via directed evolution, in an analogous fashion to how protein function can be improved. Directed evolution could enhance guide RNA function and/or reduce off-site targeting and/or indels and/or improve precise editing efficiency.

The present disclosure contemplates any such ways to further improve the stability and/or functionality of the guide RNAs disclosed here.

In some embodiments, the RNAs (including the guide RNAs) used in the compositions of the disclosure have undergone a chemical or biological modification to render them more stable. Exemplary modifications to an RNA include the depletion of a base (e.g., by deletion or by the substitution of one nucleotide for another) or modification of a base, for example, the chemical modification of a base. The phrase "chemical modifications" as used herein, includes modifications which introduce chemistries which differ from those seen in naturally occurring RNA, for example, covalent modifications such as the introduction of modified nucleotides, (e.g., nucleotide analogs, or the inclusion of pendant groups which are not naturally found in such mRNA molecules).

Other suitable polynucleotide modifications that may be incorporated into the RNAs used in the compositions of the disclosure include, but are not limited to, 4'-thio-modified bases: 4'-thio-adenosine, 4'-thio-guanosine, 4'-thio-cytidine, 4'-thio-uridine, 4'-thio-5-methyl-cytidine, 4'-thio-pseudouridine, and 4'-thio-2-thiouridine, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl)adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof. The term modification also includes, for example, the incorporation of non-nucleotide linkages or modified nucleotides into the mRNA sequences of the present invention (e.g., modifications to one or both of the 3' and 5' ends of an mRNA molecule encoding a functional protein or enzyme). Such modifications include the addition of bases to an mRNA sequence (e.g., the inclusion of a poly A tail or a longer poly A tail), the alteration of the 3' UTR or the 5' UTR, complexing the mRNA with an agent (e.g., a protein or a complementary nucleic acid molecule), and inclusion of elements which change the structure of an RNA molecule (e.g., which form secondary structures).

In some embodiments, RNAs (e.g., guide RNAs) include a 5' cap structure. A 5' cap is typically added as follows: first, an RNA terminal phosphatase removes one of the terminal phosphate groups from the 5' nucleotide, leaving two terminal phosphates; guanosine triphosphate (GTP) is then added to the terminal phosphates via a guanylyl transferase, producing a 5'5'5 triphosphate linkage; and the 7-nitrogen of guanine is then methylated by a methyltransferase. Examples of cap structures include, but are not limited to, m7G(5')ppp (5'(A,G(5')ppp(5')A and G(5')ppp(5')G. Naturally occurring cap structures comprise a 7-methyl guanosine that is linked via a triphosphate bridge to the 5'-end of the first transcribed nucleotide, resulting in a dinucleotide cap of m7G(5')ppp(5')N, where N is any nucleoside. In vivo, the cap is added enzymatically. The cap is added in the nucleus and is catalyzed by the enzyme guanylyl transferase. The addition of the cap to the 5' terminal end of RNA occurs immediately after initiation of transcription. The terminal nucleoside is typically a guanosine, and is in the reverse orientation to all the other nucleotides, i.e., G(5')ppp(5') GpNpNp.

Additional cap analogs include, but are not limited to, a chemical structures selected from the group consisting of m7GpppG, m7GpppA, m7GpppC; unmethylated cap analogs (e.g., GpppG); dimethylated cap analog (e.g., m2,7GpppG), trimethylated cap analog (e.g., m2,2,7GpppG), dimethylated symmetrical cap analogs (e.g., m7Gpppm7G), or anti reverse cap analogs (e.g., ARCA; m7,2'OmeGpppG, m72'dGpppG, m7,3'OmeGpppG, m7,3'dGpppG and their tetraphosphate derivatives) (see, e.g., Jemielity, J. et al., "Novel 'anti-reverse' cap analogs with superior translational properties", RNA, 9: 1108-1122 (2003)).

Typically, the presence of a "tail" serves to protect the RNA (e.g., guide RNAs) from exonuclease degradation. A poly A or poly U tail is thought to stabilize natural messengers and synthetic sense RNA. Therefore, in certain embodiments a long poly A or poly U tail can be added to an RNA molecule thus rendering the RNA more stable. Poly A or poly U tails can be added using a variety of art-recognized techniques. For example, long poly A tails can be added to synthetic or in vitro transcribed RNA using poly A polymerase (Yokoe, et al. Nature Biotechnology. 1996; 14: 1252-1256). A transcription vector can also encode long poly A tails. In addition, poly A tails can be added by transcription directly from PCR products. Poly A may also be ligated to the 3' end of a sense RNA with RNA ligase (see, e.g., Molecular Cloning A Laboratory Manual, 2nd Ed., ed. by Sambrook, Fritsch and Maniatis (Cold Spring Harbor Laboratory Press: 1991 edition)).

Typically, the length of a poly A or poly U tail can be at least about 10, 50, 100, 200, 300, 400 at least 500 nucleotides. In some embodiments, a poly-A tail on the 3' terminus of mRNA typically includes about 10 to 300 adenosine nucleotides (e.g., about 10 to 200 adenosine nucleotides, about 10 to 150 adenosine nucleotides, about 10 to 100 adenosine nucleotides, about 20 to 70 adenosine nucleotides, or about 20 to 60 adenosine nucleotides). In some embodiments, mRNAs include a 3' poly(C) tail structure. A suitable poly-C tail on the 3' terminus of mRNA typically include about 10 to 200 cytosine nucleotides (e.g., about 10 to 150 cytosine nucleotides, about 10 to 100 cytosine nucleotides, about 20 to 70 cytosine nucleotides, about 20 to 60 cytosine nucleotides, or about 10 to 40 cytosine nucleotides). The poly-C tail may be added to the poly-A or poly U tail or may substitute the poly-A or poly U tail.

RNAs according to the present disclosure (e.g., Cas12a guide RNAs) may be synthesized according to any of a variety of known methods. For example, RNAs according to the present invention may be synthesized via in vitro transcription (IVT). Briefly, IVT is typically performed with a linear or circular DNA template containing a promoter, a pool of ribonucleotide triphosphates, a buffer system that may include DTT and magnesium ions, and an appropriate RNA polymerase (e.g., T3, T7 or SP6 RNA polymerase), DNAse I, pyrophosphatase, and/or RNAse inhibitor. The exact conditions will vary according to the specific application.

In a particular embodiment, the guide RNAs can comprise an MS2 modification, as specific RNA hairpin structure recognized in nature by a certain MS2-binding protein. This domain can help to stabilize the guide RNAs and improve the editing efficiency. The disclosure contemplates other similar modifications. A review of other such MS2-like domains are described in the art, for example, in Johansson et al., "RNA recognition by the MS2 phage coat protein," Sem Virol., 1997, Vol. 8(3): 176-185; Delebecque et al., "Organization of intracellular reactions with rationally designed RNA assemblies," Science, 2011, Vol. 333: 470-474; Mali et al., "Cas9 transcriptional activators for target specificity screening and paired nickases for cooperative genome engineering," Nat. Biotechnol., 2013, Vol. 31: 833-838; and Zalatan et al., "Engineering complex synthetic transcriptional programs with CRISPR RNA scaffolds," Cell, 2015, Vol. 160: 339-350, each of which are incorporated herein by reference in their entireties. Other systems include the PP7 hairpin, which specifically recruits the PCP protein, and the "com" hairpin, which specifically recruits the Com protein. See Zalatan et al. The nucleotide sequence of the MS2 hairpin (or equivalently referred to as the "MS2 aptamer") is:

(SEQ ID NO: 1549)
GCCAACATGAGGATCACCCATGTCTGCAGGGCC.

E. Cas12a (or Cas Type V) Editing Systems

The present disclosure relates to novel genome editing systems. In exemplary embodiments, the editing systems comprise:
(a) one or more polypeptide sequences comprising at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of sequences selected from SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419); and
(b) one or more polynucleotide sequences comprising a guide RNA, wherein the guide RNA comprises a complementary sequence to that of a targeted polynucleotide sequence.

In other aspects, the Cas12a-based gene editing systems may comprise one or more additional accessory proteins having genome modifying functions, including recombinases, invertases, nucleases, polymerases, ligases, deaminases, reverse transcriptases, or epigenetic modifying functions. In various embodiments, the accessory proteins may be provided separately. In other embodiments, the accessory proteins may be fused to Cas12a, optionally with a linker.

In various embodiments, the genome editing system may comprise a guide RNA, which hybridizes to one or more targeted polynucleotide sequence. In preferred embodiments, the guide RNA of the genome editing system comprises 12-40 nucleotides.

In various embodiments, the genome editing system comprises the targeted polynucleotide sequence comprises one or more protospacer adjacent motif (PAM) recognition domains selected from 5'-TTTN-3', 5'-TTN-3', 5'-TNN-3', 5'-TTV-3', or 5'-TTTV-3', wherein N=A, T, C or G and V=A, C or G. In additional embodiments, the targeted polynucleotide sequence comprises one or more relaxed PAM recognition domains. Jacobsen, Thomas et al. "Characterization of Cas12a nucleases reveals diverse PAM profiles between closely-related orthologs." Nucleic acids research vol. 48,10 (2020): 5624-5638. doi:10.1093/nar/gkaa272. Previous work has demonstrated to address the limitation for the requirement for an extended TTTV protospacer adjacent motif (PAM) by expanding the targeting range for non-canonical PAMs (such as ATTA, CTTA, GTTA, and TCTA) Kleinstiver, Benjamin P et al. "Engineered CRISPR-Cas12a variants with increased activities and improved targeting ranges for gene, epigenetic and base editing." *Nature biotechnology* vol. 37,3 (2019): 276-282. doi:10.1038/s41587-018-0011-0. Most of the Cpf1 nucleases require thymine-rich PAM. Different studies have demonstrated an increased Cpf1 targeting range using in vitro and in vivo (*E. coli*) PAM identification assays. Zhang, Xiaochun, et al. "Multiplex gene regulation by CRISPR-ddCpf1." *Cell discovery* 3.1 (2017): 1-9. The two Cpf1 endonucleases, AsCpf1 and LbCpf1, require TTTV as a PAM sequence, where V can be A, C, or G nucleotides. Mutations at position S542R/K607R and S542R/K548V/N552R produced AsCpf1 variants, and these are able to recognize TYCV and TATV PAMs, respectively, where Y can be C or T. Gao, Linyi, et al. "Engineered Cpf1 variants with altered PAM specificities." *Nature biotechnology* 35.8 (2017): 789-792. The AsCpf1 showed increased activity for TTTV PAMs and decreased activity with TTTT PAM Kim, Hui K., et al. "In vivo high-throughput profiling of CRISPR-Cpf1 activity." *Nature methods* 14.2 (2017): 153-159.

Accordingly, it is within the scope of the disclosure to devise the Cas12a editing system to recognize altered PAM recognition domains for genome editing. In preferred embodiments, the Cas12a polypeptide recognizes one or more non-canonical PAM sequence in the targeted polynucleotide sequence, the PAM upstream of the crRNA-complementary DNA sequence on the non-target strand. In related embodiments, the gRNA has a seed sequence of eight nucleotides, located at the 5' end of the spacer, and is proximal to the PAM sequence on the targeted polynucleotide sequence. Preferably, the Cas12a polypeptide cleaves the targeted polynucleotide sequence about 20 nucleotides upstream of the PAM sequence.

In further embodiments, the one or more polypeptide sequences and the one or more polynucleotide sequences comprising a cognate guide RNA of the genome editing system form a ribonucleoprotein complex.

In various embodiments, the one or more polypeptide sequences of the genome editing system comprise:
- one or more α-helical recognition lobe (REC) and a nuclease lobe (NUC);
- a Wedge (WED), α-helical recognition lobe (REC), PAM-interacting (PI),
- RuvC nuclease, Bridge Helix (BH) and NUC domains; or
- one or more domains selected from RuvC, REC, WED, BH, PI and NUC domains.

Preferably, the REC lobe comprises REC1 and REC2 domains. More preferably, the NUC lobe comprises the RuvC, PI, WED, and Bridge Helix (BH) domains. Additionally, the RuvC domain comprises subdomains RuvCI, RuvCII and RuvCIII. In preferred embodiments, the RuvCIII domain is located on the C-terminus.

In various embodiments, the one or more polypeptide sequences of the genome editing system lack a HNH endonuclease domain.

Without being bound by theory, the Cas12a genome editing system is characterized as a Class 2, Type V Cas endonuclease.

In various embodiments, the molecular weight of Cas12a nuclease is characterized in its molecular weight to be about 50 kDa-100 kDa, 100 kDa-200 kDa, 200 kDa-500 kDa.

In additional embodiments, the polypeptide sequences comprise at least one activity selected from endonuclease activity; endoribonuclease activity, or RNA-guided DNase activity. In such embodiments, the cognate guide RNA and the Cas12a protein modifies the targeted polynucleotide sequence of a host cell genome. In certain instances, the targeted polynucleotide sequence is modified by an insertion, deletion or alteration of one or more base pairs at the targeted polynucleotide sequence in the host cell genome.

In related embodiments, the genome editing system is characterized in enhanced efficiency and precision of site-directed integration. Preferably, the efficiency and precision of site-directed integration enabled by genome editing system is enhanced by staggered overhangs on the donor nucleic acid sequence. In certain embodiments, the targeted polynucleotide sequence is double-stranded and contains a 5' overhang wherein the overhang preferably comprises five nucleotides.

In various embodiments, cleavage or cuts in the targeted polynucleotide sequence is preferably repaired by endogenous DNA polymerase repair mechanism present in the cell. In some embodiments, methods provide introducing a donor DNA sequence under conditions that allow editing of the targeted polynucleotide sequence by homology directed repair. Preferably, the Cas12a genome editing system is characterized as exhibiting reduced specificity, e.g., off-target effects relative to Cas9. More preferably, the Cas12a system comprises enhanced activity of at least 1, 1.5, 2, 2.5, 3, 3.5, 4, 4.5, 5, 5.5, 6, 6.5, 7, 7.5, 8, 8.5, 9, 9.5, 10 or higher-fold improvement.

In various embodiments, the RuvC domain comprising RuvC subdomains I, II and II of the Cas12a polypeptide of the Cas12a genome editing system cleaves the targeted polynucleotide sequence and/or a non-target DNA strand. Preferably, the genome editing system expresses multiple copies of guide RNA in a host cell of interest.

In various other embodiments, the polypeptide of the genome editing system comprises one or more mutations. Preferably, the mutation is selected from one or more domains selected from RuvC, REC, WED, BH, PI and NUC domains. More preferably, the mutation encodes a nuclease-deficient polypeptide. In various embodiments, the genome editing system comprises a fusion of one or more deaminases to the nuclease deficient polypeptide. Preferably, the one or more deaminases of the genome editing system is selected from adenine deaminase or cytosine deaminase. Use of cytidine deaminase and adenosine deaminase base editing is disclosed in U.S. Pat. No. 9,840,699. One approach is to produce an Cas12a fusion protein, preferably an inactive or nickase variant) and a base-editing enzyme or the active domain of a base editing enzyme. Cytidine deaminase and adenosine deaminase base editing is disclosed in U.S. Pat. No. 9,840,699. In various embodiments, the compositions comprise contacting a targeted polynucleotide sequence with a fusion protein comprising an Cas12a and one or more base-editing polypeptide such as a deaminase; and a gRNA targeting the fusion protein to the targeted polynucleotide sequence of the DNA strand. Accordingly, the fusion of one or more deaminases to the nuclease deficient polypeptide of the Cas12a genome editing system of enables base editing on DNA and/or RNA. In select embodiments, the system modifies one or more nucleobase on DNA and RNA. In related embodiments, the system enables multiplexed gene editing. Preferably, the genome editing system comprises a single crRNA. More preferably, the system enables targeting multiple genes simultaneously.

Recent studies demonstrate Cas12a's on-target gene editing efficiency approaching 100% through modifications to the NLS framework. Luk et al., GEN Biotechnology. June 2022.271-284. doi.org/10.1089/genbio.2022.0003. Previous work also demonstrated NLS-optimized SpCas9-based prime editor that improves genome editing efficiency Liu, Pengpeng et al. "Improved prime editors enable pathogenic allele correction and cancer modelling in adult mice." *Nature communications* vol. 12,1 2121. 9 Apr. 2021, doi: 10.1038/s41467-021-22295-w.

In yet other embodiments, the Cas12a polypeptide is operably linked to a nuclear localization signal (NLS). Preferably, the Cas12a polypeptide comprises an NLS on the N-terminus or the C-terminus or both or multiple NLS on the Cas12a polypeptide. In some embodiments, the polypeptide linked to the NLS further comprises crRNA to form a ribonucleoprotein complex. In some embodiments, polypeptide comprises one or more NLS repeats at either N- or C-terminus of the polypeptide.

In select embodiments, the one or more polypeptide sequences of the genome editing system comprises a modification, wherein the modification comprises a nuclease-deficient polypeptide (dCas). In related embodiments, the guide RNA of the genome editing system of comprises a prime editing guide RNA (pegRNA). Preferably, the pegRNA of the genome editing system hybridizes to a targeted polynucleotide sequence and acts as a primer to the one or more reverse transcriptases. More preferably, the pegRNA of the genome editing system binds to the nicked strand for initiation of repair through a reverse transcriptase using the repair template.

In various additional embodiments, the nuclease-deficient polypeptide of the genome editing system comprises a nickase activity. Preferably, the genome editing system comprises fusion of one or more reverse transcriptases to the nuclease deficient Cas (dCas). In certain examples, the fusion of one or more reverse transcriptases is selected from Moloney Murine Leukemia Virus (M-MLV). In certain embodiments, the guide RNA or a pegRNA comprises or consists of an extended single guide RNA containing a primer binding site (PBS) and a reverse transcriptase (RT) template sequence.

The Cas12a genome editing system comprises improved genome editing characteristics selected from efficiency, specificity, precision, intended edits:unintended edits, indels relative to Cas9. Accordingly, it is an object of the invention to reduce off-target effects in host cells in comparison to an equivalent endonuclease activity in host cells relative to SpCas9.

Optional Components/Modifications
Donor Templates

In one embodiment, the compositions and systems herein may further comprise one or more donor templates for use in editing. In some cases, the donor template may comprise one or more polynucleotides. In certain cases, the donor template may comprise coding sequences for one or more polynucleotides. The donor template may be a DNA template. It may be single stranded or double stranded. It may also be circular single or double stranded. It may also be linear single stranded or double stranded. Without being bound by theory, the donor template may become integrated into the genome after a targeted cut by the Cas12a gene editing system described herein through cellular repair machinery including HDR and NHEJ.

The donor template may be used for editing the target polynucleotide. In some cases, the donor polynucleotide comprises one or more mutations to be introduced into the target polynucleotide. Examples of such mutations include substitutions, deletions, insertions, or a combination thereof. The mutations may cause a shift in an open reading frame on the target polynucleotide. In some cases, the donor template alters a stop codon in the target polynucleotide. For example, the donor template may correct a premature stop codon. The correction may be achieved by deleting the stop codon or introduces one or more mutations to the stop codon. In other example embodiments, the donor template addresses loss of function mutations, deletions, or translocations that may occur, for example, in certain disease contexts by inserting or restoring a functional copy of a gene, or functional fragment thereof, or a functional regulatory sequence or functional fragment of a regulatory sequence. A functional fragment refers to less than the entire copy of a gene by providing sufficient nucleotide sequence to restore the functionality of a wild type gene or non-coding regulatory sequence (e.g. sequences encoding long non-coding RNA). In certain example embodiments, the systems disclosed herein may be used to replace a single allele of a defective gene or defective fragment thereof. In another example embodiment, the systems disclosed herein may be used to replace both alleles of a defective gene or defective gene fragment. A "defective gene" or "defective gene fragment" is a gene or portion of a gene that when expressed fails to generate a functioning protein or non-coding RNA with functionality of a corresponding wild-type gene. In certain example embodiments, these defective genes may be associated with one or more disease phenotypes. In certain example embodiments, the defective gene or gene fragment is not replaced but the systems described herein are used to insert donor templates that encode gene or gene fragments that compensate for or override defective gene expression such that cell phenotypes associated with defective gene expression are eliminated or changed to a different or desired cellular phenotype.

In an embodiment of the invention, the donor template may include, but not be limited to, genes or gene fragments, encoding proteins or RNA transcripts to be expressed, regulatory elements, repair templates, and the like. According to the invention, the donor templates may comprise left end and right end sequence elements that function with transposition components that mediate insertion.

In certain cases, the donor template manipulates a splicing site on the target polynucleotide. In some examples, the donor template disrupts a splicing site. The disruption may be achieved by inserting the polynucleotide to a splicing site and/or introducing one or more mutations to the splicing site. In certain examples, the donor template may restore a splicing site. For example, the polynucleotide may comprise a splicing site sequence.

The donor template to be inserted may has a size from 10 base pair or nucleotides to 50 kb in length, e.g., from 50 to 40 k, from 100 and 30 k, from 100 to 10000, from 100 to 300, from 200 to 400, from 300 to 500, from 400 to 600, from 500 to 700, from 600 to 800, from 700 to 900, from 800 to 1000, from 900 to from 1100, from 1000 to 1200, from 1100 to 1300, from 1200 to 1400, from 1300 to 1500, from 1400 to 1600, from 1500 to 1700, from 600 to 1800, from 1700 to 1900, from 1800 to 2000 base pairs (bp) or nucleotides in length.

In some embodiments, the heterologous nucleic acid sequence is a donor DNA template that can be integrated into a host genome via HDR. In other embodiments, the heterologous nucleic acid sequence is a donor DNA template that can be integrated into a host genome via NHEJ.

In certain embodiments, the heterologous nucleic acid comprises or encodes a donor/template sequence, wherein the donor/template corrects/repairs/removes a mutation at the target genome site. For example, the mutation may be a mutated exon in a disease gene.

In certain embodiments, the donor/template may encode or comprises a functional DNA element, such as a promoter, an enhancer, a protein binding sequence, a methylation site, or a homology region for assisting gene editing, etc.

By "donor DNA" or "donor DNA template" it is meant a DNA segment (can be single stranded or double stranded DNA) to be inserted at a site cleaved by a gene-editing nuclease (e.g., a Cas12a nuclease) (e.g., after dsDNA cleavage, after nicking a target DNA, after dual nicking a target DNA, and the like). The donor DNA template can contain sufficient homology to a genomic sequence at the target site, e.g., 70%, 80%, 85%, 90%, 95%, or 100% homology with the nucleotide sequences flanking the target site, e.g. within about 50 bases or less of the target site, e.g. within about 30 bases, within about 15 bases, within about 10 bases, within about 5 bases, or immediately flanking the target site, to support homology-directed repair between it and the genomic sequence to which it bears homology. In the case of repair by NHEJ, no homology is needed on the donor DNA template against the site to which it targets editing.

Approximately 25, 50, 100, or 200 nucleotides, or more than 200 nucleotides, of sequence homology between a donor DNA template and a genomic sequence (or any integral value between 10 and 200 nucleotides, or more) can support homology-directed repair. Donor DNA template can be of any length, e.g., 50 nucleotides or more, 100 nucleotides or more, 250 nucleotides or more, 500 nucleotides or more, 1000 nucleotides or more, 5000 nucleotides or more, etc. A suitable donor DNA template can be from 50 nucleotides to 100 nucleotides, from 100 nucleotides to 500 nucleotides, from 500 nucleotides to 1000 nucleotides, from 1000 nucleotides to 5000 nucleotides, or from 5000 nucleotides to 10,000 nucleotides, or more than 10,000 nucleotides, in length.

As noted above, in some embodiments, the donor DNA template comprises a first homology arm and a second homology arm. The first homology arm is at or near the 5' end of the donor DNA; and comprises a nucleotide sequence that is at least partially complementary to a first nucleotide sequence in a target nucleic acid. The second homology arm is at or near the 3' end of the donor DNA; and comprises a nucleotide sequence that is at least partially complementary to a second nucleotide sequence in the target nucleic acid. The first and second homology arms can each independently have a length of from about 10 nucleotides to 400 nucleotides; e.g., from 10 nucleotides (nt) to 15 nt, from 15 nt to 20 nt, from 20 nt to 25 nt, from 25 nt to 30 nt, from 30 nt to 35 nt, from 35 nt to 40 nt, from 40 nt to 45 nt, from 45 nt to 50 nt, from 50 nt to 75 nt, from 75 nt to 100 nt, from 100 nt to 125 nt, from 125 nt to 150 nt, from 150 nt to 175 nt, from 175 nt to 200 nt, from 200 nt to 225 nt, from 225 nt to 250 nt, from 250 nt to 275 nt, from 275 nt to 300 nt, from 325 nt to 350 nt, from 350 nt to 375 nt, or from 375 nt to 400 nt.

In certain embodiments, the donor DNA template is used for editing the target nucleotide sequence. In certain embodiments, the donor DNA template comprises one or more mutations to be introduced into the target polynucleotide. Examples of such mutations include substitutions, deletions, insertions, or a combination thereof. In certain embodiments, the mutation causes a shift in an open reading frame on the target polynucleotide. In certain embodiments, the donor polynucleotide alters a stop codon in the target polynucleotide. In certain embodiments, the donor polynucleotide corrects a premature stop codon. The correction can be achieved by deleting the stop codon, or by introducing one or more sequence changes to alter the stop codon to a codon. In certain embodiments, the donor polynucleotide addresses loss of function mutations, deletions, or translocations that may occur, for example, in certain disease contexts by inserting or restoring a functional copy of a gene, or functional fragment thereof, or a functional regulatory sequence or functional fragment of a regulatory sequence. A functional fragment includes a fragment less than the entire copy of a gene but otherwise provides sufficient nucleotide sequence to restore the functionality of a wild type gene or non-coding regulatory sequence (e.g., sequences encoding long non-coding RNA).

In certain embodiments, the donor DNA template may be used to replace a single allele of a defective gene or defective fragment thereof. In another embodiment, the donor DNA template is used to replace both alleles of a defective gene or defective gene fragment. A "defective gene" or "defective gene fragment" is a gene or portion of a gene that when expressed, fails to generate a functioning protein or non-coding RNA with functionality of the corresponding wild-type gene.

In certain example embodiments, these defective genes may be associated with one or more disease phenotypes. In certain example embodiments, the defective gene or gene fragment is not replaced but the heterologous nucleic acid is used to insert donor polynucleotides that encode gene or gene fragments that compensate for or override defective gene expression such that cell phenotypes associated with defective gene expression are eliminated or changed to a different or desired cellular phenotype. This can be achieved by including the coding sequence of a therapeutic protein, such as a therapeutic antibody or functional fragment thereof, or a wild-type version of a defective protein associated with one or more disease phenotypes.

In certain embodiments, the donor may include, but not be limited to, genes or gene fragments, encoding proteins or RNA transcripts to be expressed, regulatory elements, repair templates, and the like. According to the invention, the donor polynucleotides may comprise left end and right end sequence elements that function with transposition components that mediate insertion.

In certain embodiments, the donor DNA template manipulates a splicing site on the target polynucleotide. In certain embodiments, the donor DNA template disrupts a splicing site. The disruption may be achieved by inserting the polynucleotide to a splicing site and/or introducing one or more mutations to the splicing site. In certain embodiments, the donor polynucleotide may restore a splicing site. For example, the polynucleotide may comprise a splicing site sequence.

In certain embodiments, the donor DNA template to be inserted has a size from 10 bp to 50 kb in length, e.g., from 50 bp to ~40 kb, from 100 bp to ~30 kb, from 100 bp to ~10 kb, from 100 bp to 300 bp, from 200 bp to 400 bp, from 300 bp to 500 bp, from 400 bp to 600 bp, from 500 bp to 700 bp, from 600 bp to 800 bp, from 700 bp to 900 bp, from 800 bp to 1000 bp, from 900 bp to 1100 bp, from 1000 bp to 1200 bp, from 1100 bp to 1300 bp, from 1200 bp to 1400 bp, from 1300 bp to 1500 bp, from 1400 bp to 1600 bp, from 1500 bp to 1700 bp, from 1600 bp to 1800 bp, from 1700 bp to 1900 bp, from 1800 bp to 2000 bp nucleotides in length.

In certain embodiments, the homologous arm on one or both ends of the sequence to be inserted is independently about 20 bp, 40 bp, 60 bp, 80 bp, 100 bp, 120 bp, or 150 bp.

The first homology arm and the second homology arm of the donor DNA flank a nucleotide sequence ("a nucleotide sequence of interest" or "an intervening nucleotide sequence") that is to be introduced into a target nucleic acid. The nucleotide sequence of interest can comprise: i) a nucleotide sequence encoding a polypeptide of interest; ii) a nucleotide sequence encoding an exon of a gene; iii) a promoter sequence; iv) an enhancer sequence; v) a nucleotide sequence encoding a non-coding RNA; or vi) any combination of the foregoing.

The donor DNA can provide for gene correction, gene replacement, gene tagging, transgene insertion, nucleotide deletion, gene disruption, gene mutation, etc. For example, the donor DNA can be used to add, e.g., insert or replace, nucleic acid material to a target DNA (e.g. to "knock in" a nucleic acid that encodes a protein, an siRNA, an miRNA, etc.), to add a tag (e.g., 6×His, a fluorescent protein (e.g., a green fluorescent protein; a yellow fluorescent protein, etc.), hemagglutinin (HA), FLAG, etc.), to add a regulatory sequence to a gene (e.g. promoter, polyadenylation signal, internal ribosome entry sequence (IRES), 2A peptide, start codon, stop codon, splice signal, localization signal, enhancer, etc.), to modify a nucleic acid sequence (e.g., introduce a mutation), and the like. For example, the donor DNA can be used to modify DNA in a site-specific, i.e. "targeted", way; for example gene knock-out, gene knock-in, gene editing, gene tagging, etc., as used in, for example, gene therapy, e.g. to treat a disease; or as an antiviral, antipathogenic, or anticancer therapeutic, the production of genetically modified organisms in agriculture, the large scale production of proteins by cells for therapeutic, diagnostic, or research purposes, the induction of pluripotent stem cells, biological research, the targeting of genes of pathogens for deletion or replacement, etc.

In some cases, the donor DNA comprises a nucleotide sequence encoding a polypeptide of interest. Polypeptides of interest include, e.g., a) functional versions of a polypeptide that comprises one or more amino acid substitutions, insertions, and/or deletions and that exhibits reduced function, e.g., where the reduced function is associated with or causes a pathological condition; b) fluorescent polypeptides; c) hormones; d) receptors for ligands; e) ion channels; f) neurotransmitters; g) and the like.

In some cases, the donor DNA comprises a nucleotide sequence that encodes a wild-type protein that is lacking in the recipient cell. In some cases, the donor DNA encodes a wild type factor (e.g. Factor VII, Factor VIII, Factor IX and the like) involved in coagulation. In some cases, the donor DNA comprises a nucleotide sequence that encodes a therapeutic antibody. In some cases, the donor DNA comprises a nucleotide sequence that encodes an engineered protein or receptor. In some cases, the engineered receptor is a T cell receptor (TCR), a natural killer (NK) receptor (NKR), or a B cell receptor (BCR). In some cases, the engineered TCR or NKR targets a cancer marker (e.g., a polypeptide that is expressed (e.g., over-expressed) on the surface of a cancer cell). In some cases, the donor DNA comprises a nucleotide sequence that encodes a chimeric antigen receptor (CAR). In some cases, the CAR targets a cancer marker. Donor DNAs encoding CAR, TCR, and/or NCR proteins may be folded into DNA origami structures (DNA nanostructures) and delivered into T cells or NK cells in vitro or in vivo.

Non-limiting examples of polypeptides that can be encoded by a donor DNA include, e.g., IL1B (interleukin 1, beta), XDH (xanthine dehydrogenase), TP53 (tumor protein p53), PTGIS (prostaglandin I2 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin I2 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (C. elegans)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), vWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric Golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein IIIa, antigen CD61)), CAT (catalase), UTS2 (urotensin 2), THBD (thrombomodulin), F10 (coagulation factor X), CP (ceruloplasmin (ferroxidase)), TNFRSF11B (tumor necrosis factor receptor superfamily, member IIb), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, subfamily B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP1 (matrix metallopeptidase 1 (interstitial collagenase)), TIPl1 (TIP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysins 1, progelatinase)), ELN (elastin), USF1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-1-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomer ase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CAB INI (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SP1 (Sp 1 transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member A1), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IE17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, A1 polypeptide), TTR (transthyretin), FABP4 (fatty acid binding protein 4, adipocyte), PON3 (paraoxonase 3), APOC1 (apolipoprotein C—I), INSR (insulin receptor), TNFRSF1B (tumor necrosis factor receptor superfamily, member IB), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (Drosophila)), UGT1A1 (UDP glucuronosyltransferase 1 family, polypeptide A1), IFNA1 (interferon, alpha 1), PPARD (peroxisome proliferator-activated receptor delta), SIRT1 (sirtuin (silent mating type information regulation 2 homolog) 1 (S. cerevisiae)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gp130, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member A1 (aldehyde reductase)), ALDH9A1 (aldehyde dehydrogenase 9 family, member A1), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMPP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin LI), PCNA (proliferating cell nuclear antigen), IGF2 (insulin like growth factor 2 (somatomedin A)), ITGB1 (integrin, beta 1 (fibronectin receptor, beta polypeptide, antigen CD29 includes MDF2, MSK12)), CAST (calpastatin), CXCL12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), TL2RA (interleukin 2 receptor, alpha), CCL5 (chemokine (C-C motif) ligand 5), IRF1 (interferon regulatory factor 1), CFLAR (CASP8 and FADD-like apoptosis regulator), CALC A (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PEC AMI (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (*S. cerevisiae*)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-b-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Sha1-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene C4 synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase IB (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor HI), NR1I2 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCF1E (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase kinase 5), CF1GA (chromogranin A (parathyroid secretory protein 1)), IAPP (islet amyloid polypeptide), RFIO (rhodopsin), ENPP1 (ectonucleotide pyrophosphatase/phosphodiesterase 1), PTF1LF1 (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISF1 (cytokine inducible SF12-containing protein), GAST (gastrin), MYOC (myocilin, trabecular mesh work inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), FISF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTF1 (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOF1 (apolipoprotein FI (beta-2-glycoprotein I)), S100A8 (S100 calcium binding protein A8), IL11 (interleukin 11), ALOX15 (arachidonate 15-lipoxygenase), FBLN1 (fibulin 1), NR1F13 (nuclear receptor subfamily 1, group FI, member 3), SCD (stearoyl-CoA desaturase (delta-9-desaturase)), GIP (gastric inhibitory polypeptide), CF1 GB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), F1SD1 1B2 (hydroxy steroid (11-beta) dehydrogenase 2), CALCRL (calcitonin receptor-like), GALNT2 (UDP-N-acetyl-alpha-D-galactosamine:polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adeno virus E1B 19 kDa interacting protein 3), GCKR (glucokinase (hexokinase 4) regulator), S100A12 (S100 calcium binding protein A 12), PADI4 (peptidyl arginine deaminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), insulin, RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNA1C (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11 A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol(myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member B1), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), cystic fibrosis transmembrane conductance regulator (CFTR), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), F11R (F11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), K'HK (ketohexokinase (fructokinase)), SAT1 (spermidine/spermine N1-acetyltransferase 1), GGFI (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2 A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RFIOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-Sep (15 kDa selenoprotein), CILP2 (cartilage intermediate layer protein 2), TERC (telomerase RNA component), GGT2 (gamma-glutamyltransf erase 2), MT-COl (mitochondrially encoded cytochrome c oxidase I), UOX (urate oxidase, pseudogene), a CRISPR/Cas effector polypeptide, an enzymatically active CRISPR/Cas effector polypeptide (e.g., is capable of cleaving a target nucleic acid) and a CRISPR/Cas effector polypeptide that is not enzymatically active (e.g., does not cleave a target nucleic acid, but retains binding to the target nucleic acid). In some cases, the donor DNA encodes a wild-type version of any of the foregoing polypeptides; i.e., the donor DNA can encode a "normal" version that does not include a mutation(s) that results in reduced function, lack of function, or pathogenesis.

In some cases, the donor DNA comprises a nucleotide sequence encoding a fluorescent polypeptide. Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilized EGFP (dEGFP), destabilized ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2 (12), mRFPl, pocilloporin, Renilla GFP, Monster GFP, paGFP, Kaede protein and kindling protein, Phycobiliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrape1, mRaspberry, mGrape2, m PI urn (Shaner et al. (2005) Nat. Methods 2:905-909), and the like. Any of a variety of fluorescent and colored proteins from Anthozoan species, as described in, e.g., Matz et al. (1999) Nature Biotechnol. 17:969-973, can be encoded.

In some cases, the donor DNA encodes an RNA, e.g., an siRNA, a microRNA, a short hairpin RNA (shRNA), an anti-sense RNA, a riboswitch, a ribozyme, an aptamer, a ribosomal RNA, a transfer RNA, and the like.

A donor DNA can include, in addition to a nucleotide sequence encoding one or more gene products (e.g., an RNA and/or a polypeptide), one or more transcriptional control elements, e.g., a promoter, an enhancer, and the like. In some cases, the transcriptional control element is inducible. In some cases, the promoter is reversible. In some cases, the transcriptional control element is constitutive. In some cases, the promoter is functional in a eukaryotic cell. In some cases, the promoter is a cell type-specific promoter. In some cases, the promoter is a tissue-specific promoter.

The nucleotide sequence of the donor DNA is typically not identical to the target nucleic acid (e.g., genomic sequence) that it replaces. Rather, the donor DNA may contain at least one or more single base changes, insertions, deletions, inversions or rearrangements with respect to the target nucleic acid (e.g., genomic sequence), so long as sufficient homology is present to support homology-directed repair (e.g., for gene correction, e.g., to convert a disease-causing base pair or a non-disease-causing base pair). In some cases, the donor DNA comprises a non-homologous sequence flanked by two regions of homology, such that homology-directed repair between the target DNA region and the two flanking sequences results in insertion of the non-homologous sequence at the target region. Donor DNA may also comprise a vector backbone containing sequences that are not homologous to the DNA region of interest (the target nucleic acid) and that are not intended for insertion into the DNA region of interest (the target nucleic acid).

Generally, the homologous region(s) of a donor sequence will have at least 50% sequence identity to a target nucleic acid (e.g., a genomic sequence) with which recombination is desired. In certain cases, 60%, 70%, 80%, 90%, 95%, 98%, 99%, or 99.9% sequence identity is present. Any value between 1% and 100% sequence identity can be present, depending upon the length of the donor polynucleotide.

The donor DNA may comprise certain nucleotide sequence differences as compared to the target nucleic acid (e.g., genomic sequence), where such difference include, e.g. restriction sites, nucleotide polymorphisms, selectable markers (e.g., drug resistance genes, fluorescent proteins, enzymes etc.), etc., which may be used to assess for successful insertion of the donor DNA at the cleavage site or in some cases may be used for other purposes (e.g., to signify expression at the targeted genomic locus). In some cases, if located in a coding region, such nucleotide sequence differences will not change the amino acid sequence, or will make silent amino acid changes (i.e., changes which do not affect the structure or function of the protein). Alternatively, these sequences differences may include flanking recombination sequences such as FLPs, loxP sequences, or the like, that can be activated at a later time for removal of the marker sequence. In some cases, the donor DNA will include one or more nucleotide sequences to aid in localization of the donor to the nucleus of the recipient cell or to aid in the integration of the donor DNA into the target nucleic acid. For example, in some case, the donor DNA may comprise one or more nucleotide sequences encoding one or more nuclear localization signals (e.g. PKKKRKV (SEQ ID NO:1550), VSRKRPRP (SEQ ID NO: 1548), QRKRKQ (SEQ ID NO: 1551), and the like (Frietas et al (2009) Cun-Genomics 10:550-7). In some cases, the donor DNA will include nucleotide sequences to recruit DNA repair enzymes to increase insertion efficiency. Fiuman enzymes involved in homology directed repair include MRN-CtIP, BLM-DNA2, ExoI, ERCC1, Rad51, Rad52, Ligase 1, RoIQ, PARP1, Ligase 3, BRCA2, RecQ/BLM-ToroIIIa, RTEL, Ro îd, and Ro îh (Verma and Greenburg (2016) Genes Dev. 30 (10): 1138-1154). In some cases, the donor DNA is delivered as reconstituted chromatin (Cruz-Becerra and Kadonaga (2020) eLife 2020; 9:e55780 DOI: 10.7554/eLife.55780).

In some cases, the ends of the donor DNA are protected (e.g., from exonucleolytic degradation) by any convenient method and such methods are known to those of skill in the art. For example, one or more dideoxynucleotide residues can be added to the 3' terminus of a linear molecule and/or self complementary oligonucleotides can be ligated to one or both ends. See, for example, Chang et al. (1987) Proc. Natl. Acad Sci USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues. As an alternative to protecting the termini of a linear donor DNA, additional lengths of sequence may be included outside of the regions of homology that can be degraded without impacting recombination.

Linkers

In some embodiments, the Cas12a polypeptides are coupled to one or more accessory functions by a linker. Such accessory functions can include deaminases, nucleases, reverse transcriptases, and recombinases. One or more gRNAs directed to such promoters or enhancers may also be provided to direct the binding of the Cas12a polypeptide to such promoters or enhancers. The term linker as used in reference to a fusion protein refers to a molecule which joins the proteins to form a fusion protein. Generally, such molecules have no specific biological activity other than to join or to preserve some minimum distance or other spatial relationship between the proteins. However, in one embodiment, the linker may be selected to influence some property of the linker and/or the fusion protein such as the folding, net charge, or hydrophobicity of the linker.

Suitable linkers for use in the methods of the present invention are well known to those of skill in the art and include, but are not limited to, straight or branched-chain carbon linkers, heterocyclic carbon linkers, or peptide linkers. However, as used herein the linker may also be a covalent bond (carbon-carbon bond or carbon-heteroatom bond). In particular embodiments, the linker is used to separate the Cas12a polypeptide and an accessory protein (e.g., a nucleotide deaminase) by a distance sufficient to ensure that each protein retains its required functional property. Preferred peptide linker sequences adopt a flexible extended conformation and do not exhibit a propensity for developing an ordered secondary structure. In one embodiment, the linker can be a chemical moiety which can be monomeric, dimeric, multimeric or polymeric. Preferably, the linker comprises amino acids. Typical amino acids in flexible linkers include Gly, Asn and Ser.

Accordingly, in particular embodiments, the linker comprises a combination of one or more of Gly, Asn and Ser amino acids. Other near neutral amino acids, such as Thr and Ala, also may be used in the linker sequence. Exemplary linkers are disclosed in Maratea et al. (1985), Gene 40: 39-46; Murphy et al. (1986) Proc. Nat'l. Acad. Sci. USA 83: 8258-62; U.S. Pat. No. 4,935,233; and U.S. Pat. No. 4,751, 180. For example, GlySer linkers may be based on repeating units of GGS, i.e., up to 2, 3, 4, 5, 6, 7, 8, 9, 10, 11 or even 12 or more repeating units, including but not limited to:

| SEQ ID | Description | Sequence |
|---|---|---|
|  | GlySer linker based on GGS repeating unit | GGS |
| 1552 | GlySer linker based on GGS repeating unit | GGS GGS |
| 1554 | GlySer linker based on GGS repeating unit | GGS GGS GGS |

| SEQ ID | Description | Sequence |
|---|---|---|
| 1555 | GlySer linker based on GGS repeating unit | GGS GGS GGS GGS |
| 1556 | GlySer linker based on GGS repeating unit | GGS GGS GGS GGS GGS |
| 1557 | GlySer linker based on GGS repeating unit | GGS GGS GGS GGS GGS GGS |
| 1558 | GlySer linker based on GGS repeating unit | GGS GGS GGS GGS GGS GGS GGS |
| 1559 | GlySer linker based on GGS repeating unit | GGS GGS GGS GGS GGS GGS GGS GGS |
| 1553 | GlySer linker based on GGS repeating unit | GGS GGS GGS GGS GGS GGS GGS GGS GGS |
| 1403 | GlySer linker based on GGS repeating unit | GGS GGS GGS GGS GGS GGS GGS GGS GGS GGS |
| 1404 | GlySer linker based on GGS repeating unit | GGS GGS GGS GGS GGS GGS GGS GGS GGS GGS GGS |
| 1405 | GlySer linker based on GGS repeating unit | GGS GGS GGS GGS GGS GGS GGS GGS GGS GGS GGS GGS |
| 1406 | GlySer linker based on GGS repeating unit | GGS GGS GGS GGS GGS GGS GGS GGS GGS GGS GGS GGS GGS |
| 1407 | GlySer linker based on GGS repeating unit | GGS GGS GGS GGS GGS GGS GGS GGS GGS GGS GGS GGS GGS GGS |
| 1408 | GlySer linker based on GGS repeating unit | GGS GGS GGS GGS GGS GGS GGS GGS GGS GGS GGS GGS GGS GGS GGS |

In another example, GlySer linkers may be based on repeating units of GSG, i.e., up to 2, 3, 4, 5, 6, 7, 8, 9, 10, 11 or even 12 or more repeating units, including but not limited to:

| SEQ ID | Description | Sequence |
|---|---|---|
|  | GlySer linker based on GSG repeating unit | GSG |
| 1409 | GlySer linker based on GSG repeating unit | GSG GSG |
| 1410 | GlySer linker based on GSG repeating unit | GSG GSG GSG |
| 1411 | GlySer linker based on GSG repeating unit | GSG GSG GSG GSG |

| SEQ ID | Description | Sequence |
|---|---|---|
| 1412 | GlySer linker based on GSG repeating unit | GSG GSG GSG GSG GSG |
| 1413 | GlySer linker based on GSG repeating unit | GSG GSG GSG GSG GSG GSG |
| 1414 | GlySer linker based on GSG repeating unit | GSG GSG GSG GSG GSG GSG GSG GSG |
| 1415 | GlySer linker based on GSG repeating unit | GSG GSG GSG GSG GSG GSG GSG GSG GSG |
| 1416 | GlySer linker based on GSG repeating unit | GSG GSG GSG GSG GSG GSG GSG GSG GSG GSG |
| 1417 | GlySer linker based on GSG repeating unit | GSG GSG GSG GSG GSG GSG GSG GSG GSG GSG GSG |
| 1418 | GlySer linker based on GSG repeating unit | GSG GSG GSG GSG GSG GSG GSG GSG GSG GSG GSG GSG |
| 1419 | GlySer linker based on GSG repeating unit | GSG GSG GSG GSG GSG GSG GSG GSG GSG GSG GSG GSG GSG |
| 1420 | GlySer linker based on GSG repeating unit | GSG GSG GSG GSG GSG GSG GSG GSG GSG GSG GSG GSG GSG GSG |
| 1421 | GlySer linker based on GSG repeating unit | GSG GSG GSG GSG GSG GSG GSG GSG GSG GSG GSG GSG GSG GSG GSG |

In yet another example, GlySer linkers may be based on repeating units of GGGS, i.e., up to 2, 3, 4, 5, 6, 7, 8, 9, 10, 11 or even 12 or more repeating units, including but not limited to:

| SEQ ID | Description | Sequence |
|---|---|---|
| 1422 | GlySer linker based on GGGS repeating unit | GGGS |
| 1423 | GlySer linker based on GGGS repeating unit | GGGS GGGS |
| 1424 | GlySer linker based on GGGS repeating unit | GGGS GGGS GGGS |
| 1425 | GlySer linker based on GGGS repeating unit | GGGS GGGS GGGS GGGS |
| 1426 | GlySer linker based on GGGS repeating unit | GGGS GGGS GGGS GGGS GGGS |
| 1427 | GlySer linker based on GGGS repeating unit | GGGS GGGS GGGS GGGS GGGS GGGS |

| SEQ ID | Description | Sequence |
|---|---|---|
| 1428 | GlySer linker based on GGGS repeating unit | GGGS GGGS GGGS GGGS GGGS GGGS GGGS |
| 1429 | GlySer linker based on GGGS repeating unit | GGGS GGGS GGGS GGGS GGGS GGGS GGGS GGGS |
| 1430 | GlySer linker based on GGGS repeating unit | GGGS GGGS GGGS GGGS GGGS GGGS GGGS GGGS GGGS |
| 1431 | GlySer linker based on GGGS repeating unit | GGGS GGGS GGGS GGGS GGGS GGGS GGGS GGGS GGGS GGGS |
| 1432 | GlySer linker based on GGGS repeating unit | GGGS GGGS GGGS GGGS GGGS GGGS GGGS GGGS GGGS GGGS GGGS |
| 1433 | GlySer linker based on GGGS repeating unit | GGGS GGGS GGGS GGGS GGGS GGGS GGGS GGGS GGGS GGGS GGGS GGGS |
| 1434 | GlySer linker based on GGGS repeating unit | GGGS GGGS GGGS GGGS GGGS GGGS GGGS GGGS GGGS GGGS GGGS GGGS GGGS |
| 1435 | GlySer linker based on GGGS repeating unit | GGGS GGGS GGGS GGGS GGGS GGGS GGGS GGGS GGGS GGGS GGGS GGGS GGGS GGGS |
| 1436 | GlySer linker based on GGGS repeating unit | GGGS GGGS GGGS GGGS GGGS GGGS GGGS GGGS GGGS GGGS GGGS GGGS GGGS GGGS GGGS |

In still another example, GlySer linkers may be based on repeating units of GGGGS, i.e., up to 2, 3, 4, 5, 6, 7, 8, 9, 10, 11 or even 12 or more repeating units, including but not limited to:

| SEQ ID | Description | Sequence |
|---|---|---|
| 1437 | GlySer linker based on GGGGS repeating unit | GGGGS |
| 1438 | GlySer linker based on GGGGS repeating unit | GGGGS GGGGS |
| 1439 | GlySer linker based on GGGGS repeating unit | GGGGS GGGGS GGGGS |
| 1440 | GlySer linker based on GGGGS repeating unit | GGGGS GGGGS GGGGS GGGGS |
| 1441 | GlySer linker based on GGGGS repeating unit | GGGGS GGGGS GGGGS GGGGS GGGGS |
| 1442 | GlySer linker based on GGGGS repeating unit | GGGGS GGGGS GGGGS GGGGS GGGGS GGGGS |
| 1443 | GlySer linker based on GGGGS repeating unit | GGGGS GGGGS GGGGS GGGGS GGGGS GGGGS GGGGS |

| SEQ ID | Description | Sequence |
|---|---|---|
| 1444 | GlySer linker based on GGGGS repeating unit | GGGGS GGGGS GGGGS GGGGS GGGGS GGGGS GGGGS GGGGS |
| 1445 | GlySer linker based on GGGGS repeating unit | GGGGS GGGGS GGGGS GGGGS GGGGS GGGGS GGGGS GGGGS GGGGS |
| 1446 | GlySer linker based on GGGGS repeating unit | GGGGS GGGGS GGGGS GGGGS GGGGS GGGGS GGGGS GGGGS GGGGS GGGGS |
| 1447 | GlySer linker based on GGGGS repeating unit | GGGGS GGGGS GGGGS GGGGS GGGGS GGGGS GGGGS GGGGS GGGGS GGGGS GGGGS |
| 1448 | GlySer linker based on GGGGS repeating unit | GGGGS GGGGS GGGGS GGGGS GGGGS GGGGS GGGGS GGGGS GGGGS GGGGS GGGGS GGGGS |
| 1449 | GlySer linker based on GGGGS repeating unit | GGGGS GGGGS GGGGS GGGGS GGGGS GGGGS GGGGS GGGGS GGGGS GGGGS GGGGS GGGGS GGGGS |
| 1450 | GlySer linker based on GGGGS repeating unit | GGGGS GGGGS GGGGS GGGGS GGGGS GGGGS GGGGS GGGGS GGGGS GGGGS GGGGS GGGGS GGGGS GGGGS |
| 1451 | GlySer linker based on GGGGS repeating unit | GGGGS GGGGS GGGGS GGGGS GGGGS GGGGS GGGGS GGGGS GGGGS GGGGS GGGGS GGGGS GGGGS GGGGS GGGGS |

In yet a further embodiment, LEPGEKPYKCPECGKSFSQSGALTRHQRTHTR (SEQ ID NO: 1452) is used as a linker.

In yet an additional embodiment, the linker is an XTEN linker, which is TCGGGATCTGAGACGCCTGGGACCTCGGAATCGGCTACGCCCGAAAGT (SEQ ID NO: 1453). In particular embodiments, the Cas12a polypeptide is linked to the deaminase protein or its catalytic domain by means of an LEPGEKPYKCPECGKSFSQSGALTRHQRTHTR LEPGEKPYKCPECGKSFSQSGALTRHQRTHTR (SEQ ID NO: 1454) linker. In further particular embodiments, Cas12a polypeptide is linked C-terminally to the N-terminus of a deaminase protein or its catalytic domain by means of an LEPGEKPYKCPECGKSFSQSGALTRHQRTHTRLEPGEKPYKCPECGKSFSQSGALTRHQRT HTRLEPGEKPYKCPECGKSFSQSGALTRHQRTHTR (SEQ ID NO: 1455) linker. In addition, N- and C-terminal NLSs can also function as linker (e.g., PKKKRKVEASSPKKKRKVEAS (SEQ ID NO: 1456)).

The above description of linkers is intended to be non-limiting and includes any combinations of the above linkers or heterologous combinations of repeating GlySer linkers.

The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminoHEXAnoic acid (Ahx). In certain embodiments, the linker is based on a carbocyclic moiety (e.g., cyclopentane, cycloHEXAne). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

The linker can be, for example, a cleavable linker or protease-sensitive linker. In some embodiments, the linker is selected from the group consisting of F2A linker, P2A linker, T2A linker, E2A linker, and combinations thereof. This family of self-cleaving peptide linkers, referred to as 2A peptides, has been described in the art (see for example, Kim, J. H. et al. (2011) PLoS ONE 6:e18556). In some embodiments, the linker is an F2A linker. In some embodiments, the linker is a GGGS linker (SEQ ID NO:1422). In some embodiments, the fusion protein contains three domains with intervening linkers, having the structure: domain-linker-domain-linker-domain.

Cleavable linkers known in the art may be used in connection with the disclosure. Exemplary such linkers include: F2A linkers, T2A linkers, P2A linkers, E2A linkers (See, e.g., WO2017127750). The skilled artisan will appreciate that other art-recognized linkers may be suitable for use in the constructs of the disclosure (e.g., encoded by the nucleic acids of the disclosure). The skilled artisan will likewise appreciate that other polycistronic constructs (mRNA encoding more than one nucleobase editing system component/polypeptide separately within the same molecule) may be suitable for use as provided herein.

Nuclear Localization Domains

In various embodiments, the gene editing systems or any of the components thereof may fused to one or more nuclear localization sequences (NLSs), such as about or more than about 1, 2, 3, 4, 5, 6, 7, 8, 9, 10, or more NLSs. In one embodiment, a gene editor component (e.g., a nucleic acid programmable DNA binding protein or an editing accessory protein) comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In an embodiment of the invention, an editor component polypeptide comprises at most 6 NLSs. In one embodiment, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Nonlimiting examples of NLSs include an NLS sequence derived from: the NLS of the SV40 virus large T-antigen, having the amino acid sequence PKKKRKV (SEQ ID NO: 1550); the NLS from nucleoplasmin (e.g. the nucleoplasmin bipartite NLS with the sequence KRPAATKKAGQAKKKK (SEQ ID NO:1457); the c-myc NLS having the amino acid sequence PAAKRVKLD (SEQ ID NO:1458) or RQRRNELKRSP (SEQ ID NO:1459); the hRNPA1 M9 NLS having the sequence NQSSNFGPMKGGNFG-GRSSGPYGGGGQYFAKPRNQGGY (SEQ ID NO: 1460); the sequence RMRIZFKNKGKDTAELRRRRVEVS-VELRKAKKDEQILKRRNV (SEQ ID NO: 1461) of the IBB domain from importin-alpha; the sequences VSRKR-PRP (SEQ ID NO: 1548) and PPKKARED (SEQ ID NO: 1462) of the myoma T protein; the sequence PQPKKKPL (SEQ ID NO: 1463) of human p53; the sequence SALIK-KKKKMAP (SEQ ID NO: 1464) of mouse c-abl IV; the sequences DRLRR (SEQ ID NO: 1465) and PKQKKRK (SEQ ID NO: 1466) of the influenza virus ns 1; the sequence RKLKKKIKKL (SEQ ID NO: 1467) of the Hepatitis virus delta antigen; the sequence REKKKFLKRR (SEQ ID NO: 1468) of the mouse Mx1 protein; the sequence KRKGDEVDGVDEVAKKKSKK (SEQ ID NO: 1469) of the human poly(ADP-ribose) polymerase; and the sequence RI<CLQAGMNLEARI<TI<I< (SEQ ID NO: 1470) of the steroid hormone receptors (human) glucocorticoid.

In general, the one or more NLSs are of sufficient strength to drive accumulation of the Cas12a polypeptide (or an NLS-modified accessory protein, or an NLS-modified chimera comprising a Cas12a protein and an accessory protein) in a detectable amount in the nucleus of a eukaryotic cell. In general, strength of nuclear localization activity may derive from the number of NLSs in the Cas12a polypeptide, the particular NLS(s) used, or a combination of these factors. Detection of accumulation in the nucleus may be performed by any suitable technique.

For example, a detectable marker may be fused to the Cas12a polypeptide, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of complex formation (e.g., assay for DNA cleavage or mutation at the target sequence, or assay for altered gene expression activity affected by complex formation and/or Cas12a polypeptide activity), as compared to a control no exposed to the Cas12a polypeptide or complex, or exposed to a Cas12a polypeptide lacking the one or more NLSs. In one embodiment of the herein described Cas12a polypeptide protein complexes and systems the codon optimized Cas12a polypeptide proteins comprise an NLS attached to the C-terminal of the protein. In one embodiment, other localization tags may be fused to the Cas12a polypeptide, such as without limitation for localizing the Cas12a polypeptide to particular sites in a cell, such as organelles, such as mitochondria, plastids, chloroplast, vesicles, golgi, (nuclear or cellular) membranes, ribosomes, nucleolus, ER, cytoskeleton, vacuoles, centrosome, nucleosome, granules, centrioles, etc.

In one embodiment of the invention, at least one nuclear localization signal (NLS) is attached to the nucleic acid sequences encoding the Cas12a polypeptide. In preferred embodiments at least one or more C-terminal or N-terminal NLSs are attached (and hence nucleic acid molecule(s) coding for the Cas12a polypeptide can include coding for NLS(s) so that the expressed product has the NLS(s) attached or connected). In a preferred embodiment a C-terminal NLS is attached for optimal expression and nuclear targeting in eukaryotic cells, preferably human cells. The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein.

In other examples, the fusion proteins comprising Cas12a and another accessory protein (e.g., RT) contains one or more nuclear localization signals is selected or derived from SV40, c-Myc or NLP-1.

The NLS examples above are non-limiting. The Cas12a fusion proteins contemplated herein may comprise any known NLS sequence, including any of those described in Cokol et al., "Finding nuclear localization signals," EMBO Rep., 2000, 1(5): 411-415 and Freitas et al., "Mechanisms and Signals for the Nuclear Import of Proteins," Current Genomics, 2009, 10(8): 550-7, each of which are incorporated herein by reference.

Tag Domains

In some embodiments, Cas12a editing system or a component thereof may comprise a polypeptide tag, such as an affinity tag (chitin binding protein (CBP), maltose binding protein (MBP), glutathione-S-transferase (GST), SBP-tag, Strep-tag, AviTag, Calmodulin-tag); solubilization tag; chromatography tag (polyanionic amino acid tag, such as FLAG-tag); epitope tag (short peptide sequences that bind to high-affinity antibodies, such as V5-tag, Myc-tag, VSV-tag, Xpress tag, E-tag, S-tag, and HA-tag); fluorescence tag (e.g., GFP). In some embodiments, the Cas12a editing system peptide may comprise an amino acid tag, such as one or more lysines, histidines, or glutamates, which can be added to the polypeptide sequences (e.g., at the N-terminal or C-terminal ends). Lysines can be used to increase peptide solubility or to allow for biotinylation. Protein and amino acid tags are peptide sequences genetically grafted onto a recombinant protein. Sequence tags are attached to proteins for various purposes, such as peptide purification, identification, or localization, for use in various applications including, for example, affinity purification, protein array, western blotting, immunofluorescence, and immunoprecipitation. Such tags are subsequently removable by chemical agents or by enzymatic means, such as by specific proteolysis or intein splicing.

Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

Aptamers

In particular embodiments, the nucleic acid components (e.g., guide RNA) of the Cas12a editing systems may further comprise a functional structure designed to improve nucleic acid component molecule structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green fluorescent protein (Paige, Jeremy S., Karen Y. Wu, and Sarnie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, in particular embodiments, a Cas12a gene editing nucleic acid component is modified, e.g., by one or more aptamer(s) designed to improve RNA or DNA component molecule delivery, including delivery across the cellular membrane, to intracellular compartments, or into the nucleus. Such a structure can include, either in addition to the one or more aptamer(s) or without such one or more aptamer(s), moiety(ies) so as to render the nucleic acid component molecule deliverable, inducible or responsive to a selected effector. The invention accordingly comprehends a reRNA component molecule that responds to normal or pathological physiological conditions, including without limitation pH, hypoxia, oxygen concentration, temperature, protein concentration, enzymatic concentration, lipid structure, light exposure, mechanical disruption (e.g. ultrasound waves), magnetic fields, electric fields, or electromagnetic radiation.

Agents that Modulate DNA-Repair

In certain embodiments, the engineered Cas12a gene editing systems described herein (e.g., an engineered nucleic acid construct or engineered nucleic acid-enzyme construct described herein) further comprises or encodes a DNA-repair modulating biomolecule, which may further enhance the efficiency of integration of a transgene on the heterologous nucleic acid by homology dependent repair (HDR).

In certain embodiments, the DNA-repair modulating biomolecule comprises a Nonhomologous end joining (NHEJ) inhibitor.

In certain embodiments, the DNA-repair modulating biomolecule comprises a homologous directed repair (HDR) promoter.

In certain embodiments, the DNA-repair modulating biomolecule comprises a NHEJ inhibitor and an HDR promoter.

In certain embodiments, the DNA-repair modulating biomolecule enhances or improves more precise genome editing and/or the efficiency of homologous recombination, compared to the otherwise identical embodiment without the DNA-repair modulating biomolecule.

HDR promoters and/or NHEJ inhibitors can, in some embodiments, comprise one or more small molecules. Systems bearing recombination enhancers such as small molecules that activate HDR and suppress NHEJ locally at the genomic site of the DNA damage can be tailored in their placement on the engineered systems to further enhance their efficiency. In general, the small molecule recombination enhancers can be synthesized to bear linkers and a functional group, such as maleimide for reacting with a thiol group on a Cys residue of a protein, for chemical conjugation to the engineered systems. Use of commercially available functionalized PEG linkers (alkyne, azide, cyclooctyne etc.) can also be employed for conjugation, and orthogonal conjugation chemistries can be utilized for the multivalent display.

Conjugation sites can be readily identified where modifications do not affect the potency of the recombination enhancers selected.

In certain embodiments, multivalent display of one or more DNA-repair modulating biomolecule can be effected, including multiple moieties of NHEJ inhibitors, HDR promoters, or a combination thereof. See, for example, "Genomic targeting of epigenetic probes using a chemically tailored Cas9 system" by Liszczak et al., *Proc Natl Acad Sci U.S.A.* 114: 681-686, 2017 (incorporated herein by reference). In certain embodiments, multivalent display of small molecule compounds can be achieved through sortase loop proteins used as a scaffold for their display.

In some embodiments, the DNA-repair modulating biomolecule may comprise an HDR promoter. The HDR promoter may comprise small molecules, such as RSI or analogs thereof. In certain embodiments, the HDR promoter stimulates RAD51 activity or RAD52 motif protein 1 (RDM1) activity. In certain embodiments, the HDR promoter comprises Nocodazole, which can result in higher HDR selection.

In certain embodiments, the HDR promoter may be administered prior to the delivery of the engineered Type V systems described herein.

In certain embodiments, the HDR promoter locally enhances HDR without NHEJ inhibition. For example, RAD51 is a protein involved in strand exchange and the search for homology regions during HDR repair. In certain embodiments, the HDR promoter is phenylbenzamide RSI, identified as a small-molecule RAD51-stimulator (see WO2019/135816 at [0200]-[0204], specifically incorporated herein by reference).

In certain embodiments, the DNA-repair modulating biomolecule comprises C-terminal binding protein interacting protein (CtIP) or a functional fragment or homolog thereof. CtIP is a key protein in early steps of homologous recombination. According to this embodiment, the CtIP or the functional fragment or homolog thereof can be linked (e.g., fused) to the RT or the sequence-specific nuclease (e.g., a CRISPR/Cas effector enzyme, a ZFN, a TALEN, a meganuclease, TnpB, IscB, or a restriction endonuclease (RE)), and stimulates transgene integration by HDR.

In certain embodiments, the CtIP fragment is a minimal N-terminal fragment of the wild-type CtIP, such as the N-terminal fragment comprising residues 1-296 of the full-length CtIP (the HE for HDR enhancer), as described in Charpentier et al. (Nature Comm., DOI: 10.1038/s41467-018-03475-7, incorporated herein by reference), shown to be sufficient to stimulate HDR. The activity of the fragment depends on CDK phosphorylation sites (e.g., S233, T245, and S276) and the multimerization domain essential for CtIP activity in homologous recombination. Thus alternative fragments comprising the CDK phosphorylation sites and the multimerization domain essential for CtIP activity are also within the scope of the invention.

In certain embodiments, the DNA-repair modulating biomolecule comprises a dominant negative 53BP1.

In certain embodiments, the DNA-repair modulating biomolecule comprises a cell cycle-specific degradation tag, such as the degradation domain of the (human) Geminin, and the (murine) CyclinB2.

In certain embodiments, the DNA-repair modulating biomolecule comprises CyclinB2, a member of the B-type cyclins that associate with p34cdc2, and an essential component of the cell cycle regulatory machinery. CRISPR-mediated knock-in efficiency may be increased by promoting the relative increase in Cas9 activity in G2 phase of the cell cycle, when HDR is more active. In certain embodiments, the degradation domains of the (human) Geminin and (murine) CyclinB2 can be used as either N- or C-terminal fusion to serve as the DNA-repair modulating biomolecule. These domains are known to determine a cell-cycle specific profile of chimeric proteins, namely an increase in their relative concentration in S and G2 compared to G1, highjacking the conventional CyclinB2 and Geminin degradation pathways. This produces active Geminin-Cas9 and CyclinB2-Cas9 chimeric proteins, which are degraded in a cell-cycle-dependent manner. Such chimeras shift the repair of the DSBs to the HDR repair pathway compared to the commonly used Cas9.

While not wishing to be bound by particular theory, it is believed that the application of such cell cycle-specific degradation tags permits/promotes more efficient/secure gene editing.

In certain embodiments, the DNA-repair modulating biomolecule comprises a Rad family member protein, such as Rad50, Rad51, Rad52, etc., which functions to promote foreign DNA integration into a host chromosome. Specifically, Rad52 is an important homologous recombinant protein, and its complex with Rad51 plays a key role in HDR, mainly involved in the regulation of foreign DNA in eukaryotes. Key steps in the process of HR include repair mediated by Rad51 and strand exchange. Co-expression of Rad52 as a DNA-repair modulating biomolecule significantly enhances the likelihood of HDR by, e.g., three-fold.

In certain embodiments, the DNA-repair modulating biomolecule comprises a RAD52 protein as, e.g., either an N- or a C-terminal fusion.

In certain embodiments, the DNA-repair modulating biomolecule comprises a RAD52 motif protein 1 (RDM1) that functions similarly as RAD52. RDM1 has been shown to be able to repair DSBs caused by DNA replication, prevent G2 or M cell cycle arrest, and improve HDR selection.

In certain embodiments, the DNA-repair modulating biomolecule comprises a dominant negative version of the tumor suppressor p53-binding protein 1 (53BP1). The wild-type protein 53BP1 is a key regulator of the choice between NHEJ and HDR—it is a pro-NHEJ factor which limits HDR by blocking DNA end resection, and also by inhibiting BRCA1 recruitment to DSB sites. It has been shown that global inhibition of 53BP1 by a ubiquitin variant significantly improves Cas9-mediated HDR frequency in non-hematopoietic and hematopoietic cells with single-strand oligonucleotide delivery or double-strand donor in AAV.

In certain embodiments, the dominant negative (DN) version of the 53BP1 comprises the minimal focus forming region, but lacks domains outside this region, e.g., towards the N-terminus and tandem C-terminal BRCT repeats that recruit key effectors involved in NHEJ, such as RIF1-PTIP and EXPAND, respectively. The 53BP1 adapter protein is recruited to specific histone marks at sites of DSBs via this minimal focus forming region, which comprises several conserved domains including an oligomerization domain (OD), a glycine-arginine rich (GAR) motif, a Tudor domain, and an adjacent ubiquitin-dependent recruitment (UDR) motif. The Tudor domain mediates interactions with histone H4 dimethylated at K2023.

In certain embodiments, a dominant negative version of 53BP1 (DN1S) suppresses the accumulation of endogenous 53BP1 and downstream NHEJ proteins at sites of DNA damage, while upregulating the recruitment of the BRCA1 HDR protein. Such a DN version of the 53BP1 can be used as the DNA-repair modulating biomolecule, either as an N- or a C-terminal fusion (such as a Cas9 fusion, to locally inhibit NHEJ at the Cas9-target site defined by its gRNA, while promoting an increase in HDR, and does not globally affect NHEJ, thereby improving cell viability).

In certain embodiments, the DNA-repair modulating biomolecule comprises an NHEJ inhibitor, such as an inhibitor of DNA ligase IV, a KU inhibitor (e.g., KU70 or KU80), a DNA-PKc inhibitor, or an artemis inhibitor.

In certain embodiments, the NHEJ inhibitor inhibits the NHEJ pathway, enhances HDR, or modulates both. In certain embodiments, the NHEJ inhibitor is a small molecule inhibitor.

In certain embodiments, the small molecule inhibitor of the NHEJ pathway comprises an SCR7 analog, for example, PK66, PK76, PK409.

In certain embodiments, the NHEJ inhibitor comprises a KU inhibitor, for example, KU5788, and KU0060648.

In certain embodiments, a small molecule NHEJ inhibitor is linked to a polyglycine tripeptide through PEG for sortase-mediated ligation, as described in WO2019/135816, Guimaraes et al., *Nat Protoc* 8:1787-99, 2013; Theile et al., *Nat Protoc* 8:1800-7, 2013; and Schmohl et al., *Curr Opin Chem Biol* 22:122-8, 2014 (all incorporated herein by reference). The same means can also be used for attaching small molecule HDR enhancers to protein.

An exemplary method for conjugating a small molecule DNA-repair modulating biomolecule without loss of activity is described in WO2019135816, where SCR-7 conjugation of a poly-glycine peptide with the para-carboxylic moiety at ring 4 retained activity of the inhibitor, with rings 1, 2 and 3 of the molecule having involvement in the target-engagement, providing a simple and effective strategy to ligate a small molecule NHEJ inhibitor to the system described herein (e.g., to the sequence-specific nuclease including Cas enzymes, or to the RT) to precisely enhance HDR pathway near a nucleic acid target site.

In certain embodiments, a nucleic acid targeting moiety conjugates based on small molecule inhibitor of DNA-dependent protein kinase (DNA-PK) or heterodimeric Ku (KU70/KU80) can be utilized. KU-0060648 is one potent KU-inhibitors, which can also be functionalized with poly-glycine and used for recombination enhancement.

In certain embodiments, the DNA-repair modulating biomolecule comprises the Tumor Suppressor p53. p53 plays a direct role in DNA repair, including HR regulation, where it affects the extension of new DNA, thereby affecting HDR selection. In vivo, p53 binds to the nuclear matrix and is a rate-limiting factor in repairing DNA structure. p53 regulates DNA repair processes in almost all eukaryotes via transactivation-dependent and -independent pathways, but only the transactivation-independent function of p53 is involved in HR regulation. Wild-type p53 protein can link double stranded breaks to form intact DNA, as well as also playing a role in inhibiting NHEJ. p53 interacts with HR-related proteins, including Rad51, where it controls HR through direct interaction with Rad51.

Accessory Domains

In other aspects, the Cas12a-based gene editing systems may comprise one or more additional accessory proteins having genome modifying functions, including recombinases, invertases, nucleases, polymerases, ligases, deaminases, reverse transcriptases, or epigenetic modifying functions. In various embodiments, the accessory proteins may be provided separately. In other embodiments, the accessory proteins may be fused to Cas12a, optionally with a linker.

The Cas12a-based gene editing systems may further comprise additional polypeptides polypeptides, proteins and/or peptides known in the art. Non-limiting categories of polypeptides include antigens, antibodies, antibody fragments, cytokines, peptides, hormones, enzymes, oxidants, antioxidants, synthetic polypeptides, and chimeric polypeptides, receptor, enzymes, hormones, transcription factors, ligands, membrane transporters, structural proteins, nucleases, or a component, variant or fragment (e.g., a biologically active fragment) thereof.

As used herein, the term "peptide" generally refers to shorter polypeptides of about 50 amino acids or less. Peptides with only two amino acids may be referred to as "dipeptides." Peptides with only three amino acids may be referred to as "tripeptides." Polypeptides generally refer to polypeptides with from about 4 to about 50 amino acids. Peptides may be obtained via any method known to those skilled in the art. In some embodiments, peptides may be expressed in culture. In some embodiments, peptides may be obtained via chemical synthesis (e.g., solid phase peptide synthesis).

In some embodiments, the RNA payloads (e.g., linear and/or circular mRNA payloads encoding one or more encoded products of interest or the non-coding RNAs such as guide RNAs) may encode a user-programmable DNA binding protein, or a gene editor accessory proteins, such as, but not limited to a deaminases, nucleases, transposases, polymerases, and reverse transcriptases, etc.

In some embodiments, the RNA payloads (e.g., linear and/or circular mRNA payloads encoding one or more encoded products of interest), e.g., the originator constructs and benchmark constructs described herein, may encode a simple protein associated with a non-protein. Non-limiting examples of conjugated proteins include, glycoproteins, hemoglobins, lecithoproteins, nucleoproteins, and phosphoproteins.

In some embodiments, the RNA payloads (e.g., linear and/or circular mRNA payloads encoding one or more encoded products of interest), e.g., the originator constructs and benchmark constructs described herein, may encode a protein that is derived from a simple or conjugated protein by chemical or physical means. Non-limiting examples of derived proteins include denatured proteins and peptides.

In some embodiments, the polypeptide, protein or peptide may be unmodified.

In some embodiments, the polypeptide, protein or peptide may be modified. Types of modifications include, but are not limited to, phosphorylation, glycosylation, acetylation, ubiquitylation/sumoylation, methylation, palmitoylation, quinone, amidation, myristoylation, pyrrolidone carboxylic acid, hydroxylation, phosphopantetheine, prenylation, GPI anchoring, oxidation, ADP-ribosylation, sulfation, S-nitrosylation, citrullination, nitration, gamma-carboxyglutamic acid, formylation, hypusine, topaquinone (TPQ), bromination, lysine topaquinone (LTQ), tryptophan tryptophylquinone (TTQ), iodination, and cysteine tryptophylquinone (CTQ). In some aspects, the polypeptide, protein or peptide may be modified by a post-transcriptional modification which can affect its structure, subcellular localization, and/or function.

In some embodiments, the polypeptide, protein or peptide may be modified using phosphorylation. Phosphorylation, or the addition of a phosphate group to serine, threonine, or tyrosine residues, is one of most common forms of protein modification. Protein phosphorylation plays an important role in fine tuning the signal in the intracellular signaling cascades.

In some embodiments, the polypeptide, protein or peptide may be modified using ubiquitination which is the covalent attachment of ubiquitin to target proteins. Ubiquitination-mediated protein turnover has been shown to play a role in driving the cell cycle as well as in protein-degradation-independent intracellular signaling pathways.

In some embodiments, the polypeptide, protein or peptide may be modified using acetylation and methylation which can play a role in regulating gene expression. As a non-limiting example, the acetylation and methylation could mediate the formation of chromatin domains (e.g., euchromatin and heterochromatin) which could have an impact on mediating gene silencing.

In some embodiments, the polypeptide, protein or peptide may be modified using glycosylation. Glycosylation is the attachment of one of a large number of glycan groups and is a modification that occurs in about half of all proteins and plays a role in biological processes including, but not limited to, embryonic development, cell division, and regulation of protein structure. The two main types of protein glycosylation are N-glycosylation and O-glycosylation. For N-glycosylation the glycan is attached to an asparagine and for O-glycosylation the glycan is attached to a serine or threonine.

In some embodiments, the polypeptide, protein or peptide may be modified using sumoylation. Sumoylation is the addition of SUMOs (small ubiquitin-like modifiers) to proteins and is a post-translational modification similar to ubiquitination.

In other embodiments, the RNA payloads (e.g., linear and/or circular mRNA payloads encoding one or more encoded products of interest), e.g., the originator constructs and benchmark constructs described herein, may encode a therapeutic protein, such as those exemplified below.

In other embodiments, the RNA payloads (e.g., linear and/or circular mRNA payloads encoding one or more products of interest), e.g., the originator constructs and benchmark constructs described herein, may encode a gene editing system, such as those exemplified herein. As used herein, a "nucleobase editing system" is a protein, DNA, or RNA composition capable of making edits, modifications or alterations to one or more targeted genes of interest. According to the present invention, one or more nucleobase editing system currently being marketed or in development may be encoded by the RNA payloads (e.g., linear and/or circular mRNA payloads encoding one or more encoded products of interest) described herein of the present invention.

Inducibility Modifications

In one embodiment, a Cas12a polypeptide may form a component of an inducible gene editing system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc.), or light inducible systems (Phytochrome, LOV domains, or cryptochrome). In one embodiment, the Cas12a polypeptide may be a part of a Light Inducible Transcriptional Effector (LITE) to direct changes in transcriptional activity in a sequence-specific manner. The components of a light may include a Cas12a polypeptide, a light-responsive cytochrome heterodimer (e.g. from *Arabidopsis thaliana*), and a transcriptional activation/repression domain. Further examples of inducible DNA binding proteins and methods for their use are provided in U.S. Provisional Application Nos. 61/736,465 and U.S. 61/721,283, and International Patent Publication No. WO 2014/018423 A2 which is hereby incorporated by reference in its entirety.

Once all copies of a gene in the genome of a cell have been edited, continued expression of the system in that cell is no longer necessary. Indeed, sustained expression would be undesirable in case of off-target effects at unintended genomic sites, etc. Thus time-limited expression would be useful. Inducible expression offers one approach, but in addition Applicants have engineered a self-inactivating system that relies on the use of a non-coding nucleic acid component molecule target sequence within the vector itself. Thus, after expression begins, the system will lead to its own destruction, but before destruction is complete it will have time to edit the genomic copies of the target gene (which, with a normal point mutation in a diploid cell, requires at most two edits). Simply, the self-inactivating system includes additional RNA (e.g., nucleic acid component molecule) that targets the coding sequence for the Cas12a polypeptide itself or that targets one or more non-coding nucleic acid component molecule target sequences complementary to unique sequences present in one or more of the following: (a) within the promoter driving expression of the non-coding RNA elements, (b) within the promoter driving expression of the Cas12a polypeptide gene, (c) within 100 bp of the ATG translational start codon in the Cas12a polypeptide coding sequence, (d) within the inverted terminal repeat (iTR) of a viral delivery vector, e.g., in the AAV genome.

In some aspects, a single nucleic acid component molecule is provided that is capable of hybridization to a sequence downstream of a Cas12a polypeptide start codon, whereby after a period of time there is a loss of the Cas12a polypeptide expression. In some aspects, one or more nucleic acid component molecule(s) are provided that are capable of hybridization to one or more coding or non-coding regions of the polynucleotide encoding the system, whereby after a period of time there is a inactivation of one or more, or in some cases all, of the system. In some aspects of the system, and not to be limited by theory, the cell may comprise a plurality of complexes, wherein a first subset of complexes comprise a first nucleic acid component molecule capable of targeting a genomic locus or loci to be edited, and a second subset of complexes comprise at least one second nucleic acid component molecule capable of targeting the polynucleotide encoding the system, wherein the first subset of complexes mediate editing of the targeted genomic locus or loci and the second subset of complexes eventually inactivate the system, thereby inactivating further expression in the cell.

The various coding sequences (Cas12a polypeptide and nucleic acid component molecule) can be included on a single vector or on multiple vectors. For instance, it is possible to encode the enzyme on one vector and the various RNA sequences on another vector, or to encode the enzyme and one nucleic acid component molecule on one vector, and the remaining nucleic acid component molecule on another vector, or any other permutation. In general, a system using a total of one or two different vectors is preferred.

Optional Editing System Formats

In various embodiments, the Cas12a-based gene editing systems may comprise one or more additional accessory proteins having genome modifying functions, including recombinases, invertases, nucleases, polymerases, ligases, deaminases, reverse transcriptases, or epigenetic modifying functions. In various embodiments, the accessory proteins may be provided separately. In other embodiments, the accessory proteins may be fused to Cas12a, optionally with a linker.

Cas12a (Cas Type V) Base Editor Format

In some embodiments, the Cas12a-based gene editing system is combined with one or more deaminases to produce a base editor. In some embodiments, the deaminase is fused, optionally via a linker, to a component of the Cas12a-based gene editing system. For example, the deaminase might be coupled or fused to a Cas12a domain via a linker.

Base editing was first described in Komor et al., "Programmable editing of a target base in genomic DNA without double-stranded DNA cleavage," Nature, May 19, 2016, 533 (7603); pp. 420-424 in the form of cytosine base editors or CBEs followed by the disclosure of Gaudelli et al., "Programmable base editing of A-T to G-C in genomic DNA without DNA cleavage," Nature, Vol. 551, pp. 464-471 describing adenine base editors or ABEs. Subsequently, base editing has been described in numerous scientific publications, including, but not limited to (i) Kim J S. Precision genome engineering through adenine and cytosine base editing. Nat Plants. 2018 March; 4(3):148-151. doi: 10.1038/s41477-018-0115-z. Epub 2018 Feb. 26. PMID: 29483683.; (ii) Wei Y, Zhang X H, Li D L. The "new favorite" of gene editing technology-single base editors. Yi Chuan. 2017 Dec. 20; 39(12):1115-1121. doi: 10.16288/j.yczz.17-389. PMID: 29258982; (iii) Tang J, Lee T, Sun T. Single-nucleotide editing: From principle, optimization to application. Hum Mutat. 2019 December; 40(12):2171-2183. doi: 10.1002/humu.23819. Epub 2019 Sep. 15. PMID: 31131955; PMCID: PMC6874907; (iv) Grunewald J, Zhou R, Lareau C A, Garcia S P, Iyer S, Miller B R, Langner L M, Hsu J Y, Aryee M J, Joung J K. A dual-deaminase CRISPR base editor enables concurrent adenine and cytosine editing. Nat Biotechnol. 2020 July; 38(7):861-864. doi: 10.1038/s41587-020-0535-y. Epub 2020 Jun. 1. PMID: 32483364; PMCID: PMC7723518; (v) Sakata R C, Ishiguro S, Mori H, Tanaka M, Tatsuno K, Ueda H, Yamamoto S, Seki M, Masuyama N, Nishida K, Nishimasu H, Arakawa K, Kondo A, Nureki O, Tomita M, Aburatani H, Yachie N. Base editors for simultaneous introduction of C-to-T and A-to-G mutations. Nat Biotechnol. 2020 July; 38(7):865-869. doi: 10.1038/s41587-020-0509-0. Epub 2020 Jun. 2. Erratum in: Nat Biotechnol. 2020 Jun. 5; PMID: 32483365; (vi) Fan J, Ding Y, Ren C, Song Z, Yuan J, Chen Q, Du C, Li C, Wang X, Shu W. Cytosine and adenine deaminase base-editors induce broad and nonspecific changes in gene expression and splicing. Commun Biol. 2021 Jul. 16; 4(1):882. doi: 10.1038/s42003-021-02406-5. PMID: 34272468; PMCID: PMC8285404; (vii) Zhang S, Yuan B, Cao J, Song L, Chen J, Qiu J, Qiu Z, Zhao X M, Chen J, Cheng T L. TadA orthologs enable both cytosine and adenine editing of base editors. Nat Commun. 2023 Jan. 26; 14(1):414. doi: 10.1038/s41467-023-36003-3. PMID: 36702837; PMCID: PMC988000; and (viii) Zhang S, Song L, Yuan B, Zhang C, Cao J, Chen J, Qiu J, Tai Y, Chen J, Qiu Z, Zhao X M, Cheng T L. TadA reprogramming to generate potent miniature base editors with high precision. Nat Commun. 2023 Jan. 26; 14(1):413. doi: 10.1038/s41467-023-36004-2. PMID: 36702845; PMCID: PMC987999, each of which are incorporated herein by reference in their entireties.

Amino acid and nucleotide sequences of base editors, including adenosine base editors, cytidine base editors, and others are readily available in the art. For example, exemplary base editors that may be delivered using the LNP compositions described herein can be found in the following published patent applications, each of their contents (including any and all biological sequences) are incorporated herein by reference:

US 2023/0021641 A1 CAS9 VARIANTS HAVING NON-CANONICAL PAM SPECIFICITIES AND USES THEREOF

U.S. Pat. No. 11,542,496 B2 CYTOSINE TO GUANINE BASE EDITOR

U.S. Pat. No. 11,542,509 B2 INCORPORATION OF UNNATURAL AMINO ACIDS INTO PROTEINS USING BASE EDITING

US 2022/0315906 A1 BASE EDITORS WITH DIVERSIFIED TARGETING SCORE

US 2022/0282275 A1 G-TO-T BASE EDITORS AND USES THEREOF

US 2022/0249697 A1 AAV DELIVERY OF NUCLEOBASE EDITORS

Base editing does not require double-stranded DNA breaks or a DNA donor template. In some embodiments, base editing comprises creating an SSB in a target double-stranded DNA sequence and then converting a nucleobase. In some embodiments, the nucleobase conversion is an adenosine to a guanine. In some embodiments, the nucleobase conversion is a thymine to a cytosine. In some embodiments, the nucleobase conversion is a cytosine to a thymine. In some embodiments, the nucleobase conversion is a guanine to an adenosine. In some embodiments, the nucleobase conversion is an adenosine to inosine. In some embodiments, the nucleobase conversion is a cytosine to uracil.

A base editing system comprises a base editor which can convert a nucleobase. The base editor ("BE") comprises a partially inactive Cas12a protein which is connected to a deaminase that precisely and permanently edits a target nucleobase in a polynucleotide sequence. A base editor comprises a polynucleotide programmable nucleotide binding domain and a nucleobase editing domain (e.g., adenosine deaminase or cytosine deaminase). In some embodiments, the partially inactive Cas12a protein is a Cas12a nickase. In some embodiments, the partially inactive Cas protein is a Cas12a nickase (also referred to as "nCas12a").

A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleobase and bases of the target polynucleotide sequence) and thereby localize the nucleobase editor to the target polynucleotide sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

In certain embodiments, polynucleotide programmable nucleotide binding domains also include nucleobase programmable proteins that bind RNA. In certain embodiments, the polynucleotide programmable nucleotide binding domain can be associated with a nucleobase that guides the polynucleotide programmable nucleotide binding domain to an RNA.

Cas12a (Cas Type V) CBEs

In some embodiments, the Cas12a base editors contemplated herein may comprise a deaminase domain that is a cytidine deaminase domain. A cytidine deaminase domain may also be referred to interchangeably as a cytosine deaminase domain. In some embodiments, the cytidine deaminase catalyzes the hydrolytic deamination of cytidine (C) or deoxycytidine (dC) to uridine (U) or deoxyuridine (dU), respectively. In some embodiments, the cytidine deaminase domain catalyzes the hydrolytic deamination of cytosine (C) to uracil (U). In some embodiments, the cytidine deaminase catalyzes the hydrolytic deamination of cytidine or cytosine in deoxyribonucleic acid (DNA). Without wishing to be bound by any particular theory, fusion proteins comprising a cytidine deaminase are useful inter alia for targeted editing, referred to herein as "base editing," of nucleic acid sequences in vitro and in vivo.

One exemplary suitable type of cytidine deaminase is a cytidine deaminase, for example, of the APOBEC family. The apolipoprotein B mRNA-editing complex (APOBEC) family of cytidine deaminase enzymes encompasses eleven proteins that serve to initiate mutagenesis in a controlled and beneficial manner (see, e.g., Conticello S G. The AID/APOBEC family of nucleic acid mutators. Genome Biol. 2008; 9(6):229). One family member, activation-induced cytidine deaminase (AID), is responsible for the maturation of antibodies by converting cytosines in ssDNA to uracils in a transcription-dependent, strand-biased fashion (see, e.g., Reynaud C A, et al. What role for AID: mutator, or assembler of the immunoglobulin mutasome, Nat Immunol. 2003; 4(7):631-638). The apolipoprotein B editing complex 3 (APOBEC3) enzyme provides protection to human cells against a certain HIV-1 strain via the deamination of cytosines in reverse-transcribed viral ssDNA (see, e.g., Bhagwat A S. DNA-cytosine deaminases: from antibody maturation to antiviral defense. DNA Repair (Amst). 2004; 3(1):85-89).

Some aspects of this disclosure relate to the recognition that the activity of cytidine deaminase enzymes such as APOBEC enzymes can be directed to a specific site in genomic DNA. Without wishing to be bound by any particular theory, advantages of using a nucleic acid programmable binding protein (e.g., a Cas9 domain) as a recognition agent include (1) the sequence specificity of nucleic acid programmable binding protein (e.g., a Cas9 domain) can be easily altered by simply changing the sgRNA sequence; and (2) the nucleic acid programmable binding protein (e.g., a Cas9 domain) may bind to its target sequence by denaturing the dsDNA, resulting in a stretch of DNA that is single-stranded and therefore a viable substrate for the deaminase. It should be understood that other catalytic domains of napDNAbps, or catalytic domains from other nucleic acid editing proteins, can also be used to generate fusion proteins with Cas9, and that the disclosure is not limited in this regard.

In some embodiments, the cytidine deaminase is an apolipoprotein B mRNA-editing complex (APOBEC) family deaminase. In some embodiments, the cytidine deaminase is an APOBEC1 deaminase. In some embodiments, the cytidine deaminase is an APOBEC2 deaminase. In some embodiments, the cytidine deaminase is an APOBEC3 deaminase. In some embodiments, the cytidine deaminase is an APOBEC3A deaminase. In some embodiments, the cytidine deaminase is an APOBEC3B deaminase. In some embodiments, the cytidine deaminase is an APOBEC3C deaminase. In some embodiments, the cytidine deaminase is an APOBEC3D deaminase. In some embodiments, the cytidine deaminase is an APOBEC3E deaminase. In some embodiments, the cytidine deaminase is an APOBEC3F deaminase. In some embodiments, the cytidine deaminase is an APOBEC3G deaminase. In some embodiments, the cytidine deaminase is an APOBEC3H deaminase. In some embodiments, the cytidine deaminase is an APOBEC4 deaminase. In some embodiments, the cytidine deaminase is an activation-induced deaminase (AID). In some embodiments, the cytidine deaminase is a vertebrate cytidine deaminase. In some embodiments, the cytidine deaminase is an invertebrate cytidine deaminase. In some embodiments, the cytidine deaminase is a human, chimpanzee, gorilla, monkey, cow, dog, rat, or mouse deaminase. In some embodiments, the cytidine deaminase is a human cytidine deaminase. In some embodiments, the cytidine deaminase is a rat cytidine deaminase, e.g., rAPOBEC1.

In some embodiments, the nucleic acid editing domain is at least 80%, at least 85%, at least 90%, at least 92%, at least 95%, at least 96%, at least 97%, at least 98%, at least 99%, or at least 99.5% identical to any of the cytidine deaminase domain examples above.

Cas12a (Cas Type V) ABEs

In other embodiments, the Cas12a base editors contemplated herein may comprise a deaminase domain that is an adenosine deaminase domain. The disclosure provides fusion proteins that comprise one or more adenosine deaminases. In some aspects, such fusion proteins are capable of deaminating adenosine in a nucleic acid sequence (e.g., DNA or RNA). As one example, any of the fusion proteins provided herein may be base editors, (e.g., adenine base editors). Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminases. In some embodiments, any of the fusion proteins provided herein comprise two adenosine deaminases. Exemplary, non-limiting, embodiments of adenosine deaminases are provided herein. It should be appreciated that the mutations provided herein (e.g., mutations in ecTadA) may be applied to adenosine deaminases in other adenosine base editors, for example those provided in U.S. Patent Publication No. 2018/0073012, published Mar. 15, 2018, which issued as U.S. Pat. No. 10,113,163, on Oct. 30, 2018; U.S. Patent Publication No. 2017/0121693, published May 4, 2017, which issued as U.S. Pat. No. 10,167,457 on Jan. 1, 2019; International Publication No. WO 2017/070633, published Apr. 27, 2017; U.S. Patent Publication No. 2015/0166980, published Jun. 18, 2015; U.S. Pat. No. 9,840,699, issued Dec. 12, 2017; and U.S. Pat. No. 10,077,453, issued Sep. 18, 2018, all of which are incorporated herein by reference in their entireties.

In some embodiments, any of the adenosine deaminases provided herein is capable of deaminating adenine. In some embodiments, the adenosine deaminases provided herein are capable of deaminating adenine in a deoxyadenosine residue of DNA. The adenosine deaminase may be derived from any suitable organism (e.g., *E. coli*). In some embodiments, the adenosine deaminase is a naturally-occurring adenosine deaminase that includes one or more mutations corresponding to any of the mutations provided herein (e.g., mutations in ecTadA). One of skill in the art will be able to identify the corresponding residue in any homologous protein and in the respective encoding nucleic acid by methods well known in the art, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

Any two or more of the adenosine deaminases described herein may be connected to one another (e.g. by a linker) within an adenosine deaminase domain of the fusion proteins provided herein. For instance, the fusion proteins provided herein may contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine deaminase is any of the adenosine deaminases provided herein, but is not identical to the first adenosine deaminase. In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker.

In some embodiments, the base editor comprises a deaminase enzyme. In some embodiments, the base editor comprises a cytidine deaminase. In some embodiments, the base editor comprises a Cas9 protein fused to a cytidine deaminase enzyme. In some embodiments, the base editor comprises an adenosine deaminase. In some embodiments, the base editor comprises a Cas9 protein fused to an adenosine deaminase enzyme.

In some embodiments, the base editing system comprises an uracil glycosylase inhibitor. In some embodiments, the base editing system comprises a Cas9 protein fused to an uracil glycosylase inhibitor. In some embodiments, the cargo comprises an uracil glycosylase inhibitor or a polynucleotide encoding an uracil glycosylase inhibitor. In some embodiments, the cargo comprises a Cas9 protein fused to an uracil glycosylase inhibitor or a polynucleotide encoding a Cas9 protein fused to an uracil glycosylase inhibitor.

A variety of nucleobase modifying enzymes are suitable for use in the nucleobase systems disclosed herein. In some embodiments, the nucleobase modifying enzyme is a RNA base editor. In some embodiments, the RNA base editor can be a cytidine deaminase, which converts cytidine into uridine. Non-limiting examples of cytidine deaminases include cytidine deaminase 1 (CDA1), cytidine deaminase 2 (CDA2), activation-induced cytidine deaminase (AICDA), apolipoprotein B mRNA-editing complex (APOBEC) family cytidine deaminase (e.g., APOBEC1, APOBEC2, APOBEC3A, APOBEC3B, APOBEC3C, APOBEC3D/E, APOBEC3F, APOBEC3G, APOBEC3H, APOBEC4), APOBEC1 complementation factor/APOBEC1 stimulating factor (ACF1/ASF) cytidine deaminase, cytosine deaminase acting on RNA (CDAR), bacterial long isoform cytidine deaminase (CDDL), and cytosine deaminase acting on tRNA (CDAT). In other embodiments, the RNA base editor can be an adenosine deaminase, which converts adenosine into inosine, which is read by polymerase enzymes as guanosine. In certain embodiments, adenosine deaminases include tRNA adenine deaminase, adenosine deaminase, adenosine deaminase acting on RNA (ADAR), and adenosine deaminase acting on tRNA (ADAT).

In some embodiments, in the nucleobase editing systems disclosed herein, the Cas effector may associate with one or more functional domains (e.g., via fusion protein or suitable linkers). In some embodiments, the effector domain comprises one or more cytindine or nucleotide deaminases that mediate editing of via hydrolytic deamination. In certain embodiments, the effector domain comprises the adenosine deaminase acting on RNA (ADAR) family of enzymes. In certain embodiments, the adenosine deaminase protein or catalytic domain thereof capable of deaminating adenosine or cytidine in RNA or is an RNA specific adenosine deaminase and/or is a bacterial, human, cephalopod, or *Drosophila* adenosine deaminase protein or catalytic domain thereof, preferably TadA, more preferably ADAR, optionally huADAR, optionally (hu)ADAR1 or (hu)ADAR2, preferably huADAR2 or catalytic domain thereof.

In some embodiments, the cytidine deaminase is a human, rat or lamprey cytidine deaminase. In some embodiments, the cytidine deaminase is an apolipoprotein B mRNA-editing complex (APOBEC) family deaminase, an activation-induced deaminase (AID), or a cytidine deaminase 1 (CDA1).

In certain embodiments, the adenosine deaminase is adenosine deaminase acting on RNA (ADAR). In certain embodiments, the ADAR is ADAR (ADAR1), ADARB1 (ADAR2) or ADARB2 (ADAR3) (see, e.g., Savva et al. Genon. Biol. 2012, 13(12):252).

In some embodiments, the gene editing system comprises AID/APOBEC (apolipoprotein B editing complex) family of enzymes deaminates cytidine to uridine, leading to mutations in RNA and DNA.

In some embodiments, the nucleobase editing system comprises ADAR and an antisense oligonucleotide. In certain embodiments, the antisense oligonucleotide is chemically optimized antisense oligonucleotide. In certain embodiments, the antisense oligonucleotide is administered for the nucleobase editing, wherein the antisense oligonucleotide activates human endogenous ADAR for nucleobase editing. Such ADAR and antisense oligonucleotide editing system provides a safer site-directed RNA editing with low off-target effect. See, e.g., Merkle et al., Nature Biotechnology, 2019, 37, 133-138.

Any of the above base editor embodiments or variants, modifications, or derivatives thereof are contemplated herein to be delivered by the LNP systems disclosed in this specification for gene editing in cells, tissues, and/or organs under in vitro, ex vivo, or in vivo conditions. The various components described herein may be configured and delivered in any suitable manner. Any of the descriptions presented in this section are not intended to be strictly limiting.

Cas12a (Cas Type V) Prime Editor Format

In other embodiments, the Cas12a-based gene editing system is combined with one or more reverse transcriptases to produce a prime editor when used in connection with a specialized guide RNA called a prime editing guide RNA ("pegRNA"). In some embodiments, the reverse transcriptase is fused, optionally via a linker, to a component of the Cas12a-based gene editing system. For example, the reverse transcriptase might be coupled or fused to a Cas12a domain via a linker.

Prime editing technology is a gene editing technology that can make targeted insertions, deletions, and all transversion and transition point mutations in a target genome. Without wishing to be bound by any particular theory, the prime editing process may search and replace endogenous sequences in a target polynucleotide. The spacer sequence of a prime editing guide RNA ("PEgRNA" or "pegRNA") recognizes and anneals with a search target sequence in a target strand of a double stranded target polynucleotide, e.g., a double stranded target DNA. A prime editing complex may generate a nick in the target DNA on the edit strand which is the complementary strand of the target strand. The prime editing complex may then use a free 3' end formed at the nick site of the edit strand to initiate DNA synthesis, where a "primer binding site sequence" (PBS) of the PEgRNA complexes with the free 3' end, and a single stranded DNA is synthesized (by reverse transcriptase) using an editing template of the PEgRNA as a template. As used herein, a "primer binding site" is a single-stranded portion of the PEgRNA that comprises a region of complementarity to the PAM strand (i.e., the non-target strand or the edit strand). The PBS is complementary or substantially complementary to a sequence on the PAM strand of the double stranded target DNA that is immediately upstream of the nick site.

The term "prime editor (PE)" refers to the polypeptide or polypeptide components involved in prime editing, or any polynucleotide(s) encoding the polypeptide or polypeptide components. In various embodiments, a prime editor includes a polypeptide domain having DNA binding activity and a polypeptide domain having DNA polymerase activity. In some embodiments, the prime editor further comprises a polypeptide domain having nuclease activity. In some embodiments, the polypeptide domain having DNA binding activity comprises a nuclease domain or nuclease activity. In some embodiments, the polypeptide domain having nuclease activity comprises a nickase, or a fully active nuclease. As used herein, the term "nickase" refers to a nuclease capable of cleaving only one strand of a double-stranded DNA target. In some embodiments, the prime editor comprises a polypeptide domain that is an inactive nuclease. In some embodiments, the polypeptide domain having programmable DNA binding activity comprises a nucleic acid guided DNA binding domain, for example, a CRISPR-Cas protein, for example, a Cas9 nickase, a Cpf1 nickase, or another CRISPR-Cas nuclease. In some embodiments, the polypeptide domain having DNA polymerase activity comprises a template-dependent DNA polymerase, for example, a DNA-dependent DNA polymerase or an RNA-dependent DNA polymerase. In some embodiments, the DNA polymerase is a reverse transcriptase. In some embodiments, the prime editor comprises additional polypeptides involved in prime editing, for example, a polypeptide domain having 5' endonuclease activity, e.g., a 5' endogenous DNA flap endonucleases (e.g., FEN1), for helping to drive the prime editing process towards the edited product formation. In some embodiments, the prime editor further comprises an RNA-protein recruitment polypeptide, for example, a MS2 coat protein.

A prime editor may be engineered. In some embodiments, the polypeptide components of a prime editor do not naturally occur in the same organism or cellular environment. In some embodiments, the polypeptide components of a prime editor may be of different origins or from different organisms. In some embodiments, a prime editor comprises a DNA binding domain and a DNA polymerase domain that are derived from different species. In some embodiments, a prime editor comprises a Cas polypeptide (DNA binding domain) and a reverse transcriptase polypeptide (DNA polymerase) that are derived from different species. For example, a prime editor may comprise a S. pyogenes Cas9 polypeptide and a Moloney murine leukemia virus (M-MLV) reverse transcriptase polypeptide.

In some embodiments, polypeptide domains of a prime editor may be fused or linked by a peptide linker to form a fusion protein. In other embodiments, a prime editor comprises one or more polypeptide domains provided in trans as separate proteins, which are capable of being associated to each other through non-peptide linkages or through aptamers or recruitment sequences. For example, a prime editor may comprise a DNA binding domain and a reverse transcriptase domain associated with each other by an RNA-protein recruitment aptamer, e.g., a MS2 aptamer, which may be linked to a PEgRNA. Prime editor polypeptide components may be encoded by one or more polynucleotides in whole or in part. In some embodiments, a single polynucleotide, construct, or vector encodes the prime editor fusion protein. In some embodiments, multiple polynucleotides, constructs, or vectors each encode a polypeptide domain or portion of a domain of a prime editor, or a portion of a prime editor fusion protein. For example, a prime editor fusion protein may comprise an N-terminal portion fused to an intein-N and a C-terminal portion fused to an intein-C, each of which is individually encoded by an AAV vector.

The editing template may comprise one or more intended nucleotide edits compared to the endogenous double stranded target DNA sequence. Accordingly, the newly synthesized single stranded DNA also comprises the nucleotide edit(s) encoded by the editing template. Through removal of the editing target sequence on the edit strand of the double stranded target DNA and DNA repair mechanism, the newly synthesized single stranded DNA replaces the editing target sequence, and the desired nucleotide edit(s) are incorporated into the double stranded target DNA.

Prime editing was first described in Anzalone et al., "Search-and-replace genome editing without double-strand breaks or donor DNA," Nature, December 2019, 576 (7789): pp. 149-157, which is incorporated herein in its entirety. Prime editing has subsequently been described and detailed in numerous follow-on publications, including, for example, (i) Liu et al., "Prime editing: a search and replace tool with versatile base changes," Yi Chuan, Nov. 20, 2022, 44(11): 993-1008; (ii) Lu C et al., "Prime Editing: An All-Rounder for Genome Editing. Int J Mol Sci. 2022 Aug. 30; 23(17):9862; (iii) Velimirovic M, Zanetti L C, Shen M W, Fife J D, Lin L, Cha M, Akinci E, Barnum D, Yu T, Sherwood R I. Peptide fusion improves prime editing efficiency. Nat Commun. 2022 Jun. 18; 13(1):3512. doi: 10.1038/s41467-022-31270-y. PMID: 35717416; PMCID: PMC9206660; (iv) Velimirovic M, Zanetti L C, Shen M W, Fife J D, Lin L, Cha M, Akinci E, Barnum D, Yu T, Sherwood R I. Peptide fusion improves prime editing efficiency. Nat Commun. 2022 Jun. 18; 13(1):3512. doi: 10.1038/s41467-022-31270-y. PMID: 35717416; PMCID: PMC9206660; (v) Habib O, Habib G, Hwang G H, Bae S. Comprehensive analysis of prime editing outcomes in human embryonic stem cells. Nucleic Acids Res. 2022 Jan. 25; 50(2):1187-1197. doi: 10.1093/nar/gkab1295. PMID: 35018468; PMCID: PMC8789035; (vi) Marzec M, Brgszewska-Zalewska A, Hensel G. Prime Editing: A New Way for Genome Editing. Trends Cell Biol. 2020 April; 30(4):257-259. doi: 10.1016/j.tcb.2020.01.004. Epub 2020 Jan. 27. PMID: 32001098; (vii) Tao R, Wang Y, Jiao Y, Hu Y, Li L, Jiang L, Zhou L, Qu J, Chen Q, Yao S. Bi-PE: bi-directional priming improves CRISPR/Cas9 prime editing in mammalian cells. Nucleic Acids Res. 2022 Jun. 24; 50(11):6423-6434. doi: 10.1093/nar/gkac506. PMID: 35687127; PMCID: PMC9226529; (viii) Nelson J W, Randolph P B, Shen S P, Everette K A, Chen P J, Anzalone A V, An M, Newby G A, Chen J C, Hsu A, Liu D R. Engineered pegRNAs improve prime editing efficiency. Nat Biotechnol. 2022 March; 40(3):402-410. doi: 10.1038/s41587-021-01039-7. Epub 2021 Oct. 4. Erratum in: Nat Biotechnol. 2021 Dec. 8; PMID: 34608327; PMCID: PMC8930418; (ix) Doman J L, Sousa A A, Randolph P B, Chen P J, Liu D R. Designing and executing prime editing experiments in mammalian cells. Nat Protoc. 2022 November; 17(11):2431-2468. doi: 10.1038/s41596-022-00724-4. Epub 2022 Aug. 8. PMID: 35941224; PMCID: PMC9799714; (x) Jiao Y, Zhou L, Tao R, Wang Y, Hu Y, Jiang L, Li L, Yao S. Random-PE: an efficient integration of random sequences into mammalian genome by prime editing. Mol Biomed. 2021 Nov. 18; 2(1):36. doi: 10.1186/s43556-021-00057-w. PMID: 35006470; PMCID: PMC8607425; and (xi) Awan M J A, Ali Z, Amin I, Mansoor S. Twin prime editor: seamless repair without damage. Trends Biotechnol. 2022 April; 40(4):374-376. doi: 10.1016/j.tibtech.2022.01.013. Epub 2022 Feb. 10. PMID: 35153078, all of which are incorporated herein by reference.

In addition, prime editing has been described and disclosed in numerous published patent applications, each of which their entire contents, amino acid sequences, nucleotide sequences, and all disclosures therein are incorporated herein by reference in their entireties:

| Publication No. | Publication Date | Title |
|---|---|---|
| WO 2023/015309 A2 | Feb. 9, 2023 | IMPROVED PRIME EDITORS AND METHODS OF USE |
| WO 2023/004439 A2 | Jan. 26, 2023 | GENOME EDITING COMPOSITIONS AND METHODS FOR TREATMENT OF CHRONIC GRANULOMATOUS DISEASE |
| WO 2023/288332 A2 | Jan. 19, 2023 | GENOME EDITING COMPOSITIONS AND METHODS FOR TREATMENT OF WILSON'S DISEASE |
| WO 2023/283092 A1 | Jan. 12, 2023 | COMPOSITIONS AND METHODS FOR EFFICIENT GENOME EDITING |
| WO 2023/283246 A1 | Jan. 12, 2023 | MODULAR PRIME EDITOR SYSTEMS FOR GENOME ENGINEERING |
| WO 2022/256714 A3 | Jan. 12, 2023 | GENOME EDITING COMPOSITIONS AND METHODS FOR TREATMENT OF WILSON'S DISEASE |
| EP 4107273 A1 | Dec. 28, 2022 | PRIME EDITING TECHNOLOGY FOR PLANT GENOME ENGINEERING |
| WO 2022/256714 A2 | Dec. 8, 2022 | GENOME EDITING COMPOSITIONS AND METHODS FOR TREATMENT OF WILSON'S DISEASE |
| WO 2022/234051 A1 | Nov. 10, 2022 | SPLIT PRIME EDITING ENZYME |
| US 2022/0356469 A1 | Nov. 10, 2022 | METHODS AND COMPOSITIONS FOR EDITING NUCLEOTIDE SEQUENCES METHODS AND COMPOSITIONS FOR EDITING NUCLEOTIDE SEQUENCES |
| WO 2022/206352 A1 | Oct. 6, 2022 | PRIME EDITING TOOL, FUSION RNA, AND USE THEREOF |
| WO 2022/212926 A1 | Oct. 6, 2022 | METHODS AND COMPOSITIONS FOR EDITING NUCLEOTIDE SEQUENCES |
| WO 2022/204476 A1 | Sept. 29, 2022 | NUCLEOTIDE EDITING TO REFRAME DMD TRANSCRIPTS BY BASE EDITING AND PRIME EDITING |
| WO 2022/203905 A1 | Sept. 29, 2022 | PRIME EDITING-BASED SIMULTANEOUS GENOMIC DELETION AND INSERTION |
| US 11447770 B1 | Sept. 20, 2022 | Methods and compositions for prime editing nucleotide sequences |
| WO 2022/174829 A1 | Aug. 25, 2022 | EDITING OF DOUBLE-STRANDED DNA WITH RELAXED PAM REQUIREMENT FIELD OF THE DISCLOSURE |
| WO 2022/170058 A1 | Aug. 11, 2022 | PRIME EDITOR SYSTEM FOR IN VIVO GENOME EDITING |
| WO 2022/169235 A1 | Aug. 11, 2022 | PRIME EDITING COMPOSITION WITH IMPROVED EDITING EFFICIENCY |
| WO 2022/150790 A3 | Aug. 11, 2022 | PRIME EDITOR VARIANTS, CONSTRUCTS, AND METHODS FOR ENHANCING PRIME EDITING EFFICIENCY AND PRECISION |
| WO 2022/149166 A1 | Jul. 14, 2022 | A COCKTAIL FORMULATION FOR SELECTIVE ENRICHMENT OF GENE-MODIFIED CELLS |
| WO 2022/150790 A2 | Jul. 14, 2022 | PRIME EDITOR VARIANTS, CONSTRUCTS, AND METHODS FOR ENHANCING PRIME EDITING EFFICIENCY AND PRECISION |
| US 11384353 B2 | Jul. 12, 2022 | Inhibition of unintended mutations in gene editing |
| WO 2022/067130 A3 | Jun. 23, 2022 | PRIME EDITING GUIDE RNAS, COMPOSITIONS THEREOF, AND METHODS OF USING THE SAME |
| WO 2022/114815 A1 | Jun. 2, 2022 | COMPOSITION FOR PRIME EDITING COMPRISING TRANS-SPLICING ADENO-ASSOCIATED VIRUS VECTOR |
| WO 2022/100662 A1 | May 19, 2022 | GENOMIC EDITING OF IMPROVED EFFICIENCY AND ACCURACY |
| WO 2022/098765 A1 | May 12, 2022 | SPLIT PRIME EDITING PLATFORMS |
| WO 2022/098885 A1 | May 12, 2022 | PRECISE GENOME DELETION AND REPLACEMENT METHOD BASED ON PRIME EDITING |
| WO 2022/071745 A1 | Apr. 7, 2022 | PRIME EDITING USING HIV REVERSE TRANSCRIPTASE AND CAS9 OR VARIANT THEREOF |
| WO 2022/067130 A2 | Mar. 31, 2022 | PRIME EDITING GUIDE RNAS, COMPOSITIONS THEREOF, AND METHODS OF USING THE SAME |
| WO 2022/065689 A1 | Mar. 31, 2022 | PRIME EDITING-BASED GENE EDITING COMPOSITION WITH ENHANCED EDITING EFFICIENCY AND USE THEREOF |
| US 2022/0064626 A1 | Mar. 3, 2022 | INHIBITION OF UNINTENDED MUTATIONS IN GENE EDITING |
| WO 2022/032085 A1 | Feb. 10, 2022 | TARGETED SEQUENCE INSERTION COMPOSITIONS AND METHODS |
| WO 2022/025623 A1 | Feb. 3, 2022 | SYSTEM AND METHOD FOR PRIME EDITING EFFICIENCY PREDICTION USING DEEP LEARNING |
| WO 2021/226558 A8 | Jan. 13, 2022 | METHODS AND COMPOSITIONS FOR SIMULTANEOUS EDITING OF BOTH STRANDS OF A TARGET DOUBLE-STRANDED NUCLEOTIDE SEQUENCE |

-continued

| Publication No. | Publication Date | Title |
|---|---|---|
| WO 2021/243289 A1 | Dec. 2, 2021 | SYSTEMS AND METHODS FOR STABLE AND HERITABLE ALTERATION BY PRECISION EDITING (SHAPE) |
| WO 2021/226558 A1 | Nov. 11, 2021 | METHODS AND COMPOSITIONS FOR SIMULTANEOUS EDITING OF BOTH STRANDS OF A TARGET DOUBLE-STRANDED NUCLEOTIDE SEQUENCE |
| WO 2021/215897 A1 | Oct. 28, 2021 | GENOME EDITION USING CAS9 OR CAS9 VARIANT |
| WO 2021/215827 A1 | Oct. 28, 2021 | GENOME EDITING USING CAS9 OR CAS9 VARIANT |
| WO 2020/191248 A8 | Oct. 21, 2021 | METHODS AND COMPOSITIONS FOR EDITING NUCLEOTIDE SEQUENCES |
| WO 2020/191234 A8 | Oct. 21, 2021 | METHODS AND COMPOSITIONS FOR EDITING NUCLEOTIDE SEQUENCES |
| WO 2021/165508 A1 | Aug. 26, 2021 | PRIME EDITING TECHNOLOGY FOR PLANT GENOME ENGINEERING |
| WO 2021/138469 A1 | Jul. 8, 2021 | GENOME EDITING USING REVERSE TRANSCRIPTASE ENABLED AND FULLY ACTIVE CRISPR COMPLEXES |
| WO 2021/092204 A1 | May 14, 2021 | METHODS AND COMPOSITIONS FOR NUCLEIC ACID-GUIDED NUCLEASE CELL TARGETING SCREEN |
| WO 2021/076876 A1 | Apr. 22, 2021 | GENOTYPING EDITED MICROBIAL STRAINS |
| WO 2021/072328 A1 | Apr. 15, 2021 | METHODS AND COMPOSITIONS FOR PRIME EDITING RNA |
| WO 2020/191153 A8 | Dec. 30, 2020 | METHODS AND COMPOSITIONS FOR EDITING NUCLEOTIDE SEQUENCES |
| WO 2020/191153 A3 | Dec. 10, 2020 | METHODS AND COMPOSITIONS FOR EDITING NUCLEOTIDE SEQUENCES |
| WO 2020/191153 A9 | Nov. 12, 2020 | METHODS AND COMPOSITIONS FOR EDITING NUCLEOTIDE SEQUENCES |
| WO 2020/191171 A9 | Oct. 29, 2020 | METHODS AND COMPOSITIONS FOR EDITING NUCLEOTIDE SEQUENCES |
| WO 2020/191248 A1 | Sept. 24, 2020 | METHOD AND COMPOSITIONS FOR EDITING NUCLEOTIDE SEQUENCES |
| WO 2020/191239 A1 | Sept. 24, 2020 | METHODS AND COMPOSITIONS FOR EDITING NUCLEOTIDE SEQUENCES |
| WO 2020/191153 A2 | Sept. 24, 2020 | METHODS AND COMPOSITIONS FOR EDITING NUCLEOTIDE SEQUENCES |
| WO 2020/191246 A1 | Sept. 24, 2020 | METHODS AND COMPOSITIONS FOR EDITING NUCLEOTIDE SEQUENCES |
| WO 2020/191249 A1 | Sept. 24, 2020 | METHODS AND COMPOSITIONS FOR EDITING NUCLEOTIDE SEQUENCES |
| WO 2020/191233 A1 | Sept. 24, 2020 | METHODS AND COMPOSITIONS FOR EDITING NUCLEOTIDE SEQUENCES |
| WO 2020/191243 A1 | Sept. 24, 2020 | METHODS AND COMPOSITIONS FOR EDITING NUCLEOTIDE SEQUENCES |
| WO 2020/191234 A1 | Sept. 24, 2020 | METHODS AND COMPOSITIONS FOR EDITING NUCLEOTIDE SEQUENCES |
| WO 2020/191245 A1 | Sept. 24, 2020 | METHODS AND COMPOSITIONS FOR EDITING NUCLEOTIDE SEQUENCES |
| WO 2020/191242 A1 | Sept. 24, 2020 | METHODS AND COMPOSITIONS FOR EDITING NUCLEOTIDE SEQUENCES |
| WO 2020/191171 A1 | Sept. 24, 2020 | METHODS AND COMPOSITIONS FOR EDITING NUCLEOTIDE SEQUENCES |
| WO 2020/191241 A1 | Sept. 24, 2020 | METHODS AND COMPOSITIONS FOR EDITING NUCLEOTIDE SEQUENCES |
| WO 2020/156575 A1 | Aug. 6, 2020 | INHIBITION OF UNINTENDED MUTATIONS IN GENE EDITING |
| US 10189831 B2 | Jan. 29, 2019 | Non-nucleoside reverse transcriptase inhibitors |
| WO 2019/014564 A1 | Jan. 17, 2019 | SYSTEMS AND METHODS FOR TARGETED INTEGRATION AND GENOME EDITING AND DETECTION THEREOF USING INTEGRATED PRIMING SITES |
| US 10150955 B2 | Dec. 11, 2018 | Stabilized reverse transcriptase fusion proteins |
| WO 2018/049168 A1 | May 15, 2018 | HIGH-THROUGHPUT PRECISION GENOME EDITING |
| US 9783791 B2 | Oct. 10, 2017 | Mutant reverse transcriptase and methods of use |
| US 9458484 B2 | Oct. 4, 2016 | Reverse transcriptase mixtures with improved storage stability |

In some embodiments, the Cas12 based gene editing system is a prime editing system comprising a Cas12a domain (e.g., a nickase Cas12a domain) fused to a reverse transcriptase or a polynucleotide encoding such a prime editing system.

Prime editing is a versatile and precise genome editing method that directly writes new genetic information into a specified DNA site using a catalytically impaired Cas fused to an engineered reverse transcriptase, also referred to as a prime editor, which is programmable using a prime editing guide RNA ("pegRNA") that both specifies the target site and encodes the desired edit (see, e.g., Anzalone et al., Nature 2019). Prime editing bypasses the need for DNA donor templates by using a prime editor having nickase or catalytically impaired enzymatic activity.

A prime editing system comprises a prime editor. The prime editor ("PE") comprises a catalytically impaired Cas protein (e.g., a Cas12a) fused to an engineered reverse transcriptase which can precisely and permanently edit one or more target nucleobases in a target polynucleotide.

In some embodiments, the prime editor comprises an engineered Moloney murine leukemia virus ("M-MLV") reverse transcriptase ("RT") fused to a Cas-H840A nickase (called "PE2"). In some embodiments, the prime editor comprises an engineered M-MLV RT fused to a Cas9-H840A nickase. In some embodiments, the prime editor comprises an engineered M-MLV RT fused to a *Streptococcus pyogenes* Cas9 (spCas9)-H840A nickase. PE modifications include increased PAM flexibility to increase the utility of PE2 editing, expanding the coverage of targetable pathogenic variants in the ClinVar database that can now be prime edited to 94.4%.

In some embodiments, the prime editing system further comprises a prime editing guide RNA ("pegRNA"). In some embodiments, the cargo comprises a pegRNA or a polynucleotide encoding a pegRNA.

In some embodiments, the prime editing system further comprises a second guide RNA targeting the complementary strand, allowing the Cas9 nickase to also nick the non-edited strand (called "PE3"), which biases mismatch DNA repair in favor of the edited sequence. In some embodiments, the second guide RNA is designed to recognize the complementary strand of DNA only after the PE3 edit has occurred (called "PE3b"), which reduces indel formation.

In some embodiments, the prime editing system comprises an uracil glycosylase inhibitor. In some embodiments, the prime editing system comprises a Cas9 protein fused to an uracil glycosylase inhibitor. In some embodiments, the cargo comprises an uracil glycosylase inhibitor or a polynucleotide encoding an uracil glycosylase inhibitor. In some embodiments, the cargo comprises a Cas9 protein fused to an uracil glycosylase inhibitor or a polynucleotide encoding a Cas9 protein fused to an uracil glycosylase inhibitor.

Any of the above prime editor embodiments or variants, modifications, or derivatives thereof are contemplated herein to be delivered by the LNP systems disclosed in this specification for gene editing in cells, tissues, and/or organs under in vitro, ex vivo, or in vivo conditions. The various components described herein may be configured and delivered in any suitable manner. Any of the descriptions presented in this section are not intended to be strictly limiting.

Cas12a (Cas Type V) Retron Editor Format

In still other embodiments, the herein disclosed Cas12a gene editing system may comprise an engineered retron system. An engineered retron editing system in various embodiments may comprise (a) a retron reverse transcriptase, or a nucleic acid molecule encoding a retron reverse transcriptase, (b) a retron ncRNA (or a nucleic acid molecule encoding same) comprising a modified msd region to include a sequence that is reverse transcribed to form a single strand template DNA sequence (RT-DNA), (c) a Cas12a domain, and (d) a guide RNA to target the nuclease to a desired target site.

Retrons are defined by their unique ability to produce an unusual satellite DNA known as msDNA (multicopy single-stranded DNA). DNA encoding retrons includes a reverse trancriptase (RT)-coding gene (ret) and a nucleic acid sequence encoding the non-coding RNA (ncRNA), which contains two contiguous and inverted non-coding sequences referred to as the msr and msd. The ret gene and the non-coding RNA (including the msr and msd) are transcribed as a single RNA transcript, which becomes folded into a specific secondary structure following post-transcriptional processing. Once translated, the RT binds the RNA template downstream from the msd locus, initiating reverse transcription of the RNA towards its 5' end, assisted by the 2'OH group present in a conserved branching guanosine residue that acts as a primer. Reverse transcription halts before reaching the msr locus, and the resulting DNA, the msDNA, remains covalently attached to the RNA template via a 2'-5' phosphodiester bond and base-pairing between the 3' ends of the msDNA and the RNA template. The external regions, at the 5' and 3' ends of the msd/msr transcript (a1 and a2, respectively) are complementary and can hybridize, leaving the structures located in the msr and msd regions in internal positions. The msr locus, which is not reverse transcribed, forms one to three short stem-loops of variable size, ranging from 3 to 10 base pairs, whereas the msd locus folds into a single/double long hairpin with a highly variable long stem of 10-50 bp in length that is also present in the final msDNA form.

It has recently been reported that retrons may be utilized as a means to provide donor DNA template for HDR-dependent genome editing (e.g., see Lopez et al., "Precise genome editing across kingdoms of life using retron-derived DNA," *Nature Chemical Biology*, Dec. 12, 2021, 18, pages 199-206 (2022)), however, producing sufficient levels of donor DNA template intracellularly to sufficiently support efficient HDR-dependent editing remains a significant challenge.

Retrons have previously been described in the scientific literature, including in the context of retron editing. For example, retrons have been described in the following references, each of which are incorporated herein by reference:

| Title | Date Published | Journal Name | Author/s | Vol. | Start | End |
|---|---|---|---|---|---|---|
| Recording gene expression order in DNA by CRISPR addition of retron barcodes. | Jul. 27, 2022 | Nature | Santi Bhattarai-Kline; Sierra K Lear; Chloe B Fishman; Santiago C Lopez; Elana R Lockshin; Max G Schubert; Jeff Nivala; George M Church; Seth L Shipman | 608 | 217 | 225 |

| Title | Date Published | Journal Name | Author/s | Vol. | Start | End |
|---|---|---|---|---|---|---|
| Retrons Display Genome Editing Strengths Even CRISPR Might Envy | Jun. 1, 2021 | Genetic Engineering & Biotechnology News | | 41 | 15 | 15 |
| Retron reverse transcriptase termination and phage defense are dependent on host RNase H1. | Mar. 16, 2022 | Nucleic acids research | Christina Palka; Chloe B Fishman; Santi Bhattarai-Kline; Samuel A Myers; Seth L Shipman | 50 | 3490 | 3504 |
| Retrons: Complementing CRISPR in Phage Defense. | Aug. 1, 2020 | The CRISPR journal | Karen L. Maxwell | 3 | 226 | 227 |
| Systematic prediction of genes functionally associated with bacterial retrons and classification of the encoded tripartite systems. | Dec. 4, 2020 | Nucleic acids research | Mario Rodríguez Mestre; Alejandro González-Delgado; Luis I. Gutierrez-Rus; Francisco Martínez-Abarca; Nicolás Toro | 48 | 12632 | 12647 |
| Precise genome editing without exogenous donor DNA via retron editing system in human cells. | Aug. 17, 2021 | Protein & cell | Xiangfeng Kong; Zikang Wang; Renxia Zhang; Xing Wang; Yingsi Zhou; Linyu Shi; Hui Yang | 12 | 899 | 902 |
| Precise genome editing across kingdoms of life using retron-derived DNA. | Dec. 23, 2021 | Nature chemical biology | Santiago C Lopez; Kate D Crawford; Sierra K Lear; Santi Bhattarai-Kline; Seth L Shipman | 18 | 199 | 206 |
| Prokaryotic reverse transcriptases: from retroelements to specialized defense systems | May 13, 2021 | FEMS microbiology reviews | Alejandro González-Delgado; Mario Rodríguez Mestre; Francisco Martínez-Abarca; Nicolás Toro | 45 | | |
| A function for retrons. | Nov. 17, 2020 | Nature reviews. Microbiology | Grant Otto | 19 | 3 | 3 |
| Retrons and their applications in genome engineering. | Oct. 10, 2019 | Nucleic acids research | Anna J. Simon; Andrew D. Ellington; Ilya J. Finkelstein | 47 | 11007 | 11019 |
| High-efficiency retron-mediated single-stranded DNA production in plants. | Jan. 1, 2022 | Synthetic biology (Oxford, England) | Wenjun Jiang; Gundra Sivakrishna Rao; Rashid Aman; Haroon Butt; Radwa Kamel; Khalid Sedeek; Magdy M Mahfouz | 7 | ysac025 | |
| Bacterial retrons enable precise gene editing in human cells | Jan. 24, 2022 | The CRISPR journal | Zhao B; Chen Sa; Lee J; Hunter B. Fraser | 5 | 31 | 39 |
| Like CRISPR, mystery gene editor began as a virus fighter. | Nov. 20, 2020 | Science (New York, N.Y.) | Elizabeth Pennisi | 370 | 898 | 899 |
| Bacterial Retrons Function In Anti-Phage Defense. | Nov. 5, 2020 | Cell | Adi Millman; Aude Bernheim; Avigail Stokar-Avihail; Taya Fedorenko; Maya Voichek; Azita Leavitt; Yaara Oppenheimer-Shaanan; Rotem Sorek | 183 | 1551 | 1561 |

| Title | Date Published | Journal Name | Author/s | Vol. | Start | End |
|---|---|---|---|---|---|---|
| Multiplex generation, tracking, and functional screening of substitution mutants using a crispr/retron system | May 4, 2020 | ACS synthetic biology | Hyeonseob Lim; Soyeong Jun; Minjeong Park; Junghak Lim; Jaehwan Jeong; Ji Hyun Lee; Duhee Bang | 9 | 1003 | 1009 |
| Multiple origins of reverse transcriptases linked to CRISPR-Cas systems. | Jul. 11, 2019 | RNA biology | Nicolás Toro; Francisco Martínez-Abarca; Mario Rodríguez Mestre; Alejandro González-Delgado | 16 | 1486 | 1493 |
| Retroelement-Based Genome Editing and Evolution. | Oct. 26, 2018 | ACS synthetic biology | Anna J. Simon; Barrett R. Morrow; Andrew D. Ellington | 7 | 2600 | 2611 |

In addition, retrons have previously been described in the patent literature, including in the context of retron editing. For example, retrons have been described in the following references, each of which are incorporated herein by reference:

| Publication No. | TITLE |
|---|---|
| US 2020/0115706 A1 | METHOD OF RECORDING MULTIPLEXED BIOLOGICAL INFORMATION INTO A CRISPR ARRAY USING A RETRON |
| EP 3510151 A4 | HIGH-THROUGHPUT PRECISION GENOME EDITING |
| US 2019/0330619 A1 | HIGH-THROUGHPUT PRECISION GENOME EDITING |
| EP 3510151 A1 | HIGH-THROUGHPUT PRECISION GENOME EDITING |
| WO 2018/191525 A1 | METHOD OF RECORDING MULTIPLEXED BIOLOGICAL INFORMATION INTO A CRISPR ARRAY USING A RETRON |
| US 2018/0127759 A1 | DYNAMIC GENOME ENGINEERING |
| WO 2018/049168 A1 | HIGH-THROUGHPUT PRECISION GENOME EDITING |
| US 2017/0204399 A1 | GENOMICALLY-ENCODED MEMORY IN LIVE CELLS |
| EP 3180430 A1 | GENOMICALLY-ENCODED MEMORY IN LIVE CELLS |
| CA 2488328 C | RETRONS FOR GENE TARGETING |
| WO 2016/025719 A1 | GENOMICALLY-ENCODED MEMORY IN LIVE CELLS |
| U.S. Pat. No. 8,932,860 B2 | RETRONS FOR GENE TARGETING |
| EP 1517992 B1 | RETRONS FOR GENE TARGETING |
| AU 2003/233734 C1 | RETRONS FOR GENE TARGETING |
| AU 2003/233734 B2 | RETRONS FOR GENE TARGETING |
| US 2009/0123991 A1 | RETRONS FOR GENE TARGETING |
| US 2005/0250207 A1 | RETRONS FOR GENE TARGETING |
| EP 1517992 A2 | RETRONS FOR GENE TARGETING |
| WO 2003/104470 A3 | RETRONS FOR GENE TARGETING |
| AU 2003/233734 A1 | RETRONS FOR GENE TARGETING |
| CA 2488328 A1 | RETRONS FOR GENE TARGETING |
| WO 2003/104470 A2 | RETRONS FOR GENE TARGETING |

In some embodiments, the Cas12a retron editing system can be used for genome editing a desired site. A retron is engineered with a heterologous nucleic acid sequence encoding a donor polynucleotide ("template or donor nucleotide sequence" or "template DNA") suitable for use with nuclease genome editing system. The nuclease is designed to specifically target a location proximal to the desired edit (the nuclease should be designed such that it will not cut the target once the edit is properly installed). The Cas12a domain is linked to the retron, either by direct fusion to the RT or by fusion of the msDNA to the gRNA (only applicable for RNA-guided nucleases). A heterologous nucleic acid sequence is inserted into the retron msd.

In some embodiments, the heterologous nucleic acid sequence has 10-100 or more bp of homologous nucleic acid sequence to the genome on both sides of the desired edit. The desired edit (insertion, deletion, or mutation) is in between the homologous sequence.

In some embodiments, donor polynucleotides comprise a sequence comprising an intended genome edit flanked by a pair of homology arms responsible for targeting the donor polynucleotide to the target locus to be edited in a cell. The donor polynucleotide typically comprises a 5' homology arm that hybridizes to a 5' genomic target sequence and a 3' homology arm that hybridizes to a 3' genomic target sequence. The homology arms are referred to herein as 5' and 3' (i.e., upstream and downstream) homology arms, which relate to the relative position of the homology arms to the nucleotide sequence comprising the intended edit within the donor polynucleotide. The 5' and 3' homology arms hybridize to regions within the target locus in the genomic DNA to be modified, which are referred to herein as the "5' target sequence" and "3' target sequence," respectively.

The homology arm must be sufficiently complementary for hybridization to the target sequence to mediate homologous recombination between the donor polynucleotide and genomic DNA at the target locus. For example, a homology arm may comprise a nucleotide sequence having at least about 80-100% sequence identity to the corresponding genomic target sequence, including any percent identity within this range, such as at least 80%, 81%, 82%, 83%, 84%, 85%, 86%, 87%, 88%, 89%, 90%, 91%, 92%, 93%, 94%, 95%, 96%, 97%, 98%, 99% or 100% sequence identity thereto, wherein the nucleotide sequence comprising the intended edit can be integrated into the genomic DNA by HDR at the genomic target locus recognized (i.e., having sufficient complementary for hybridization) by the 5' and 3' homology arms.

In some embodiments, the corresponding homologous nucleotide sequences in the genomic target sequence (i.e., the "5' target sequence" and "3' target sequence") flank a specific site for cleavage and/or a specific site for introducing the intended edit. The distance between the specific cleavage site and the homologous nucleotide sequences (e.g., each homology arm) can be several hundred nucleotides. In some embodiments, the distance between a homology arm and the cleavage site is 200 nucleotides or less (e.g., 0, 10, 20, 30, 50, 75, 100, 125, 150, 175, and 200 nucleotides). In most cases, a smaller distance may give rise to a higher gene targeting rate. In some embodiments, the donor polynucleotide is substantially identical to the target genomic sequence, across its entire length except for the sequence changes to be introduced to a portion of the genome that encompasses both the specific cleavage site and the portions of the genomic target sequence to be altered.

A homology arm can be of any length, e.g. 10 nucleotides or more, 15 nucleotides or more, 20 nucleotides or more, 50 nucleotides or more, 100 nucleotides or more, 250 nucleotides or more, 300 nucleotides or more, 350 nucleotides or more, 400 nucleotides or more, 450 nucleotides or more, 500 nucleotides or more, 1000 nucleotides (1 kb) or more, 5000 nucleotides (5 kb) or more, 10000 nucleotides (10 kb) or more, etc. In some instances, the 5' and 3' homology arms are substantially equal in length to one another. However, in some instances the 5' and 3' homology arms are not necessarily equal in length to one another. For example, one homology arm may be 30% shorter or less than the other homology arm, 20% shorter or less than the other homology arm, 10% shorter or less than the other homology arm, 5% shorter or less than the other homology arm, 2% shorter or less than the other homology arm, or only a few nucleotides less than the other homology arm. In other instances, the 5' and 3' homology arms are substantially different in length from one another, e.g. one may be 40% shorter or more, 50% shorter or more, sometimes 60% shorter or more, 70% shorter or more, 80% shorter or more, 90% shorter or more, or 95% shorter or more than the other homology arm.

The donor polynucleotide may be used in combination with an RNA-guided nuclease, which is targeted to a particular genomic sequence (i.e., genomic target sequence to be modified) by a guide RNA. A target-specific guide RNA comprises a nucleotide sequence that is complementary to a genomic target sequence, and thereby mediates binding of the nuclease-gRNA complex by hybridization at the target site. For example, the gRNA can be designed with a sequence complementary to the sequence of a minor allele to target the nuclease-gRNA complex to the site of a mutation. The mutation may comprise an insertion, a deletion, or a substitution. For example, the mutation may include a single nucleotide variation, gene fusion, translocation, inversion, duplication, frameshift, missense, nonsense, or other mutation associated with a phenotype or disease of interest. The targeted minor allele may be a common genetic variant or a rare genetic variant. In some embodiments, the gRNA is designed to selectively bind to a minor allele with single base-pair discrimination, for example, to allow binding of the nuclease-gRNA complex to a single nucleotide polymorphism (SNP). In particular, the gRNA may be designed to target disease-relevant mutations of interest for the purpose of genome editing to remove the mutation from a gene. Alternatively, the gRNA can be designed with a sequence complementary to the sequence of a major or wild-type allele to target the nuclease-gRNA complex to the allele for the purpose of genome editing to introduces a mutation into a gene in the genomic DNA of the cell, such as an insertion, deletion, or substitution. Such genetically modified cells can be used, for example, to alter phenotype, confer new properties, or produce disease models for drug screening.

The genomic target site will typically comprise a nucleotide sequence that is complementary to the gRNA and may further comprise a protospacer adjacent motif (PAM). In some embodiments, the target site comprises 20-30 base pairs in addition to a 3 or more base pair PAM. Typically, the first nucleotide of a PAM can be any nucleotide, while the two or more other nucleotides will depend on the specific Cas9 protein that is chosen. Exemplary PAM sequences are known to those of skill in the art and include, without limitation, NNG, NGN, NAG, and NGG, wherein N represents any nucleotide. In some embodiments, the allele targeted by a gRNA comprises a mutation that creates a PAM within the allele, wherein the PAM promotes binding of the Cas9-gRNA complex to the allele.

In some embodiments, the gRNA is 5-50 nucleotides, 10-30 nucleotides, 15-25 nucleotides, 18-22 nucleotides, or 19-21 nucleotides in length, or any length between the stated ranges, including, for example, 10, 11, 12, 13, 14, 15, 16, 17, 18, 19, 20, 21, 22, 23, 24, 25, 26, 27, 28, 29, 30, 31, 32, 33, 34, or 35 nucleotides in length. The guide RNA may be a single guide RNA comprising crRNA and tracrRNA sequences in a single RNA molecule, or the guide RNA may comprise two RNA molecules with crRNA and tracrRNA sequences residing in separate RNA molecules.

In some embodiments, the Cas12a is provided in the form of a protein, optionally where the nuclease is complexed with a gRNA to form a ribonucleoprotein (RNP) complex. In some embodiments, the RNA-guided nuclease is provided by a nucleic acid encoding the RNA-guided nuclease, such as an RNA (e.g., messenger RNA) or DNA (expression vector). In some embodiments, the RNA-guided nuclease and the gRNA are both provided by vectors, such as the vectors and the vector system described in other parts of the application (all incorporated herein by reference). Both can be expressed by a single vector or separately on different vectors. The vectors encoding the RNA-guided nuclease and gRNA may be included in the vector system comprising the engineered retron msr gene, msd gene and ret gene sequences. In some embodiments, the RNA-guided nuclease is fused to the RT and/or the msDNA.

The RNP complex may be administered to a subject or delivered into a cell by methods known in the art, such as those described in U.S. Pat. No. 11,390,884, which is incorporated by reference herein in its entirety. In some embodiments, the endonuclease/gRNA ribonucleoprotein (RNP) complexes are delivered to cells by electroporation. Direct delivery of the RNP complex to a subject or cell eliminates the need for expression from nucleic acids (e.g., transfection of plasmids encoding Cas12a and gRNA). It also eliminates unwanted integration of DNA segments derived from nucleic acid delivery (e.g., transfection of plasmids encoding Cas12a and gRNA). An endonuclease/gRNA ribonucleoprotein (RNP) complex usually is formed prior to administration.

Codon usage may be optimized to further improve production of an RNA-guided nuclease and/or reverse transcriptase (RT) in a particular cell or organism. For example, a nucleic acid encoding an RNA-guided nuclease or reverse transcriptase can be modified to substitute codons having a higher frequency of usage in a yeast cell, a bacterial cell, a human cell, a non-human cell, a mammalian cell, a rodent cell, a mouse cell, a rat cell, or any other host cell of interest, as compared to the naturally occurring polynucleotide sequence. When a nucleic acid encoding the RNA-guided nuclease or reverse transcriptase is introduced into cells, the protein can be transiently, conditionally, or constitutively expressed in the cell.

In some embodiments, the engineered retron used for genome editing with nuclease genome editing systems can further include accessory or enhancer proteins for recombination. Examples of recombination enhancers can include nonhomologous end joining (NHEJ) inhibitors (e.g., inhibitor of DNA ligase IV, a KU inhibitor (e.g., KU70 or KU80), a DNA-PKc inhibitor, or an artemis inhibitor) and homologous directed repair (HDR) promoters, or both, that can enhance or improve more precise genome editing and/or the efficiency of homologous recombination. In some embodiments, the recombination accessory or enhancers can comprise C-terminal binding protein interacting protein (CtIP), cyclinB2, Rad family members (e.g. Rad50, Rad51, Rad52, etc).

CtIP is a transcription factor containing C2H2 zinc fingers that are involved in early steps of homologous recombination. Mammalian CtIP and its orthologs in other eukaryotes promote the resection of DNA double-strand breaks and are essential for meiotic recombination. HDR may be enhanced by using Cas9 nuclease associated (e.g. fused) to an N-terminal domain of CtIP, an approach that forces CtIP to the cleavage site and increases transgene integration by HDR. In some embodiments, an N-terminal fragment of CtIP, called HE for HDR enhancer, may be sufficient for HDR stimulation and requires the CtIP multimerization domain and CDK phosphorylation sites to be active. HDR stimulation by the Cas9-HE fusion depends on the guide RNA used, and therefore the guide RNA will be designed accordingly.

Using the gene editing system described herein, any target gene or sequence in a host cell can be edited or modified for a desired trait, including but not limited to: Myostatin (e.g., GDF8) to increase muscle growth; Pc POLLED to induce hairlessness; KISSIR to induce bore taint; Dead end protein (dnd) to induce sterility; Nano2 and DDX to induce sterility; CD163 to induce PRRSV resistance; RELA to induce ASFV resilience; CD18 to induce Mannheimia (*Pasteurella*) hae-*molytica* resilience; NRAMP1 to induce tuberculosis resilience; Negative regulators of muscle mass (e.g., Myostatin) to increase muscle mass.

Any of the above retron editor embodiments or variants, modifications, or derivatives thereof are contemplated herein to be delivered by the LNP systems disclosed in this specification for gene editing in cells, tissues, and/or organs under in vitro, ex vivo, or in vivo conditions. The various components described herein may be configured and delivered in any suitable manner. Any of the descriptions presented in this section are not intended to be strictly limiting.

Cas12a (Cas Type V) Integrase Editors (e.g., PASTE)

In some embodiments, the Cas12a gene editing system comprises one or more integrase domains. In certain embodiments, the Cas12a gene editing system comprises one or more integrases as described and disclosed in PCT Publications WO2022087235A1, WO2020191245A1, WO2022060749A1, WO2021188840A1, WO2021138469A1, US Patent Application Publications US20140349400A1, US20210222164A1 or US20150071898A1, each of which is incorporated by reference herein in their entirety.

Cas12a (Cas Type V) Epigenetic Editors

In still other embodiments, the Cas12a gene editing systems may comprise one or more epigenetic functionalities for modulating the epigenome of a cell. Epigenetic editors are generally composed of an epigenetic enzyme or their catalytic domain fused with a user-programmable DNA-binding protein, such as a CRISPR-Cas enzyme or Cas12a disclosed herein. The user-programmable DNA-binding protein (plus a guide RNA for programming the Cas12a) guides the epigenetic enzyme (e.g., a DNA methyltransferase or DNMT) to a specific site (e.g., a CpG island in a promoter region of a gene) in order to induce a change in promoter activity.

Epigenetic modifications of DNA and histones are known for their multifaceted contributions to transcriptional regulation. As these modifications are faithfully propagated throughout DNA replication, they are considered central players in cellular memory of transcriptional states. Many efforts in the last decade have generated a vast understanding of individual epigenetic modifications and their contribution to transcriptional regulation. Epigenetic editing offers powerful tools to selectively induce epigenetic changes in a genome without altering the sequence of a nucleotide sequence as a means to regulate gene activity. The foundation of epigenetic editing is formed by the ability to generate fusion proteins of epigenetic enzymes or their catalytic domains with programmable DNA-binding platforms such as the clustered regularly interspaced short palindromic repeat (e.g., CRISPR Cas9 or Cas12a) to target these to an endogenous locus of choice. The enzymatic fusion protein then dictates the initial deposited modification while subsequent cross-talk within the local chromatin environment likely influences epigenetic and transcriptional output.

The following published literature discussing epigenetic editing is incorporated herein by reference each in their entireties.

Gjaltema R A F, Rots M G. Advances of epigenetic editing. Curr Opin Chem Biol. 2020 August; 57:75-81. doi: 10.1016/j.cbpa.2020.04.020. Epub 2020 Jun. 30. PMID: 32619853. www.sciencedirect.com/science/article/pii/S1367593120300636?via%3Dihub Kleinstiver B P, Sousa A A, Walton R T, Tak Y E, Hsu J Y, Clement K, Welch M M, Horng J E, Malagon-Lopez J, Scarfo I, Maus M V, Pinello L, Aryee M J, Joung J K. Engineered CRISPR-Cas12a variants with increased activities and improved targeting ranges for gene, epigenetic and base editing. Nat Biotechnol. 2019 March; 37(3):276-282. doi: 10.1038/s41587-018-0011-0. Epub 2019 Feb. 11. Erra tum in: Nat Biotechnol. 2020 July; 38(7):901. PMID: 30742127; PMCID: PMC6401248. www.ncbi.nlm.nih.gov/pmc/articles/PMC6401248/

Rots M G, Jeltsch A. Editing the Epigenome: Overview, Open Questions, and Directions of Future Development. Methods Mol Biol. 2018; 1767:3-18. doi: 10.1007/978-1-4939-7774-1_1. PMID: 29524127.

Liu X S, Jaenisch R. Editing the Epigenome to Tackle Brain Disorders. Trends Neurosci. 2019 December; 42(12): 861-870. doi: 10.1016/j.tins.2019.10.003. Epub 2019 Nov. 7. PMID: 31706628.

Waryah C B, Moses C, Arooj M, Blancafort P. Zinc Fingers, TALEs, and CRISPR Systems: A Comparison of Tools for Epigenome Editing. Methods Mol Biol. 2018; 1767:19-63. doi: 10.1007/978-1-4939-7774-1_2. PMID: 29524128.

Xu X, Hulshoff M S, Tan X, Zeisberg M, Zeisberg E M. CRISPR/Cas Derivatives as Novel Gene Modulating Tools: Possibilities and In Vivo Applications. Int J Mol Sci. 2020 Apr. 25; 21(9):3038. doi: 10.3390/ijms21093038. PMID: 32344896; PMCID: PMC7246536. www.ncbi.nlm.nih.gov/pmc/articles/PMC7246536/

In addition, the following published patent literature relating to epigenetic editing is incorporated herein by reference each in their entireties.

| Publication Number | Title |
|---|---|
| WO2023283359A2 | COMPOSITIONS AND METHODS FOR MODULATING SECRETED FRIZZLED RECEPTOR PROTEIN 1 (SFRP1) GENE EXPRESSION |
| WO2022226139A1 | TISSUE-SPECIFIC NUCLEIC ACID DELIVERY BY MIXED CATIONIC LIPID PARTICLES |
| WO2022132926A1 | TISSUE-SPECIFIC NUCLEIC ACID DELIVERY BY 1,2-DIOLEOYL-3-TRIMETHYLAMMONIUM-PROPANE (DOTAP) LIPID NANOPARTICLES |
| WO2021183720A1 | COMPOSITIONS AND METHODS FOR MODULATING FORKHEAD BOX P3 (FOXP3) GENE EXPRESSION |
| WO2021061815A1 | COMPOSITIONS AND METHODS FOR MODULATING HEPATOCYTE NUCLEAR FACTOR 4-ALPHA (HNF4α) GENE EXPRESSION |
| WO2021061707A1 | COMPOSITIONS AND METHODS FOR MODULATING APOLIPOPROTEIN B (APOB) GENE EXPRESSION |
| WO2021061698A1 | METHODS AND COMPOSITIONS FOR MODULATING FRATAXIN EXPRESSION AND TREATING FRIEDRICH'S ATAXIA |

Cas12a (Cas Type V) Gene Writing Editor

In some embodiments, the gene editing system is a gene writing system that comprises a Cas12a domain. In certain embodiments, the gene editing system is one described and disclosed in US Patent Application Publications US2022039681A1 or US20200109398A1, each of which is incorporated by reference herein in their entirety.

In certain embodiments, the gene editing system is a system for modifying DNA comprising a polypeptide or a nucleic acid encoding a polypeptide capable of target primed reverse transcription, wherein the polypeptide comprises (a) a reverse transcriptase domain and (b) an endonuclease domain, wherein at least one of (a) or (b) is heterologous; and a template RNA comprising (i) a sequence that binds the polypeptide and (ii) a heterologous object sequence. In certain embodiments, the gene editing system is a system for modifying DNA comprising a polypeptide or a nucleic acid encoding a polypeptide capable of target primed reverse transcription, wherein the polypeptide comprises (a) a target DNA binding domain, (b) a reverse transcriptase domain and (c) an endonuclease domain, wherein at least one of (a), (b) or (c) is heterologous, and a template RNA comprising (i) a sequence that binds the polypeptide and (ii) a heterologous object sequence. In certain embodiments, the polypeptide comprises a sequence of at least 50 amino acids having at least 80% identity to a reverse transcriptase domain of a sequence of a polypeptide listed in TABLE 1, TABLE 2, or TABLE 3 of US Patent Application Publication US20200109398A1, which is incorporated by reference in its entirety, including the aforementioned sequence tables.

In certain embodiments, the reverse transcriptase domain is from a retrovirus or a retrotransposon, such as a LTR-retrotransposon, or a non-LTR retrotransposon. In certain embodiments, the reverse transcriptase is from a non-LTR retrotransposon, wherein the non-LTR retrotransposon is a RLE-type non-LTR retrotransposon from the R2, NeSL, HERO, R4, or CRE clade, or an APE-type non-LTR retrotransposon from the R1, or Tx1 clade. In certain embodiments, the reverse transcriptase domain is from an avian retrotransposase of column 8 of Table 3 of US20200109398A1, or a sequence having at least 70%, identity thereto. In certain embodiments, the reverse transcriptase domain does not comprise an RNA binding domain and the polypeptide comprises an RNA binding domain heterologous to the reverse transcriptase domain, wherein the RNA binding domain is a B-box protein, a MS2 coat protein, a dCas protein, or a UTR binding protein, or a fragment or variant of any of the foregoing.

In certain embodiments, the endonuclease domain is heterologous to the reverse transcriptase domain, and wherein the endonuclease is a Fok1 nuclease (or a functional fragment thereof), a type-II restriction 1-like endonuclease (RLE-type nuclease), another RLE-type endonuclease, or a Prp8 nuclease. In certain embodiments, the endonuclease domain is heterologous to the reverse transcriptase domain, wherein endonuclease domain contains DNA binding functionality. In certain embodiments, the endonuclease domain is heterologous to the reverse transcriptase domain, and wherein the endonuclease has nickase activity and does not form double stranded breaks.

In certain embodiments, the polypeptide comprises a DNA binding domain heterologous to the reverse transcriptase domain, and wherein the DNA binding domain is a sequence-guided DNA binding element such as Cas12a. In certain embodiments, the polypeptide comprises a DNA binding domain heterologous to the reverse transcriptase domain, and wherein the DNA binding element is a sequence-guided DNA binding element, further wherein the sequence-guided DNA binding element is Cas9, Cpf1, or other CRISPR-related protein. In certain embodiments, the polypeptide comprises a DNA binding domain heterologous to the reverse transcriptase domain, and wherein the DNA binding domain is a transcription factor.

In certain embodiments, the sequence-guided DNA binding element has been altered to have no endonuclease activity. In certain embodiments, the sequence-guided DNA binding element replaces the endonuclease element of the polypeptide. In certain embodiments, the editing system is capable of modifying DNA using reverse transcriptase activity, optionally in the absence of homologous recombination activity.

In certain embodiments, the gene editing system is a system for modifying DNA comprising:
 a) a recombinase polypeptide selected from Rec27 (WP_021170377.1, SEQ ID NO: 1241 of US20220396813A1), Rec35 (WP_134161939.1, SEQ ID NO: 1249 of US20220396813A1), or comprising an amino acid sequence of Table 1 or 2 of US20220396813A1, or an amino acid sequence having at least 70%, 75%, 80%, 85%, 90%, 95%, 96%, 97%, 98%, or 99% identity thereto, or a nucleic acid encoding the recombinase polypeptide; and b) a double-stranded insert DNA comprising:
  (i) a DNA recognition sequence that binds to the recombinase polypeptide of (a), said DNA recognition sequence having a first parapalindromic sequence and a second parapalindromic sequence, wherein each parapalindromic sequence is about 10-30, 12-27, or 10-15 nucleotides, e.g., about 13 nucleotides, and the first and second parapalindromic sequences together comprise the parapalindromic region of a nucleotide sequence of Table 1, or a nucleotide sequence having at least 70%, 75%, 80%, 85%, 90%, 95%, 96%, 97%, 98%, or 99% identity thereto, or having no more than 1, 2, 3, 4, 5, 6, 7, 8 sequence alterations (e.g., substitutions, insertions, or deletions) relative thereto, and said DNA recognition sequence further comprises a core sequence of about 5-10 nucleotides, e.g., about 8 nucleotides, wherein the core sequence is situated between the first and second parapalindromic sequences, and
  (ii) a heterologous object sequence.

Cas12a (Cas Type V) Recombinase Editors

In some embodiments, the Cas12a editing system may also further a recombinase domain, e.g., as a fusion or provided in trans. This domain may be further combined with other domains, such as a reverse transcriptase domain. In certain embodiments, the gene editing system can be based on that described and disclosed in US Patent Application Publications US2022039681A1 or US20200109398A1, each of which is incorporated by reference herein in their entirety, and which may be modified to use a herein disclosed Cas12a domain in place of the programmable nuclease disclosed therein.

A recombinase refers to a site-specific enzyme that mediates the recombination of DNA between recombinase recognition sequences, which results in the excision, integration, inversion, or exchange (e.g., translocation) of DNA fragments between the recombinase recognition sequences. Recombinases can be classified into two distinct families: serine recombinases (e.g., resolvases and invertases) and tyrosine recombinases (e.g., integrases). Examples of serine recombinases include, without limitation, Hin, Gin, Tn3, b-six, CinH, ParA, gd, Bxb1, jC31, TP901, TG1, fBT1, R4, fRV1, fFC1, MR11, A118, U153, and gp29. Examples of tyrosine recombinases include, without limitation, Cre, FLP, R, Lambda, HK101, HK022, and pSAM2. The serine and tyrosine recombinase names stem from the conserved nucleophilic amino acid residue that the recombinase uses to attack the DNA and which becomes covalently linked to the DNA during strand exchange.

Recombinases have numerous applications, including the creation of gene knockouts/knock-ins and gene therapy applications. See, e.g., Brown et al., "Serine recombinases as tools for genome engineering." Methods. 2011; 53(4): 372-9; Hirano et al., "Site-specific recombinases as tools for heterologous gene integration." Appl. Microbiol. Biotechnol. 2011; 92(2):227-39; Chavez and Calos, "Therapeutic applications of the FC31 integrase system." Curr. Gene Ther. 2011; 11(5):375-81; Turan and Bode, "Site-specific recombinases: from tag-and-target-to tag-and-exchange-based genomic modifications." FASEB J. 2011; 25(12):4088-107; Venken and Bellen, "Genome-wide manipulations of *Drosophila melanogaster* with transposons, Flp recombinase, and FC31 integrase." Methods Mol. Biol. 2012; 859:203-28; Murphy, "Phage recombinases and their applications." Adv. Virus Res. 2012; 83:367-414; Zhang et al., "Conditional gene manipulation: Cre-ating a new biological era." J. Zhejiang Univ. Sci. B. 2012; 13(7):511-24; Karpenshif and Bernstein, "From yeast to mammals: recent advances in genetic control of homologous recombination." DNA Repair (Amst). 2012; 1; 11(10):781-8; the entire contents of each are hereby incorporated by reference in their entirety. The recombinases provided herein are not meant to be exclusive examples of recombinases that can be used in embodiments of the invention. The methods and compositions of the invention can be expanded by mining databases for new orthogonal recombinases or designing synthetic recombinases with defined DNA specificities (See, e.g., Groth et al., "Phage integrases: biology and applications." J. Mol. Biol. 2004; 335, 667-678; Gordley et al., "Synthesis of programmable integrases." Proc. Natl. Acad. Sci. USA. 2009; 106, 5053-5058; the entire contents of each are hereby incorporated by reference in their entirety). Other examples of recombinases that are useful in the methods and compositions described herein are known to those of skill in the art, and any new recombinase that is discovered or generated is expected to be able to be used in the different embodiments of the invention. In some embodiments, the catalytic domains of a recombinase are fused to a nuclease-inactivated RNA-programmable nuclease (e.g., dCas9, or a fragment thereof), such that the recombinase domain does not comprise a nucleic acid binding domain or is unable to bind to a target nucleic acid (e.g., the recombinase domain is engineered such that it does not have specific DNA binding activity). Recombinases lacking DNA binding activity and methods for engineering such are known, and include those described by Klippel et al., "Isolation and characterisation of unusual gin mutants." EMBO J. 1988; 7: 3983-3989: Burke et al., "Activating mutations of Tn3 resolvase marking interfaces important in recombination catalysis and its regulation. Mol Microbiol. 2004; 51: 937-948; Olorunniji et al., "Synapsis and catalysis by activated Tn3 resolvase mutants." Nucleic Acids Res. 2008; 36: 7181-7191; Rowland et al., "Regulatory mutations in Sin recombinase support a structure-based model of the synaptosome." Mol Microbiol. 2009; 74: 282-298; Akopian et al., "Chimeric recombinases with designed DNA sequence recognition." Proc Natl Acad Sci USA. 2003; 100: 8688-8691; Gordley et al., "Evolution of programmable zinc finger-recombinases with activity in human cells. J Mol Biol. 2007; 367: 802-813; Gordley et al., "Synthesis of programmable integrases." Proc Natl Acad Sci USA. 2009; 106: 5053-5058; Arnold et al., "Mutants of Tn3 resolvase which do not require accessory binding sites for recombination activity." EMBO J. 1999; 18: 1407-1414; Gaj et al., "Structure-guided reprogramming of serine recombinase DNA sequence specificity." Proc Natl Acad Sci USA. 2011; 108(2):498-503; and Proudfoot et al., "Zinc finger recombinases with adaptable DNA sequence specificity." PLoS One. 2011; 6(4):e19537; the entire contents of each are hereby incorporated by reference. For example, serine recombinases of the resolvase-invertase group, e.g., Tn3 and gd resolvases and the Hin and Gin invertases, have modular structures with autonomous catalytic and DNA-binding domains (See, e.g., Grindley et al., "Mechanism of site-specific recombination." Ann Rev Biochem. 2006; 75: 567-605, the entire contents of which are incorporated by reference). The catalytic domains of these recombinases are thus amenable to being recombined with nuclease-inactivated RNA-programmable nucleases (e.g., dCas9, or a fragment thereof) as described herein, e.g., following the isolation of 'activated' recombinase mutants which do not require any accessory factors (e.g., DNA binding activities) (See, e.g., Klippel et al., "Isolation and characterisation of unusual gin mutants." EMBO J. 1988; 7: 3983-3989: Burke et al., "Activating mutations of Tn3 resolvase marking interfaces important in recombination catalysis and its regulation. Mol Microbiol. 2004; 51: 937-948; Olorunniji et al., "Synapsis and catalysis by activated Tn3 resolvase mutants." Nucleic Acids Res. 2008; 36: 7181-7191; Rowland et al., "Regulatory mutations in Sin recombinase support a structure-based model of the synaptosome." Mol Microbiol. 2009; 74: 282-298; Akopian et al., "Chimeric recombinases with designed DNA sequence recognition." Proc Natl Acad Sci USA. 2003; 100: 8688-8691). Additionally, many other natural serine recombinases having an N-terminal catalytic domain and a C-terminal DNA binding domain are known (e.g., phiC31 integrase, TnpX transposase, IS607 transposase), and their catalytic domains can be co-opted to engineer programmable site-specific recombinases as described herein (See, e.g., Smith et al., "Diversity in the serine recombinases." Mol Microbiol. 2002; 44: 299-307, the entire contents of which are incorporated by reference). Similarly, the core catalytic domains of tyrosine recombinases (e.g., Cre, 1 integrase) are known, and can be similarly co-opted to engineer programmable site-specific recombinases as described herein (See, e.g., Guo et al., "Structure of Cre recombinase complexed with DNA in a site-specific recombination synapse." Nature. 1997; 389:40-46; Hartung et al., "Cre mutants with altered DNA binding properties." J Biol Chem 1998; 273:22884-22891; Shaikh et al., "Chimeras of the Flp and Cre recombinases: Tests of the mode of cleavage by Flp and Cre. J Mol Biol. 2000; 302:27-48; Rongrong et al., "Effect of deletion mutation on the recombination activity of Cre recombinase." Acta Biochim Pol. 2005; 52:541-544; Kilbride et al., "Determinants of product topology in a hybrid Cre-Tn3 resolvase site-specific recombination system." J Mol Biol. 2006; 355: 185-195; Warren et al., "A chimeric cre recombinase with regulated directionality." Proc Natl Acad Sci USA. 2008 105:18278-18283; Van Duyne, "Teaching Cre to follow directions." Proc Natl Acad Sci USA. 2009 Jan. 6; 106(1): 4-5; Numrych et al., "A comparison of the effects of single-base and triple-base changes in the integrase arm-type binding sites on the site-specific recombination of bacteriophage 1." Nucleic Acids Res. 1990; 18:3953-3959; Tirumalai et al., "The recognition of core-type DNA sites by 1 integrase." J Mol Biol. 1998; 279:513-527; Aihara et al., "A conformational switch controls the DNA cleavage activity of 1 integrase." Mol Cell. 2003; 12:187-198; Biswas et al., "A structural basis for allosteric control of DNA recombination by 1 integrase." Nature. 2005; 435:1059-1066; and Warren et al., "Mutations in the amino-terminal domain of 1-integrase have differential effects on integrative and excusive recombination." Mol Microbiol. 2005; 55:1104-1112; the entire contents of each are incorporated by reference).

Cas12a (Cas Type V) Prime Editor/Recombinase System

In another aspect, Cas12a may be able to be combined with prime editing ("Cas12a PE" wherein Cas12a is used in place of Cas9) and a recombinase to insert recombinase sites (or "recombinase recognition sequences") into a desired genomic site. Insertion of recombinase sites provides a programmed location for effecting site-specific genetic changes in a genome. Such genetic changes can include, for example, genomic integration of a plasmid, genomic deletion or insertion, chromosomal translocations, and cassette exchanges, among other genetic changes. The installed recombinase recognition sequences may then be used to conduct site-specific recombination at that site to effectuate a variety of recombination outcomes, such as, excision, integration, inversion, or exchange of DNA fragments.

The mechanism of installing a recombinase site using a Cas12a prime editor into the genome is analogous to installing other sequences, such as peptide/protein and RNA tags, into the genome. The process begins with selecting a desired target locus into which the recombinase target sequence will be introduced. Next, a Cas12a prime editor system is provided ("RT-Cas12a:gRNA"). Here, the "gRNA" refers to a PEgRNA, which includes an extended region comprising the RT template that encodes a recombinase integration site for installing in a site in a genome.

In various aspects, the present disclosure provides for the use of a Cas12a PE to introduce recombinase recognition sequences at high-value loci in human or other genomes, which, after exposure to site-specific recombinase(s), will direct precise and efficient genomic modifications. In various embodiments, a single SSR target may be installed by Cas12a PE for use as a site for genomic integration of a DNA donor template. Cas12a PE-mediated introduction of recombinase recognition sequences could be particularly useful for the treatment of genetic diseases which are caused by large-scale genomic defects, such as gene loss, inversion, or duplication, or chromosomal translocation. For example, Williams-Beuren syndrome is a developmental disorder caused by a deletion of 24 in chromosome 721. No technology exists currently for the efficient and targeted insertion of multiple entire genes in living cells; however, recombinase-mediated integration at a target inserted by Cas12a PE offers one approach towards a permanent cure for this and other diseases. In addition, targeted introduction of recombinase recognition sequences could be highly enabling for applications including generation of transgenic plants, animal research models, bioproduction cell lines, or other custom eukaryotic cell lines. For example, recombinase-mediated genomic rearrangement in transgenic plants at PE-specific targets could overcome one of the bottlenecks to generating agricultural crops with improved properties[8,9].

In various other aspects, the present disclosure relates to methods of using Cas12a PE to install one or more recombinase recognition sequence and their use in site-specific recombination.

In some embodiments, the site-specific recombination may effectuate a variety of recombination outcomes, such as, excision, integration, inversion, or exchange of DNA fragments.

In some embodiments, the methods are useful for inducing recombination of or between two or more regions of two or more nucleic acid (e.g., DNA) molecules. In other embodiments, the methods are useful for inducing recombination of or between two or more regions in a single nucleic acid molecule (e.g., DNA).

In some embodiments, the disclosure provides a method for integrating a donor DNA template by site-specific recombination, comprising: (a) installing a recombinase recognition sequence at a genomic locus by prime editing; (b) contacting the genomic locus with a DNA donor template that also comprises the recombinase recognition sequence in the presence of a recombinase.

In other embodiments, the disclosure provides a method for deleting a genomic region by site-specific recombination, comprising: (a) installing a pair of recombinase recognition sequences at a genomic locus by prime editing; (b) contacting the genomic locus with a recombinase, thereby catalyzing the deletion of the genomic region between the pair of recombinase recognition sequences.

In yet other embodiments, the disclosure provides a method for inverting a genomic region by site-specific recombination, comprising: (a) installing a pair of recombinase recognition sequences at a genomic locus by prime editing; (b) contacting the genomic locus with a recombinase, thereby catalyzing the inversion of the genomic region between the pair of recombinase recognition sequences.

In still other embodiments, the disclosure provides a method for inducing chromosomal translocation between a first genomic site and a second genomic site, comprising: (a) installing a first recombinase recognition sequence at a first genomic locus by prime editing; (b) installing a second recombinase recognition sequence at a second genomic locus by prime editing; (c) contacting the first and the second genomic loci with a recombinase, thereby catalyzing the chromosomal translocation of the first and second genomic loci.

In other embodiments, the disclosure provides a method for inducing cassette exchange between a genomic locus and a donor DNA comprising a cassette, comprising: (a) installing a first recombinase recognition sequence at a first genomic locus by prime editing; (b) installing a second recombinase recognition sequence at a second genomic locus by prime editing; (c) contacting the first and the second genomic loci with a donor DNA comprising a cassette that is flanked by the first and second recombinase recognition sequences and a recombinase, thereby catalyzing the exchange of the flanked genomic locus and the cassette in the DNA donor.

In various embodiments involving the insertion of more than one recombinase recognition sequences in the genome, the recombinase recognition sequences can be the same or different. In some embodiments, the recombinase recognition sequences are the same. In other embodiments, that recombinase recognition sequences are different.

In various embodiments, the recombinase can be a tyrosine recombinase, such as Cre, Dre, Vcre, Scre, Flp, B2, B3, Kw, R, TD1-40, Vika, Nigri, Panto, Kd, Fre, Cre(ALSHG), Tre, Brecd, or Cre-R3M3. In such embodiments, the recombinase recognition sequence may be a cognate RRS that corresponds to the recombinase under use.

In various other embodiments, the recombinase can be a large serine recombinase, such as Bxb1, PhiC31, R4, phiBT1, MJ1, MR11, TP901-1, A118, V153, phiRV1, phi370.1, TG1, WB, BL3, SprA, phiJoe, phiK38, Int2, Int3, Int4, Int7, Int8, Int9, Int10, Int11, Int12, Int13, L1, peaches, Bxz2, or SV1. In such embodiments, the recombinase recognition sequence may be a cognate RRS that corresponds to the recombinase under use.

In still other embodiments, the recombinase can be a serine recombinase, such as Bxb1, PhiC31, R4, phiBT1, MJ1, MR11, TP901-1, A118, V153, phiRV1, phi370.1, TG1, WB, BL3, SprA, phiJoe, phiK38, Int2, Int3, Int4, Int7, Int8, Int9, Int10, Int11, Int12, Int13, L1, peaches, Bxz2, or SV1. In such embodiments, the recombinase recognition sequence may be a cognate RRS that corresponds to the recombinase under use.

In other embodiments, the recombinase can be a serine resolvase, such as Gin, Cin, Hin, Min, or Sin. In such embodiments, the recombinase recognition sequence may be a cognate RRS that corresponds to the recombinase under use.

In various other embodiments, the recombinase can be a tyrosine integrase, such as HK022, P22, or L5. In such embodiments, the recombinase recognition sequence may be a cognate RRS that corresponds to the recombinase under use.

In some embodiments, any of the methods for site-specific recombination with Cas12a PE can be performed in vivo or in vitro. In some embodiments, any of the methods for site-specific recombination are performed in a cell (e.g., recombine genomic DNA in a cell). The cell can be prokaryotic or eukaryotic. The cell, such as a eukaryotic cell, can be in an individual, such as a subject, as described herein (e.g., a human subject). The methods described herein are useful for the genetic modification of cells in vitro and in vivo, for example, in the context of the generation of transgenic cells, cell lines, or animals, or in the alteration of genomic sequence, e.g., the correction of a genetic defect, in a cell in a subject.

F. Delivery of Cas12 (or Cas Type V) Gene Editing Systems

Overview

In yet another aspect, the disclosure provides vectors for transferring and/or expressing said Cas12a (or Cas Type V)-based gene editing systems, e.g., under in vitro, ex vivo, and in vivo conditions. In still another aspect, the disclosure provides cell-delivery compositions and methods, including compositions for passive and/or active transport to cells (e.g., plasmids), delivery by virus-based recombinant vectors (e.g., AAV and/or lentivirus vectors), delivery by non-virus-based systems (e.g., liposomes and LNPs), and delivery by virus-like particles of the Cas12a-based gene editing systems described herein. Depending on the delivery system employed, the Cas12a-based gene editing systems described herein may be delivered in the form of DNA (e.g., plasmids or DNA-based virus vectors), RNA (e.g., guide RNA and mRNA delivered by LNPs), a mixture of DNA and RNA, protein (e.g., virus-like particles), and ribonucleoprotein (RNP) complexes. Any suitable combinations of approaches for delivering the components of the herein disclosed Cas12a-based gene editing systems may be employed.

The Cas12a (or Cas Type V) editing systems and/or components thereof can be delivered by any known delivery system such as those described above, including (a) without vectors (e.g., electroporation), (b) viral delivery systems and (c) non-viral delivery systems. Viral delivery systems include expression vectors, adeno-associated virus (AAV) vectors, retroviral vectors, lentiviral vectors, and the like. An expression construct can be replicated in a living cell, or it can be made synthetically. Non-viral delivery systems include without limitation lipid particles (e.g. Lipid nanoparticles (LNPs)), non-lipid nanoparticles, exosomes, liposomes, micelles, viral particles, stable nucleic-acid-lipid particles (SNALPs), lipoplexes/polyplexes, DNA nanoclews, Gold nanoparticles, iTOP, Streptolysin O (SLO), multifunctional envelope-type nanodevice (MEND), lipid-coated mesoporous silica particles, inorganic nanoparticles, and polymeric delivery technology (e.g., polymer-based particles).

Delivery of nucleic acid modalities, including RNA therapeutics, is described further in Paunovska K, Loughrey D, Dahlman J E. Drug delivery systems for RNA therapeutics. Nat Rev Genet. 2022 May; 23(5):265-280. doi: 10.1038/s41576-021-00439-4. Epub 2022 Jan. 4. PMID: 34983972; PMCID: PMC8724758; Hong C A, Nam Y S. Functional nanostructures for effective delivery of small interfering RNA therapeutics. Theranostics. 2014 Sep. 19; 4(12):1211-32. doi: 10.7150/thno.8491. PMID: 25285170; PMCID: PMC4183999; Liu F, Wang C, Gao Y, Li X, Tian F, Zhang Y, Fu M, Li P, Wang Y, Wang F. Current Transport Systems and Clinical Applications for Small Interfering RNA (siRNA) Drugs. Mol Diagn Ther. 2018 October; 22(5):551-569. doi: 10.1007/s40291-018-0338-8. PMID: 29926308; Zhang Y, Almazi J G, Ong H X, Johansen M D, Ledger S, Traini D, Hansbro P M, Kelleher A D, Ahlenstiel C L. Nanoparticle Delivery Platforms for RNAi Therapeutics Targeting COVID-19 Disease in the Respiratory Tract. Int J Mol Sci. 2022 Feb. 22; 23(5):2408. doi: 10.3390/ijms23052408. PMID: 35269550; PMCID: PMC8909959; Zhang M, Hu S, Liu L, Dang P, Liu Y, Sun Z, Qiao B, Wang C. Engineered exosomes from different sources for cancer-targeted therapy. Signal Transduct Target Ther. 2023 Mar. 15; 8(1):124. doi: 10.1038/s41392-023-01382-y. PMID: 36922504; PMCID: PMC10017761; Hastings M L, Krainer A R. RNA therapeutics. RNA. 2023 April; 29(4):393-395. doi: 10.1261/rna.079626.123. PMID: 36928165; PMCID: PMC10019368; Miele E, Spinelli G P, Miele E, Di Fabrizio E, Ferretti E, Tomao S, Gulino A. Nanoparticle-based delivery of small interfering RNA: challenges for cancer therapy. Int J Nanomedicine. 2012; 7:3637-57. doi: 10.2147/IJN.S23696. Epub 2012 Jul. 20. PMID: 22915840; PMCID: PMC3418108, each of which are incorporated by reference in their entireties.

The engineered Cas12a (or Cas Type V) editing systems (or vectors containing them) may be introduced into any type of cell, including any cell from a prokaryotic, eukaryotic, or archaeon organism, including bacteria, archaea, fungi, protists, plants (e.g., monocotyledonous and dicotyledonous plants); and animals (e.g., vertebrates and invertebrates). Examples of animals that may be transfected with an engineered Cas12a editing system include, without limitation, vertebrates such as fish, birds, mammals (e.g., human and non-human primates, farm animals, pets, and laboratory animals), reptiles, and amphibians.

The engineered Cas12a (or Cas Type V) editing systems can be introduced into a single cell or a population of cells. Cells from tissues, organs, and biopsies, as well as recombinant cells, genetically modified cells, cells from cell lines cultured in vitro, and artificial cells (e.g., nanoparticles, liposomes, polymersomes, or microcapsules encapsulating nucleic acids) may all be transfected with the engineered Cas12a editing systems.

The engineered Cas12a (or Cas Type V) editing systems can be introduced into cellular fragments, cell components, or organelles (e.g., mitochondria in animal and plant cells, plastids (e.g., chloroplasts) in plant cells and algae).

Cells may be cultured or expanded after transfection with the engineered Cas12a editing systems.

Methods of introducing nucleic acids into a host cell are well known in the art. Commonly used methods include chemically induced transformation, typically using divalent cations (e.g., $CaCl_2$), dextran-mediated transfection, polybrene mediated transfection, lipofectamine and LT-1 mediated transfection, electroporation, protoplast fusion, encapsulation of nucleic acids in liposomes, and direct microinjection of the nucleic acids comprising Cas12a editing systems into nuclei. See, e.g., Sambrook et al. (2001) Molecular Cloning, a laboratory manual, 3rd edition, Cold Spring Harbor Laboratories, New York, Davis et al. (1995) Basic Methods in Molecular Biology, 2nd edition, McGraw-Hill, and Chu et al. (1981) Gene 13:197; herein incorporated by reference in their entireties.

Plant cells may also be targeted by the Cas12a editing systems disclosed herein. Methods for genetic transformation of plant cells are known in the art and include those set forth in US2022/0145296, and U.S. Pat. Nos. 8,575,425; 7,692,068; 8,802,934; 7,541,517; each of which is herein incorporated by reference in its entirety. See, also, Rakoczy-Trojanowska, M. (2002) Cell Mol Biol Lett. 7:849-858; Jones et al. (2005) Plant Methods 1:5; Rivera et al. (2012) Physics of Life Reviews 9:308-345; Bartlett et al. (2008) Plant Methods 4:1-12; Bates, G. W. (1999) Methods in Molecular Biology 111:359-366; Binns and Thomashow (1988) Annual Reviews in Microbiology 42:575-606; Christou, P. (1992) The Plant Journal 2:275-281; Christou, P. (1995) Euphytica 85:13-27; Tzfira et al. (2004) TRENDS in Genetics 20:375-383; Yao et al. (2006) Journal of Experimental Botany 57:3737-3746; Zupan and Zambryski (1995) Plant Physiology 107:1041-1047; and Jones et al. (2005) Plant Methods 1:5.

The plant cells that have been transformed may be grown into a transgenic organism, such as a plant, in accordance with conventional methods. See, for example, McCormick et al. (1986) Plant Cell Reports 5:81-84.

Plant material that may be transformed with the Cas12a editing systems described herein includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Progeny, variants, and mutants of the regenerated plants are also included within the scope of the disclosure, provided that these parts comprise the genetic modification introduced by the Cas12a editing systems. Further provided is a processed plant product or byproduct that retains the genetic modification introduced by the Cas12a editing systems.

The Cas12a editing systems described herein may be used to produce transgenic plants with desired phenotypes, including but not limited to, increased disease resistance (e.g., increased viral, bacterial of fungal resistance), increased insect resistance, increased drought resistance, increased yield, and altered fruit ripening characteristics, sugar and oil composition, and color.

In some embodiments involving Cas12a-based retron editing systems, the retron msr gene, msd gene, and/or ret gene can be expressed in vitro from a vector, such as in an in vitro transcription system. The resulting ncRNA or msDNA can be isolated before being packaged and/or formulated for direct delivery into a host cell. For example, the isolated ncRNA or msDNA can be packaged/formulated in a delivery vehicle such as lipid nanoparticles as described in other sections.

In some embodiments involving Cas12a-based retron editing systems, the retron msr gene, msd gene, and/or ret gene are expressed in vivo from a vector within a cell. The retron msr gene, msd gene, and/or ret gene can be introduced into a cell with a single vector or in multiple separate vectors to produce msDNA in a host subject.

In other embodiments, the retron msr gene, msd gene, and/or ret gene, and any other components of the retron-based genome editing systems described herein (e.g., guide RNA in trans, programmable nuclease (e.g., in trans)) may be expressed in vivo from RNA delivered to the cell. The retron msr gene, msd gene, and/or ret gene can be introduced into a cell with a single vector or in multiple separate vectors to produce msDNA in a host subject.

Vectors and/or nucleic acid molecules encoding the recombinant retron-based genome editing system or components thereof can include control elements operably linked to the retron sequences, which allow for the production of msDNA either in vitro, or in vivo in the subject species. For example, in embodiments relating to Cas12a-based retron editors, the retron msr gene, msd gene, and/or ret gene can be operably linked to a promoter to allow expression of the retron reverse transcriptase and/or the msDNA product. In some embodiments, heterologous sequences encoding desired products of interest (e.g., polynucleotide encoding polypeptide or regulatory RNA, donor polynucleotide for gene editing, or protospacer DNA for molecular recording) may be inserted in the msr gene and/or msd gene.

In some embodiments, the Cas12a editing systems are produced by a vector system comprising one or more vectors.

Numerous vectors are available for use in the vector or vector system, including but not limited to, linear polynucleotides, polynucleotides associated with ionic or amphiphilic compounds, plasmids, and viruses.

Viral Vector Delivery

In various embodiments, the Cas12a (or Cas Type V)-based editing systems described herein may be delivered in viral vectors.

Examples of viral vectors include, but are not limited to, adenoviral vectors, adeno-associated virus (AAV) vectors, retroviral vectors, lentiviral vectors, and the like. An expression construct can be replicated in a living cell, or it can be made synthetically.

In some embodiments, the nucleic acid comprising an Cas12a (or Cas Type V) editing system sequence is under transcriptional control of a promoter. In some embodiments, the promoter is competent for initiating transcription of an operably linked coding sequence by a RNA polymerase I, II, or III.

Exemplary promoters for mammalian cell expression include the SV40 early promoter, a CMV promoter such as the CMV immediate early promoter (see, U.S. Pat. Nos. 5,168,062 and 5,385,839, incorporated herein by reference in their entireties), the mouse mammary tumor virus LTR promoter, the adenovirus major late promoter (Ad MLP), and the herpes simplex virus promoter, among others. Other nonviral promoters, such as a promoter derived from the murine metallothionein gene, will also find use for mammalian expression.

Exemplary promoters for plant cell expression include the CaMV 35S promoter (Odell et al., 1985, Nature 313:810-812); the rice actin promoter (McElroy et al., 1990, Plant Cell 2:163-171); the ubiquitin promoter (Christensen et al., 1989, Plant Mol. Biol. 12:619-632; and Christensen et al., 1992, Plant Mol. Biol. 18:675-689); the pEMU promoter (Last et al., 1991, Theor. Appl. Genet. 81:581-588); and the MAS promoter (Velten et al., 1984, EMBO J. 3:2723-2730).

In additional embodiments, the retron-based vectors may also comprise tissue-specific promoters to start expression only after it is delivered into a specific tissue. Non-limiting exemplary tissue-specific promoters include B29 promoter, CD14 promoter, CD43 promoter, CD45 promoter, CD68 promoter, desmin promoter, elastase-1 promoter, endoglin promoter, fibronectin promoter, Flt-1 promoter, GFAP promoter, GPIIb promoter, ICAM-2 promoter, INF-b promoter, Mb promoter, NphsI promoter, OG-2 promoter, SP-B promoter, SYN1 promoter, and WASP promoter.

These and other promoters can be obtained from or incorporated into commercially available plasmids, using techniques well known in the art. See, e.g., Sambrook et al., supra.

In some embodiments, one or more enhancer elements is/are used in association with the promoter to increase expression levels of the constructs. Examples include the SV40 early gene enhancer, as described in Dijkema et al., EMBOJ (1985) 4:761, the enhancer/promoter derived from the long terminal repeat (LTR) of the Rous Sarcoma Virus, as described in Gorman et al., Proc. Natl. Acad. Sci. USA (1982b) 79:6777, and elements derived from human CMV, as described in Boshart et al., Cell (1985) 41:521, such as elements included in the CMV intron A sequence. All such sequences are incorporated herein by reference.

In one embodiment, an expression vector for expressing an Cas12a (or Cas Type V) editing system, comprises a promoter operably linked to a polynucleotide encoding the Cas12a editing system components.

In some embodiments, the vector or vector system also comprises a transcription terminator/polyadenylation signal. Examples of such sequences include, but are not limited to, those derived from SV40, as described in Sambrook et al., supra, as well as a bovine growth hormone terminator sequence (see, e.g., U.S. Pat. No. 5,122,458).

Additionally, 5'-UTR sequences can be placed adjacent to the coding sequence to further enhance the expression. Such sequences may include UTRs comprising an internal ribosome entry site (IRES). Inclusion of an IRES permits the translation of one or more open reading frames from a vector. The IRES element attracts a eukaryotic ribosomal translation initiation complex and promotes translation initiation. See, e.g., Kaufman et al., Nuc. Acids Res. (1991) 19:4485-4490; Gurtu et al., Biochem. Biophys. Res. Comm. (1996) 229:295-298: Rees et al., BioTechniques (1996) 20:102-110; Kobayashi et al., BioTechniques (1996) 21:399-402; and Mosser et al., BioTechniques (199722 ISO-161)c. A multitude of IRES sequences are known and include sequences derived from a wide variety of viruses, such as from leader sequences of picornaviruses such as the encephalomyocarditis virus (EMCV) UTR (Jang et al. Virol. (1989) 63:1651-1660). the polio leader sequence, the hepatitis A virus leader, the hepatitis C virus IRES, human rhinovirus type 2 IRES (Dobrikova et al., Proc. Natl. Acad. Sci. (2003) 100(251:15125-151301)). an IRES element from the foot and mouth disease virus (Ramesh et al., Nucl. Acid Res. (1996) 24:2697-2700), a giardiavirus IRES (Garlapati et al., J Biol. Chem. (2004) 279(51):3389-33971) and the like. A variety of nonviral IRES sequences will also find use herein, including, but not limited to IRES sequences from yeast, as well as the human angiotensin II type 1 receptor IRES (Martin et al., Mol. Cell Endocrinol. (2003) 212:51-61), fibroblast growth factor IRESs (FGF-1 IRES and FGF-2 IRES, Martineau et al. (2004) Mol. Cell. Biol. 24(17): 7622-7635), vascular endothelial growth factor IRES (Baranick et al. (2008) Proc. Natl. Acad Sci. U.S.A. 105(12): 4733-4738, Stein et al. (1998) Mol. Cell. Biol. 18(6):3112-3119, Bert et al. (2006) RNA 12(6): 1074-1083), and insulin-like growth factor 2 IRES (Pedersen et al. (2002) Biochem. J. 363(Pt 1):37-44).

These elements are commercially available in plasmids sold, e.g., by Clontech (Mountain View, CA), Invivogen (San Diego, CA), Addgene (Cambridge, MA) and GeneCopoeia (Rockville, MD). See also IRESite: The database of experimentally verified IRES structures (iresite.org). An IRES sequence may be included in a vector, for example, to express multiple bacteriophage recombination proteins for recombineering or an RNA-guided nuclease (e.g., Cas9) for HDR in combination with a retron reverse transcriptase from an expression cassette.

In some embodiments, a polynucleotide encoding a viral self-cleaving 2A peptide, such as a T2A peptide, can be used to allow production of multiple protein products (e.g., Cas9, bacteriophage recombination proteins, retron reverse transcriptase) from a single vector or a single transcription unit under one promoter. One or more 2A linker peptides can be inserted between the coding sequences in the multicistronic construct. The 2A peptide, which is self-cleaving, allows co-expressed proteins from the multicistronic construct to be produced at equimolar levels. 2A peptides from various viruses may be used, including, but not limited to 2A peptides derived from the foot-and-mouth disease virus, equine rhinitis A virus, Jhosea asigna virus and porcine teschovirus-1. See, e.g., Kim et al. (2011) PLoS One 6(4): e18556, Trichas et al. (2008) BMC Biol. 6:40, Provost et al. (2007) Genesis 45(10): 625-629, Furler et al. (2001) Gene Ther. 8(11):864-873; herein incorporated by reference in their entireties.

In some embodiments, the expression construct comprises a plasmid suitable for transforming a bacterial host. Numerous bacterial expression vectors are known to those of skill in the art, and the selection of an appropriate vector is a matter of choice. Bacterial expression vectors include, but are not limited to, pACYC177, pASK75, pBAD, pBADM, pBAT, pCal, pET, pETM, pGAT, pGEX, pHAT, pKK223, pMa1, pProEx, pQE, and pZA31 Bacterial plasmids may contain antibiotic selection markers (e.g., ampicillin, kanamycin, erythromycin, carbenicillin, streptomycin, or tetracycline resistance), a lacZ gene (b-galactosidase produces blue pigment from x-gal substrate), fluorescent markers (e.g., GFP. mCherry), or other markers for selection of transformed bacteria. See, e.g., Sambrook et al., supra.

In other embodiments, the expression construct comprises a plasmid suitable for transforming a yeast cell. Yeast expression plasmids typically contain a yeast-specific origin of replication (ORI) and nutritional selection markers (e.g., HIS3, URA3, LYS2, LEU2, TRP1, METIS, ura4+, leu1+, ade6+), antibiotic selection markers (e.g., kanamycin resistance), fluorescent markers (e.g., mCherry), or other markers for selection of transformed yeast cells. The yeast plasmid may further contain components to allow shuttling between a bacterial host (e.g., E coif) and yeast cells. A number of different types of yeast plasmids are available including yeast integrating plasmids (Yip), which lack an ORI and are integrated into host chromosomes by homologous recombination; yeast replicating plasmids (YRp), which contain an autonomously replicating sequence (ARS) and can replicate independently; yeast centromere plasmids (YCp), which are low copy vectors containing a part of an ARS and part of a centromere sequence (CEN); and yeast episomal plasmids (YEp), which are high copy number plasmids comprising a fragment from a 2 micron circle (a natural yeast plasmid) that allows for 50 or more copies to be stably propagated per cell.

In other embodiments, the expression construct does not comprise a plasmid suitable for transforming a yeast cell.

In other embodiments, the expression construct comprises a virus or engineered construct derived from a viral genome. A number of viral based systems have been developed for gene transfer into mammalian cells. These include adenoviruses, retroviruses (g-retroviruses and lentiviruses), poxviruses, adeno-associated viruses, baculoviruses, and herpes simplex viruses (see e.g., Wamock et al. (2011) Methods Mol. Biol. 737:1-25; Walther et al. (2000) Drugs 60(2):249-271; and Lundstrom (2003) Trends Biotechnol. 21(3): 117-122; herein incorporated by reference in their entireties). The ability of certain viruses to enter cells via receptor-mediated endocytosis, to integrate into host cell genomes and express viral genes stably and efficiently have made them attractive candidates for the transfer of foreign genes into mammalian cells.

For example, retroviruses provide a convenient platform for gene delivery systems. Selected sequences can be inserted into a vector and packaged in retroviral particles using techniques known in the art. The recombinant virus can then be isolated and delivered to cells of the subject either in vivo or ex vivo. A number of retroviral systems have been described (U.S. Pat. No. 5,219,740; Miller and Rosman (1989) BioTechniques 7:980-990; Miller, A. D. (1990) Human Gene Therapy 1:5-14; Scarpa et al. (1991) Virology 180:849-852; Bums et al. (1993) Proc. Natl. Acad. Sci. USA 90:8033-8037; Boris-Lawrie and Temin (1993) Cur. Opin. Genet. Develop. 3:102-109; and Ferry et al. (2011) Curr. Pharm. Des. 17(24): 2516-2527). Lentiviruses are a class of retroviruses that are particularly useful for delivering polynucleotides to mammalian cells because they are able to infect both dividing and nondividing cells (see e.g., Lois et al. (2002) Science 295:868-872; Durand et al. (2011) Viruses 3(2): 132-159; herein incorporated by reference).

A number of adenoviral vectors have also been described. Unlike retroviruses which integrate into the host genome, adenoviruses persist extrachromosomally thus minimizing the risks associated with insertional mutagenesis.

Additionally, various adeno-associated vims (AAV) vector systems have been developed for gene delivery. AAV vectors can be readily constructed using techniques well known in the art. See, e.g., U.S. Pat. Nos. 5,173,414 and 5,139,941; International Publication Nos. WO 92/01070 (published 23 Jan. 1992) and WO 93/03769 (published 4 Mar. 1993); Lebkowski et al., Molec. Cell. Biol. (1988) 8:3988-3996; Vincent et al., Vaccines 90 (1990) (Cold Spring Harbor Laboratory Press); Carter, B. J. Current Opinion in Biotechnology (1992) 3:533-539; Muzyczka, N. Current Topics in Microbiol and Immunol. (1992) 158:97-129; Kotin, R. M. Human Gene Therapy (1994) 5:793-801; Shelling and Smith, Gene Therapy (1994) 1:165-169; and Zhou et al., J. Exp. Med. (1994) 179:1867-1875.

Another vector system useful for delivering nucleic acids encoding the Cas12a editing system components is the enterically administered recombinant poxvirus vaccines described by Small, Jr., P. A., et al. (U.S. Pat. No. 5,676,950, issued Oct. 14, 1997, herein incorporated by reference).

Other viral vectors include those derived from the pox family of viruses, including vaccinia virus and avian poxvirus. By way of example, vaccinia virus recombinants expressing a nucleic acid molecule of interest (e.g., Cas12a editing system) can be constructed as follows. The DNA encoding the particular nucleic acid sequence is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the sequences of interest into the viral genome. The resulting TK-recombinant can be selected by culturing the cells in the presence of 5-bromodeoxyuridine and picking viral plaques resistant thereto.

In some embodiments, avipoxviruses, such as the fowlpox and canarypox viruses, can also be used to deliver the nucleic acid molecules of interest. The use of an avipox vector is particularly desirable in human and other mammalian species since members of the avipox genus can only productively replicate in susceptible avian species and therefore are not infective in mammalian cells. Methods for producing recombinant avipoxviruses are known in the art and employ genetic recombination, as described above with respect to the production of vaccinia viruses. See, e.g., WO 91/12882; WO 89/03429; and WO 92/03545.

Molecular conjugate vectors, such as the adenovirus chimeric vectors described in Michael et al., J. Biol. Chem. (1993) 268:6866-6869 and Wagner et al., Proc. Natl. Acad. Sci. USA (1992) 89:6099-6103, can also be used for gene delivery.

Members of the alphavirus genus, such as, but not limited to, vectors derived from the Sindbis virus (SIN), Semliki Forest virus (SFV), and Venezuelan Equine Encephalitis virus (VEE), will also find use as viral vectors for delivering the polynucleotides of the present invention. For a description of Sindbis-virus derived vectors useful for the practice of the instant methods, see, Dubensky et al. (1996) J. Virol. 70:508-519; and International Publication Nos. WO 95/07995, WO 96/17072; as well as, Dubensky, Jr., T. W., et al., U.S. Pat. No. 5,843,723, issued Dec. 1, 1998, and Dubensky, Jr., T. W., U.S. Pat. No. 5,789,245, issued Aug. 4, 1998, both herein incorporated by reference. Particularly preferred are chimeric alphavirus vectors comprised of sequences derived from Sindbis virus and Venezuelan equine encephalitis virus. See, e.g., Perri et al. (2003) J. Virol. 77: 10394-10403 and International Publication Nos. WO 02/099035, WO 02/080982, WO 01/81609, and WO 00/61772; herein incorporated by reference in their entireties.

A vaccinia-based infection/transfection system can be conveniently used to provide for inducible, transient expression of the nucleic acids of interest (e.g., Cas12a editing system) in a host cell. In this system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the nucleic acid of interest, driven by a T7 promoter. The polymerase expressed in the cytoplasm from the vaccinia virus recombinant transcribes the transfected DNA into RNA. The method provides for high level, transient, cytoplasmic production of large quantities of RNA. See, e.g., Elroy-Stein and Moss, Proc. Natl. Acad. Sci. USA (1990) 87:6743-6747; Fuerst et al., Proc. Natl. Acad. Sci. USA (1986) 83:8122-8126.

In other approaches to infection with vaccinia or avipox virus recombinants, or to the delivery of nucleic acids using other viral vectors, an amplification system can be used that will lead to high level expression following introduction into host cells. Specifically, a T7 RNA polymerase promoter preceding the coding region for T7 RNA polymerase can be engineered. Translation of RNA derived from this template will generate T7 RNA polymerase which in turn will transcribe more templates. Concomitantly, there will be a cDNA whose expression is under the control of the T7 promoter. Thus, some of the T7 RNA polymerase generated from translation of the amplification template RNA will lead to transcription of the desired gene. Because some T7 RNA polymerase is required to initiate the amplification, T7 RNA polymerase can be introduced into cells along with the template(s) to prime the transcription reaction. The polymerase can be introduced as a protein or on a plasmid encoding the RNA polymerase. For a further discussion of T7 systems and their use for transforming cells, see, e.g., International Publication No. WO 94/26911; Studier and Moffatt, J. Mol. Biol. (1986) 189:113-130; Deng and Wolff, Gene (1994) 143:245-249; Gao et al., Biochem. Biophys. Res. Commun. (1994) 200:1201-1206; Gao and Huang, Nuc. Acids Res. (1993) 21:2867-2872; Chen et al., Nuc. Acids Res. (1994) 22:2114-2120; and U.S. Pat. No. 5,135,855.

Insect cell expression systems, such as baculovirus systems, can also be used and are known to those of skill in the art and described in, e.g., Baculovirus and Insect Cell Expression Protocols (Methods in Molecular Biology, D. W. Murhammer ed., Humana Press, 2nd edition, 2007) and L. King The Baculovirus Expression System: A laboratory guide (Springer, 1992). Materials and methods for baculovirus/insect cell expression systems are commercially available in kit form from, inter alia, Thermo Fisher Scientific (Waltham, MA) and Clontech (Mountain View, CA).

Plant expression systems can also be used for transforming plant cells. Generally, such systems use virus-based vectors to transfect plant cells with heterologous genes. For a description of such systems see, e.g., Porta et al., Mol. Biotech. (1996) 5:209-221; and Hackland et al., Arch. Virol. (1994) 139:1-22.

To obtain expression of the Cas12a (or Cas Type V) editing system or the ncRNA encoded thereby, the expression construct or the ncRNA must be delivered into a cell. This delivery may be accomplished in vitro, as in laboratory procedures for transforming cells lines, or in vivo or ex vivo, as in the treatment of certain disease states. One mechanism for delivery is via viral infection where the expression construct is encapsulated in an infectious viral particle.

Non-Viral Delivery Methods

Several non-viral methods for the transfer of expression constructs are available for delivering the Cas12a (or Cas Type V) editing systems or components thereof into cells also are contemplated. These include the use of calcium phosphate precipitation, DEAE-dextran, electroporation, direct microinjection, DNA-loaded liposomes, lipofectamine-DNA complexes, cell sonication, gene bombardment using high velocity microprojectiles, and receptor-mediated transfection (see, e.g., Graham and Van Der Eb (1973) Virology 52:456-467; Chen and Okayama (1987) Mol. Cell Biol. 7:2745-2752; Rippe et al. (1990) Mol. Cell Biol. 10:689-695; Gopal (1985) Mol. Cell Biol. 5:1188-1190; Tur-Kaspa et al. (1986) Mol. Cell. Biol. 6:716-718; Potter et al. (1984) Proc. Natl. Acad. Sci. USA 81:7161-7165); Harland and Weintraub (1985) J. Cell Biol. 101: 1094-1099); Nicolau & Sene (1982) Biochim. Biophys. Acta 721:185-190; Fraley et al. (1979) Proc. Natl. Acad. Sci. USA 76:3348-3352; Fechheimer et al. (1987) Proc Natl. Acad. Sci. USA 84:8463-8467; Yang et al. (1990) Proc. Natl. Acad. Sci. USA 87:9568-9572; Wu and Wu (1987) J. Biol. Chem. 262:4429-4432; Wu and Wu (1988) Biochemistry 27:887-892; herein incorporated by reference). Some of these techniques may be successfully adapted for in vivo or ex vivo use.

In some embodiments, nucleic acid molecules encoding the Cas12a (or Cas Type V) gene editing systems or components thereof may be stably integrated into the genome of the cell. This integration may be in the cognate location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or episomes encode sequences sufficient to permit maintenance and replication independent of or in synchronization with the host cell cycle. How the expression construct is delivered to a cell and where in the cell the nucleic acid remains is dependent on the type of expression construct employed.

In some embodiments, expression constructs encoding the Cas12a (or Cas Type V) gene editing systems or components thereof may simply consist of naked recombinant DNA or plasmids comprising nucleotide sequences encoding said Cas12a gene editing systems or components thereof. Transfer of the construct may be performed by any of the methods mentioned above which physically or chemically permeabilize the cell membrane. This is particularly applicable for transfer in vitro but it may be applied to in vivo use as well. Dubensky et al. (Proc. Natl. Acad. Sci. USA (1984) 81:7529-7533) successfully injected polyomavirus DNA in the form of calcium phosphate precipitates into liver and spleen of adult and newborn mice demonstrating active viral replication and acute infection. Benvenisty & Neshif (Proc. Natl. Acad. Sci. USA (1986) 83:9551-9555) also demonstrated that direct intraperitoneal injection of calcium phosphate-precipitated plasmids results in expression of the transfected genes. It is envisioned that DNA encoding an Cas12a editing system of interest may also be transferred in a similar manner in vivo and express retron products.

In still another embodiment, DNA expression constructs encoding the Cas12a (or Cas Type V) gene editing systems or components thereof may be transferred into cells by particle bombardment. This method depends on the ability to accelerate DNA-coated microprojectiles to a high velocity allowing them to pierce cell membranes and enter cells without killing them (Klein et al. (1987) Nature 327:70-73). Several devices for accelerating small particles have been developed. One such device relies on a high voltage discharge to generate an electrical current, which in turn provides the motive force (Yang et al. (1990) Proc. Natl. Acad. Sci. USA 87:9568-9572). The microprojectiles may consist of biologically inert substances, such as tungsten or gold beads.

Liposomes

In a further embodiment, constructs encoding the Cas12a (or Cas Type V) gene editing systems or components thereof may be delivered using liposomes. Liposomes are vesicular structures characterized by a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh & Bachhawat (1991) Liver Diseases, Targeted Diagnosis and Therapy Using Specific Receptors and Ligands, Wu et al. (Eds.), Marcel Dekker, NY, 87-104). Also contemplated is the use of lipofectamine-DNA complexes.

In some embodiments, the liposome may be complexed with a hemagglutinating virus (HVJ). This has been shown to facilitate fusion with the cell membrane and promote cell entry of liposome-encapsulated DNA (Kaneda et al. (1989) Science 243:375-378). In other embodiments, the liposome may be complexed or employed in conjunction with nuclear non-histone chromosomal proteins (HMG-I) (Kato et al. (1991) J. Biol. Chem. 266(6):3361-3364).

In yet further embodiments, the liposome may be complexed or employed in conjunction with both HVJ and HMG-I. Where a bacterial promoter is employed in the DNA construct, it also will be desirable to include within the liposome an appropriate bacterial polymerase.

Liposomes can be made from several different types of lipids, e.g., phospholipids. A liposome may comprise natural phospholipids and lipids such as 1,2-distearoryl-sn-glycero-3-phosphatidyl choline (DSPC), sphingomyelin, egg phosphatidylcholines, monosialoganglioside, or any combination thereof.

Several other additives may be added to liposomes in order to modify their structure and properties. For instance, liposomes may further comprise cholesterol, sphingomyelin, and/or 1,2-dioleoyl-sn-glycero-3-phosphoethanolamine (DOPE), e.g., to increase stability and/or to prevent the leakage of the liposomal inner cargo.

In one embodiment, the liposome comprises a transport polymer, which may optionally be branched, comprising at least 10 amino acids and a ratio of histidine to non-histidine amino acids greater than 1.5 and less than 10. The branched transport polymer can comprise one or more backbones, one or more terminal branches, and optionally, one or more non-terminal branches. See, U.S. Pat. No. 7,070,807, incorporated herein by reference in its entirety. In one embodiment, the transport polymer is a Histidine-Lysine co-polymer (HKP) used to package and deliver mRNA and other cargos. See, U.S. Pat. Nos. 7,163,695, and 7,772,201, incorporated herein by reference in their entireties, In one embodiment, the lipid particles may be stable nucleic acid lipid particles (SNALPs). SNALPs may comprise an ionizable lipid (DLinDMA) (e.g., cationic at low pH), a neutral helper lipid, cholesterol, a diffusible polyethylene glycol (PEG)-lipid, or any combination thereof. In some examples, SNALPs may comprise synthetic cholesterol, dipalmitoylphosphatidylcholine, 3-N-[(w-methoxy polyethylene glycol)2000)carbamoyl]-1,2-dimyrestyloxy-propylamine, and cationic 1,2-dilinoleyloxy-3-N,Ndimethylaminopropane. In some examples, SNALPs may comprise synthetic cholesterol, 1,2-distearoyl-sn-glycero-3-phosphocholine, PEG-eDMA, and 1,2-dilinoleyloxy-3-(N;N-dimethyl)aminopropane (DLinDMA).

Polymer Based Vehicles

In one embodiment, the delivery vehicles may comprise polymer-based particles (e.g., nanoparticles). In one embodiment, the polymer-based particles may mimic a viral mechanism of membrane fusion. The polymer-based particles may be a synthetic copy of Influenza virus machinery and form transfection complexes with various types of nucleic acids ((siRNA, miRNA, plasmid DNA or synucleic acid component, mRNA) that cells take up via the endocytosis pathway, a process that involves the formation of an acidic compartment. The low pH in late endosomes acts as a chemical switch that renders the particle surface hydrophobic and facilitates membrane crossing. Once in the cytosol, the particle releases its payload for cellular action. This Active Endosome Escape technology is safe and maximizes transfection efficiency as it is using a natural uptake pathway. In one embodiment, the polymer-based particles may comprise alkylated and carboxyalkylated branched polyethylenimine. In some examples, the polymer-based particles are VIROMER, e.g., VIROMER RNAi, VIROMER RED, VIROMER mRNA. Example methods of delivering the systems and compositions herein include those described in Bawage S S et al., Synthetic mRNA expressed Cast 3a mitigates RNA virus infections, biorxiv.org/content/10.1101/370460v1. full doi: doi.org/10.1101/370460, Viromer® RED, a powerful tool for transfection of keratinocytes. doi: 10.13140/RG.2.2.16993.61281, Viromer® Transfection—Factbook 2018: technology, product overview, users' data., doi: 10.13140/RG.2.2.23912.16642.

Exosomes

The delivery vehicles may comprise exosomes. Exosomes include membrane bound extracellular vesicles, which can be used to contain and delivery various types of biomolecules, such as proteins, carbohydrates, lipids, and nucleic acids, and complexes thereof (e.g., RNPs). Examples of exosomes include those described in Schroeder A, et al., J Intern Med. 2010 January; 267(1):9-21; El-Andaloussi S, et al., Nat Protoc. 2012 December; 7(12):2112-26; Uno Y, et al., Hum Gene Ther. 2011 June; 22(6):711-9; Zou W, et al., Hum Gene Then 2011 April; 22(4):465-75. Exemplary exosomes can be generated from 293F cells, with mRNA-loaded exosomes driving higher mRNA expression than mRNA loaded LNPs in some instances. See, e.g. J. Biol. Chem. (2021) 297(5) 101266

In some examples, the exosome may form a complex (e.g., by binding directly or indirectly) to one or more components of the cargo. In certain examples, a molecule of an exosome may be fused with first adapter protein and a component of the cargo may be fused with a second adapter protein. The first and the second adapter protein may specifically bind each other, thus associating the cargo with the exosome. Examples of such exosomes include those described in Ye Y, et al., Biomater Sci. 2020 Apr. 28. doi: 10.1039/d0bm00427h.

Receptor-Mediated Delivery

Other expression constructs encoding the Cas12a (or Cas Type V) gene editing systems or components thereof are receptor-mediated delivery vehicles. These take advantage of the selective uptake of macromolecules by receptor-mediated endocytosis in almost all eukaryotic cells. Because of the cell type-specific distribution of various receptors, the delivery can be highly specific (Wu and Wu (1993) Adv. Drug Delivery Rev. 12:159-167). Receptor-mediated gene targeting vehicles generally consist of two components: a cell receptor-specific ligand and a DNA-binding agent. Several ligands have been used for receptor-mediated gene transfer. The most extensively characterized ligands are asialoorosomucoid (ASOR) and transferrin (see, e.g., Wu and Wu (1987), supra; Wagner et al. (1990) Proc. Natl. Acad. Sci. USA 87(9):3410-3414). A synthetic neoglycoprotein, which recognizes the same receptor as ASOR, has been used as a gene delivery vehicle (Ferkol et al. (1993) FASEB J. 7:1081-1091; Perales et al. (1994) Proc. Natl. Acad. Sci. USA 91(9):4086-4090), and epidermal growth factor (EGF) has also been used to deliver genes to squamous carcinoma cells (Myers, EPO 0273085).

In other embodiments, delivery vehicle comprising one or more expression constructs encoding the Cas12a gene editing systems or components thereof may comprise a ligand and a liposome. For example, Nicolau et al. (Methods Enzymol. (1987) 149:157-176) employed lactosy 1-ceramide, a galactose-terminal asialoganglioside, incorporated into liposomes and observed an increase in the uptake of the insulin gene by hepatocytes. Thus, it is feasible that a nucleic acid encoding a particular gene also may be specifically delivered into a cell by any number of receptor-ligand systems with or without liposomes. Also, antibodies to surface antigens on cells can similarly be used as targeting moieties.

In some embodiments, the promoters that may be used in the Cas12a gene editor delivery systems described herein may be constitutive, inducible, or tissue-specific. In some embodiments, the promoters may be a constitutive promoters. Non-limiting exemplary constitutive promoters include cytomegalovirus immediate early promoter (CMV), simian virus (SV40) promoter, adenovirus major late (MLP) promoter, Rous sarcoma virus (RSV) promoter, mouse mammary tumor virus (MMTV) promoter, phosphoglycerate kinase (PGK) promoter, elongation factor-alpha (EF1a) promoter, ubiquitin promoters, actin promoters, tubulin promoters, immunoglobulin promoters, a functional fragment thereof, or a combination of any of the foregoing. In some embodiments, the promoter may be a CMV promoter. In some embodiments, the promoter may be a truncated CMV promoter. In other embodiments, the promoter may be an EF1a promoter. In some embodiments, the promoter may be an inducible promoter. Non-limiting exemplary inducible promoters include those inducible by heat shock, light, chemicals, peptides, metals, steroids, antibiotics, or alcohol. In some embodiments, the inducible promoter may be one that has a low basal (non-induced) expression level, such as, e.g., the Tet-On® promoter (Clontech). In some embodiments, the promoter may be a tissue-specific promoter. In some embodiments, the tissue-specific promoter is exclusively or predominantly expressed in liver tissue. Non-limiting exemplary tissue-specific promoters include B29 promoter, CD14 promoter, CD43 promoter, CD45 promoter, CD68 promoter, desmin promoter, elastase-1 promoter, endoglin promoter, fibronectin promoter, Flt-1 promoter, GFAP promoter, GPIIb promoter, ICAM-2 promoter, INF-b promoter, Mb promoter, Nphs1 promoter, OG-2 promoter, SP-B promoter, SYN1 promoter, and WASP promoter.

Lipid Nanoparticles (LNPs)

The payloads (e.g., linear and circular mRNAs; nucleobase editing systems and/or components thereof) described herein may be encapsulated and delivered by lipid nanoparticles (LNPs) and compositions and/or formulations comprising RNA-encapsulated LNPs.

Below describes LNPs that may be used as the payload delivery vehicles contemplated herein, as well as the various ionizable lipids, structural lipids, PEGylated lipids, and phospholipids that may be used to make the herein LNPs for delivery payloads to cells. In addition, below describes additional LNP components that are contemplated, such as targeting moieties and other lipid components.

In one aspect, the present disclosure further provides delivery systems for delivery of a therapeutic payload (e.g., the RNA payloads described herein which may encode a polypeptide of interest, e.g., a nucleobase editing system or a therapeutic protein) disclosed herein. In some embodiments, a delivery system suitable for delivery of the therapeutic payload disclosed herein comprises a lipid nanoparticle (LNP) formulation.

In some embodiments, an LNP of the present disclosure comprises an ionizable lipid, a structural lipid, a PEGylated lipid (aka PEG lipid), and a phospholipid. In alternative embodiments, an LNP comprises an ionizable lipid, a structural lipid, a PEGylated lipid (aka PEG lipid), and a zwitterionic amino acid lipid. In some embodiments, an LNP further comprises a 5th lipid, besides any of the aforementioned lipid components. In some embodiments, the LNP encapsulates one or more elements of the active agent of the present disclosure. In some embodiments, an LNP further comprises a targeting moiety covalently or non-covalently bound to the outer surface of the LNP. In some embodiments, the targeting moiety is a targeting moiety that binds to, or otherwise facilitates uptake by, cells of a particular organ system.

In some embodiments, an LNP has a diameter of at least about 20 nm, 30 nm, 40 nm, 50 nm, 60 nm, 70 nm, 80 nm, or 90 nm. In some embodiments, an LNP has a diameter of less than about 100 nm, 110 nm, 120 nm, 130 nm, 140 nm, 150 nm, or 160 nm. In some embodiments, an LNP has a diameter of less than about 100 nm. In some embodiments, an LNP has a diameter of less than about 90 nm. In some embodiments, an LNP has a diameter of less than about 80 nm. In some embodiments, an LNP has a diameter of about 60-100 nm. In some embodiments, an LNP has a diameter of about 75-80 nm.

In some embodiments, the lipid nanoparticle compositions of the present disclosure are described according to the respective molar ratios of the component lipids in the formulation. As a non-limiting example, the mol-% of the ionizable lipid may be from about 10 mol-% to about 80 mol-%. As a non-limiting example, the mol-% of the ionizable lipid may be from about 20 mol-% to about 70 mol-%. As a non-limiting example, the mol-% of the ionizable lipid may be from about 30 mol-% to about 60 mol-%. As a non-limiting example, the mol-% of the ionizable lipid may be from about 35 mol-% to about 55 mol-%. As a non-limiting example, the mol-% of the ionizable lipid may be from about 40 mol-% to about 50 mol-%.

In some embodiments, the mol-% of the phospholipid may be from about 1 mol-% to about 50 mol-%. In some embodiments, the mol-% of the phospholipid may be from about 2 mol-% to about 45 mol-%. In some embodiments, the mol-% of the phospholipid may be from about 3 mol-% to about 40 mol-%. In some embodiments, the mol-% of the phospholipid may be from about 4 mol-% to about 35 mol-%. In some embodiments, the mol-% of the phospholipid may be from about 5 mol-% to about 30 mol-%. In some embodiments, the mol-% of the phospholipid may be from about 10 mol-% to about 20 mol-%. In some embodiments, the mol-% of the phospholipid may be from about 5 mol-% to about 20 mol-%.

In some embodiments, the mol-% of the structural lipid may be from about 10 mol-% to about 80 mol-%. In some embodiments, the mol-% of the structural lipid may be from about 20 mol-% to about 70 mol-%. In some embodiments, the mol-% of the structural lipid may be from about 30 mol-% to about 60 mol-%. In some embodiments, the mol-% of the structural lipid may be from about 35 mol-% to about 55 mol-%. In some embodiments, the mol-% of the structural lipid may be from about 40 mol-% to about 50 mol-%.

In some embodiments, the mol-% of the PEG lipid may be from about 0.1 mol-% to about 10 mol-%. In some embodiments, the mol-% of the PEG lipid may be from about 0.2 mol-% to about 5 mol-%. In some embodiments, the mol-% of the PEG lipid may be from about 0.5 mol-% to about 3 mol-%. In some embodiments, the mol-% of the PEG lipid may be from about 1 mol-% to about 2 mol-%. In some embodiments, the mol-% of the PEG lipid may be about 1.5 mol-%. In some embodiments, the mol-% of the PEG lipid may be about 2.5 mol-%.

i. Ionizable Lipids

In some embodiments, an LNP disclosed herein comprises an ionizable lipid. In some embodiments, an LNP comprises two or more ionizable lipids.

Described below are a number of exemplary ionizable lipids of the present disclosure.

In some embodiments, an LNP of the present disclosure comprises an ionizable lipid disclosed in one of US 2023/0053437; US 2019/0240354; US 2010/0130588; US 2021/0087135; WO 2021/204179; US 2021/0128488; US 2020/0121809; US 2017/0119904; US 2013/0108685; US 2013/0195920; US 2015/0005363; US 2014/0308304; US 2013/0053572; WO 2019/232095A1; WO 2021/077067; WO 2019/152557; US 2017/0210697; or WO 2019/089828A1, each of which is incorporated by reference herein in their entirety.

In some embodiments, an LNP described herein comprises a lipid, e.g., an ionizable lipid, disclosed in US Application publication US2017/0119904, which is incorporated by reference herein, in its entirety.

In some embodiments, an LNP described herein comprises a lipid, e.g., an ionizable lipid, disclosed in PCT Application publication WO2021/204179, which is incorporated by reference herein, in its entirety.

In some embodiments, an LNP described herein comprises a lipid, e.g., an ionizable lipid, disclosed in PCT Application WO2022/251665A1, which is incorporated by reference herein, in its entirety.

In some embodiments, an LNP described herein comprises an ionizable lipid of Table Z:

TABLE Z

| Exemplary Ionizable Lipids | |
|---|---|
| Compound # | Structure |
| L-1 | 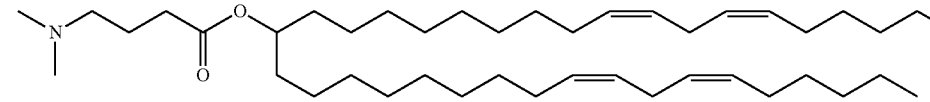 |
| L-2 | 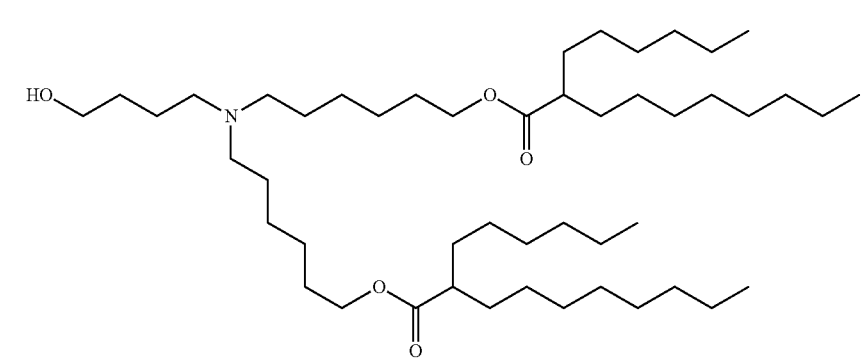 [SMILES: CCCCCCCCC(CCCCCC)C(=O)OCCCCCCN(CCCCO)CCCCCCOC(=O)C(CCCCCC)CCCCCCCC] |

TABLE Z-continued

Exemplary Ionizable Lipids

| Compound # | Structure |
|---|---|
| L-3 | 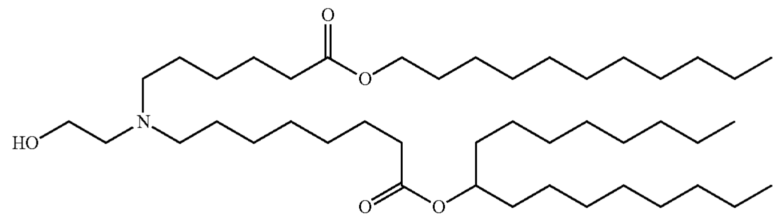 [SMILES: CCCCCCCCCCCOC(=O)CCCCCN(CCO)CCCCCCCC(=O)OC(CCCCCCCC)CCCCCCCC] |
| L-4 | 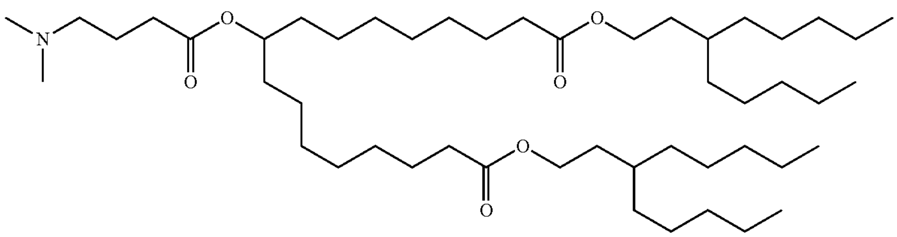 [SMILES: CCCCCC(CCCCC)CCOC(=O)CCCCCCCC(CCCCCCCC(=O)OCCC(CCCCC)CCCCC)OC(=O)CCCN(C)C] |
| L-5 | 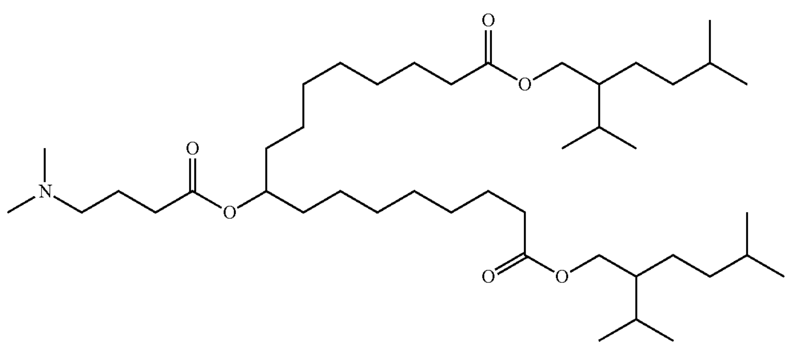 [SMILES: CC(C)CCC(COC(=O)CCCCCCCC(CCCCCCCC(=O)OCC(CCC(C)C)C(C)C)OC(=O)CCCN(C)C)C(C)C] |
| L-6 | 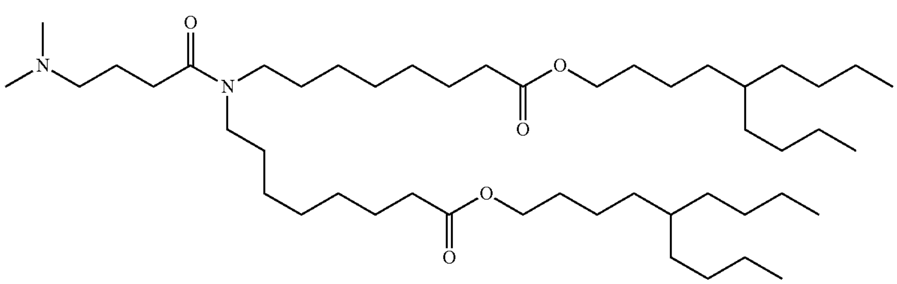 [SMILES: CCCCC(CCCC)CCCCOC(=O)CCCCCCCN(CCCCCCCC(=O)OCCCCC(CCCC)CCCC)C(=O)CCCN(C)C] |
| L-7 | 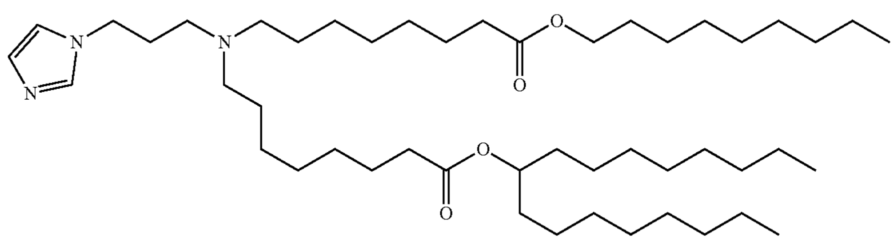 [SMILES: CCCCCCCCCOC(=O)CCCCCCCN(CCCCCCCC(=O)OC(CCCCCCCC)CCCCCCCC)CCCn1ccnc1] |

TABLE Z-continued

Exemplary Ionizable Lipids

| Compound # | Structure |
|---|---|
| L-8 | 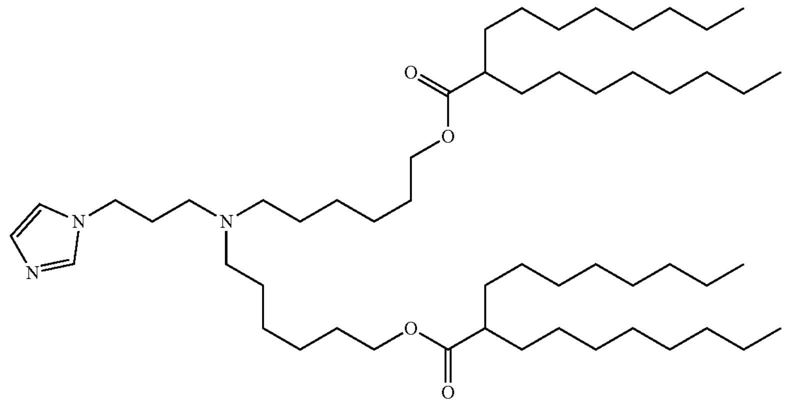 [SMILES: CCCCCCCCC(CCCCCCCC)C(=O)OCCCCCCN(CCCCCCOC(=O)C(CCCCCCCC)CCCCCCCC)CCCn1ccnc1] |
| L-9 | 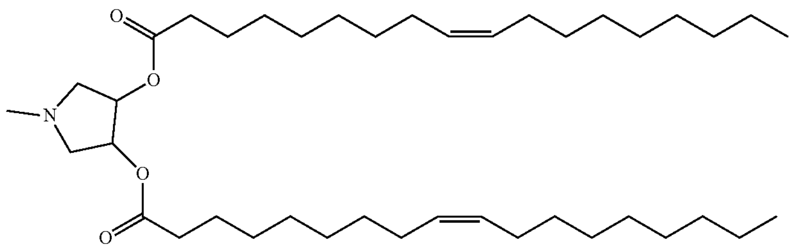 [SMILES: CCCCCCCC/C=C\CCCCCCCC(=O)OC1CN(C)CC1OC(=O)CCCCCCC/C=C\CCCCCCCC] |
| L-10 | 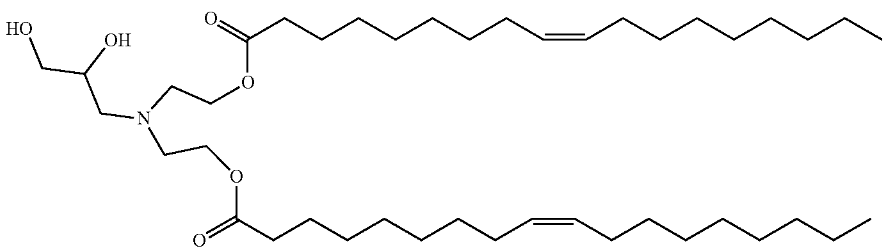 [SMILES: CCCCCCCC/C=C\CCCCCCCC(=O)OCCN(CCOC(=O)CCCCCCC/C=C\CCCCCCCC)CC(O)CO] |

In some embodiments, the ionizable lipid is MC3.

In some embodiments, an LNP of the present disclosure comprises an ionizable lipid disclosed in PCT Application Publication WO2023044343A1, which is incorporated by reference herein, in its entirety.

Formula (VII-A)

In some embodiments, Lipids of the Disclosure have a structure of Formula (VII-A):

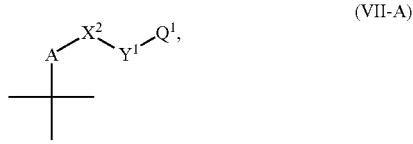
(VII-A)

or a pharmaceutically acceptable salt thereof, wherein:
A is —N(—$X^1R^1$)—, —C(R')(-$L^1$-N(R")$R^6$)—, —C(R') (—$OR^{7a}$)—, —C(R')(—N(R")$R^{8a}$)—, —C(R')(—C (=O)$OR^{9a}$)—, —C(R')(—C(=O)N(R")$R^{10a}$)—, or —C(=N—$R^{11a}$);

T is —$X^{2a}$—$Y^{1a}$-$Q^{1a}$ or —$X^3$—C(=O)$OR^4$;
$X^1$ is optionally substituted $C_2$-$C_6$ alkylenyl;
$R^1$ is —OH, —$R^{1a}$,

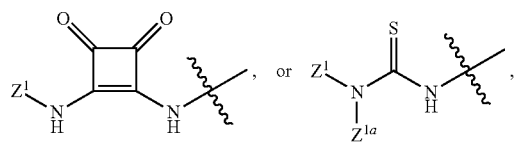

$Z^1$ is optionally substituted $C_1$-$C_6$ alkyl;
$Z^{1a}$ is hydrogen or optionally substituted $C_1$-$C_6$ alkyl;
$X^2$ and $X^{2a}$ are independently optionally substituted $C_2$-$C_{14}$ alkylenyl or optionally substituted $C_2$-$C_{14}$ alkenylenyl;
$X^3$ is optionally substituted $C_2$-$C_{14}$ alkylenyl or optionally substituted $C_2$-$C_{14}$ alkenylenyl;
(i) $Y^1$ is

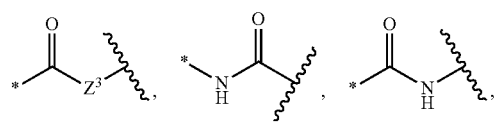

-continued

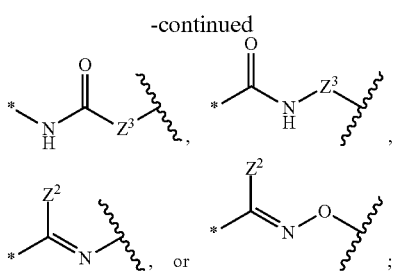

wherein the bond marked with an "*" is attached to $X^2$;
$Y^{1a}$ is

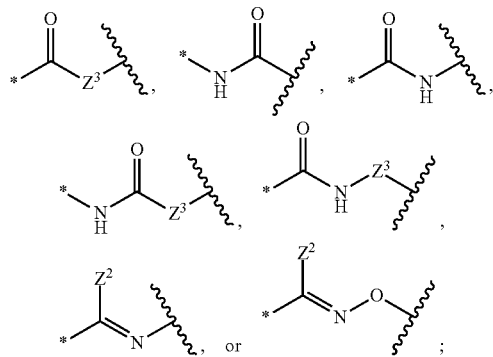

wherein the bond marked with an "*" is attached to $X^{2a}$;
each $Z^2$ is independently H or optionally substituted $C_1$-$C_8$ alkyl;
each $Z^3$ is independently optionally substituted $C_1$-$C_6$ alkylenyl;
$Q^1$ is —$NR^2R^3$, —$CH(OR^{2'})(OR^3)$, —$CR^2$=$C(R^3)(R^{12})$, or —$C(R^2)(R^3)(R^{12})$;
$Q^1a$ is —$NR^{2'}R^{3'}$, —$CH(OR^{2'})(OR^{3'})$, —$CR^2$=$C(R^3)(R^{12})$, or —$C(R^{2'})(R^{3'})(R^{12'})$; or
(ii) $Y^1$ is

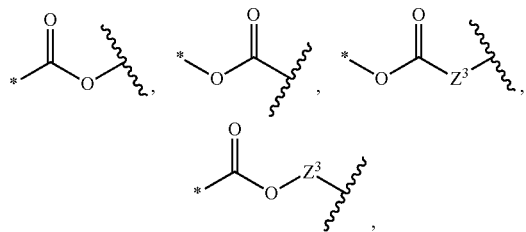

wherein the bond marked with an "*" is attached to $X^2$;
$Y^{1a}$ is

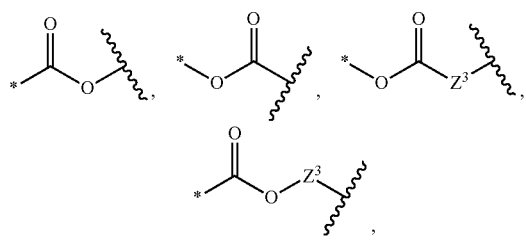

wherein the bond marked with an "*" is attached to $X^{2a}$;
each $Z^2$ is independently H or optionally substituted $C_1$-$C_8$ alkyl;
each $Z^3$ is independently optionally substituted $C_1$-$C_6$ alkylenyl;
$Q^1$ is —$NR^2R^3$;
$Q^{1a}$ is —$NR^{2'}R^{3'}$;
$R^2$, $R^3$, and $R^{12}$ are independently hydrogen, optionally substituted $C_1$-$C_{14}$ alkyl, optionally substituted $C_2$-$C_{14}$ alkenylenyl, or —$(CH_2)_m$-G-$(CH_2)_n$H;
$R^{2'}$, $R^{3'}$, and $R^{12'}$ are independently hydrogen, optionally substituted $C_1$-$C_{14}$ alkyl, optionally substituted $C_2$-$C_{14}$ alkenylenyl, or —$(CH_2)_m$-G-$(CH_2)_n$H;
G is a $C_3$-$C_8$ cycloalkylenyl;
each m is independently 0, 1, 2, 3, 4, 5, 6, 7, 8, 9, 10, 11, or 12;
each n is independently 0, 1, 2, 3, 4, 5, 6, 7, 8, 9, 10, 11, or 12;
$X^3$ is optionally substituted $C_2$-$C_{14}$ alkylenyl;
$R^4$ is optionally substituted $C_4$-$C_{14}$ alkyl;
$L^1$ is $C_1$-$C_8$ alkylenyl;
$R^6$ is $C_1$-$C_6$ alkyl, (hydroxy)$C_1$-$C_6$ alkyl, or (amino)$C_1$-$C_6$ alkyl
$R^{7a}$ is —$C(=O)N(R''')R^{7b}$, —$C(=S)N(R''')R^{7b}$, —$N$=$C(R^{7b})(R^{7c})$, or

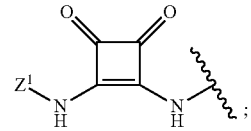

$R^{7b}$ is $C_1$-$C_6$ alkyl, (hydroxy)$C_1$-$C_6$ alkyl, or (amino)$C_1$-$C_6$ alkyl;
$R^{7c}$ is hydrogen or $C_1$-$C_6$ alkyl;
$R^{8a}$ is —$C(=O)N(R''')R^{8b}$, —$C(=S)N(R''')R^{8b}$, —$N$=$C(R^{8b})(R^{8c})$, or

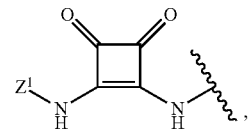

$R^{8b}$ is $C_1$-$C_6$ alkyl, (hydroxy)$C_1$-$C_6$ alkyl, or (amino)$C_1$-$C_6$ alkyl;
$R^{8c}$ is hydrogen or $C_1$-$C_6$ alkyl;
$R^{9a}$ is —$N$=$C(R^{9b})(R^{9c})$;
$R^{9b}$ is $C_1$-$C_6$ alkyl, (hydroxy)$C_1$-$C_6$ alkyl, or (amino)$C_1$-$C_6$ alkyl;
$R^{9c}$ is hydrogen or $C_1$-$C_6$ alkyl;
$R^{10a}$ is —$N$=$C(R^{10b})(R^{10c})$;
$R^{10b}$ is $C_1$-$C_6$ alkyl, (hydroxy)$C_1$-$C_6$ alkyl, or (amino)$C_1$-$C_6$ alkyl;
$R^{10c}$ is hydrogen or $C_1$-$C_6$ alkyl;
$R^{11a}$ is —$OR^{11b}$, —$N(R'')R^{11b}$, —$OC(=O)R^{11b}$, or —$N(R'')C(=O)R^{11b}$;
$R^{11b}$ is $C_1$-$C_6$ alkyl, (hydroxy)$C_1$-$C_6$ alkyl, or (amino)$C_1$-$C_6$ alkyl;
R' is hydrogen or $C_1$-$C_6$ alkyl;
R'' is hydrogen or $C_1$-$C_6$ alkyl; and
R''' is hydrogen or $C_1$-$C_6$ alkyl.

Formula (VIII-A)

In some embodiments, Lipids of the Disclosure have a structure of Formula (VII-A), wherein the Lipids of the Disclosure have a structure of Formula (VIII-A):

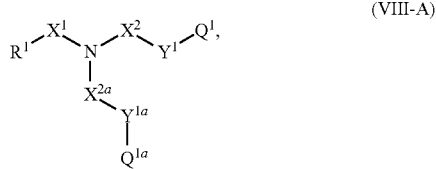

(VIII-A)

or a pharmaceutically acceptable salt thereof.

Formula (VII-B)

In some embodiments, Lipids of the Disclosure have a structure of Formula (VII-B):

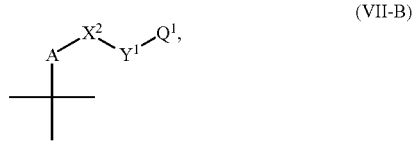

(VII-B)

or a pharmaceutically acceptable salt thereof, wherein:

A is —C(R')(-L$^1$-N(R''')R$^6$)—, —C(R')(—OR$^{7a}$)—, —C(R')(—N(R''')R$^{8a}$)—, —C(R')(—C(=O)OR$^{9a}$)—, —C(R')(—C(=O)N(R''')R$^{10a}$)—, or —C(=N—R$^{11a}$)—;

T is —X$^{2a}$—Y$^{1a}$-Q$^{1a}$ or —X$^3$—C(=O)OR$^4$;

X$^2$ and X$^{2a}$ are independently optionally substituted C$_2$-C$_{14}$ alkylenyl or optionally substituted C$_2$-C$_{14}$ alkenylenyl;

X$^3$ is optionally substituted C$_1$-C$_{14}$ alkylenyl or optionally substituted C$_2$-C$_{14}$ alkenylenyl;

Y$^1$ is

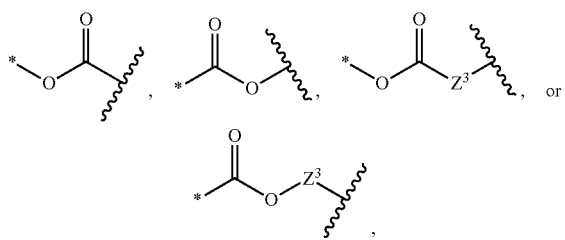

wherein the bond marked with an "*" is attached to X$^2$;

Y$^{1a}$ is

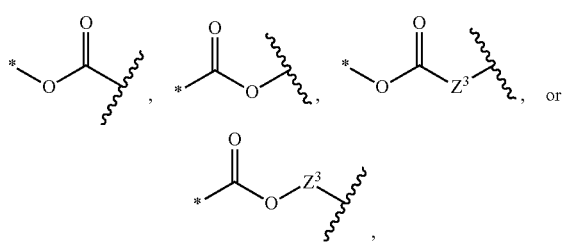

wherein the bond marked with an "*" is attached to X$^{2a}$;

each Z$^3$ is independently optionally substituted C$_1$-C$_6$ alkylenyl or optionally substituted C$_2$-C$_{14}$ alkenylenyl;

Q$^1$ is —NR$^2$R$^3$, —CH(OR$^2$)(OR$^3$), —CR$^2$=C(R$^3$)(R$^{12}$), or —C(R$^2$)(R$^3$)(R$^{12}$);

Q$^{1a}$ is —NR$^{2'}$R$^{3'}$, —CH(OR$^{2'}$)(OR$^{3'}$), —CR$^2$=C(R$^3$)(R$^{12}$), or —C(R$^{2'}$)(R$^{3'}$)(R$^{12'}$);

R$^2$, R$^3$, and R$^{12}$ are independently hydrogen, optionally substituted C$_1$-C$_{14}$ alkyl, optionally substituted C$_2$-C$_{14}$ alkenylenyl, or —(CH$_2$)$_m$-G-(CH$_2$)$_n$H;

R$^{2'}$, R$^{3'}$, and R$^{12'}$ are independently hydrogen, optionally substituted C$_1$-C$_{14}$ alkyl, optionally substituted C$_2$-C$_{14}$ alkenylenyl, or —(CH$_2$)$_m$-G-(CH$_2$)$_n$H;

G is a C$_3$-C$_8$ cycloalkylenyl;

each m is independently 0, 1, 2, 3, 4, 5, 6, 7, 8, 9, 10, 11, or 12;

each n is independently 0, 1, 2, 3, 4, 5, 6, 7, 8, 9, 10, 11, or 12;

X$^3$ is optionally substituted C$_2$-C$_{14}$ alkylenyl;

R$^4$ is optionally substituted C$_4$-C$_{14}$ alkyl;

L$^1$ is C$_1$-C$_8$ alkylenyl;

R$^6$ is (hydroxy)C$_1$-C$_6$ alkyl, or (amino)C$_1$-C$_6$ alkyl.

R$^{7a}$ is —C(=O)N(R''')R$^{7b}$, —C(=S)N(R''')R$^{7b}$, —N=C(R$^{7b}$)(R$^{7c}$),

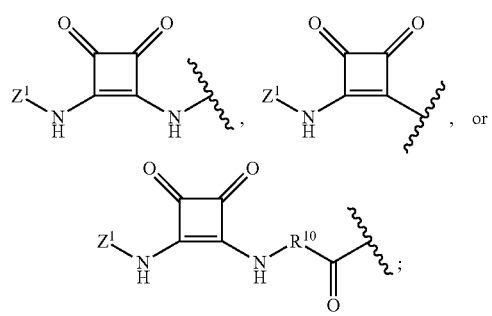

Z$^1$ is optionally substituted C$_1$-C$_6$ alkyl;

R$^{10}$ is C$_1$-C$_6$ alkylenyl;

R$^{7b}$ is C$_1$-C$_6$ alkyl, (hydroxy)C$_1$-C$_6$ alkyl, or (amino)C$_1$-C$_6$ alkyl;

R$^{7c}$ is hydrogen or C$_1$-C$_6$ alkyl;

R$^{8a}$ is —C(=O)N(R''')R$^{8b}$, —C(=S)N(R''')R$^{8b}$, —N=C(R$^{8b}$)(R$^{8c}$),

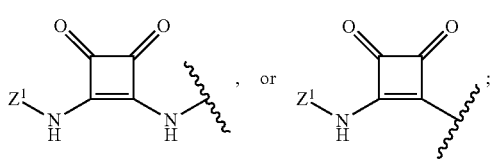

R$^{8b}$ is C$_1$-C$_6$ alkyl, (hydroxy)C$_1$-C$_6$ alkyl, or (amino)C$_1$-C$_6$ alkyl;

R$^{8c}$ is hydrogen or C$_1$-C$_6$ alkyl;

R$^{9a}$ is —N=C(R$^{9b}$)(R$^{9c}$);

R$^{9b}$ is C$_1$-C$_6$ alkyl, (hydroxy)C$_1$-C$_6$ alkyl, or (amino)C$_1$-C$_6$ alkyl;

R$^{9c}$ is hydrogen or C$_1$-C$_6$ alkyl;

R$^{10a}$ is —N=C(R$^{10b}$)(R$^{10c}$);

R$^{10b}$ is C$_1$-C$_6$ alkyl, (hydroxy)C$_1$-C$_6$ alkyl, or (amino)C$_1$-C$_6$ alkyl;

R$^{10c}$ is hydrogen or C$_1$-C$_6$ alkyl;

R$^{11a}$ is —OR$^{11b}$, —N(R'')R$^{11b}$, —OC(=O)R$^{11b}$, or —N(R'')C(=O)R$^{11b}$;

R$^{11b}$ is C$_1$-C$_6$ alkyl, (hydroxy)C$_1$-C$_6$ alkyl, or (amino)C$_1$-C$_6$ alkyl;

R' is hydrogen or $C_1$-$C_6$ alkyl;

R" is hydrogen or $C_1$-$C_6$ alkyl; and

R''' is hydrogen or $C_1$-$C_6$ alkyl.

In some embodiments, Lipids of the Disclosure have a structure of Formula (VII-B), wherein A is —C(R')(-$L^1$-N(R")$R^6$)—.

In some embodiments, Lipids of the Disclosure have a structure of Formula (VII-B), wherein A is —C(R')(—$OR^{7a}$)—.

In some embodiments, Lipids of the Disclosure have a structure of Formula (VII-B), wherein A is —C(R')(—N(R")$R^{8a}$).

In some embodiments, Lipids of the Disclosure have a structure of Formula (VII-B), wherein A is —C(R')(—C(=O)$OR^{9a}$).

In some embodiments, Lipids of the Disclosure have a structure of Formula (VII-B), wherein A is —C(R')(—C(=O)N(R")$R^{10a}$)—.

In some embodiments, Lipids of the Disclosure have a structure of Formula (VII-B), wherein A is —C(=N—$R^{11a}$)—.

In some embodiments, Lipids of the Disclosure have a structure of Formula (VII-B), wherein T is —$X^{2a}$—$Y^{1a}$-$Q^{1a}$.

In some embodiments, Lipids of the Disclosure have a structure of Formula (VII-B), wherein T is —$X^3$—C(=O)$OR^4$.

In some embodiments, Lipids of the Disclosure have a structure of Formula (VII-B), wherein $X^2$ and/or $X^{2a}$ are/is optionally substituted $C_2$-$C_{14}$ alkylenyl (e.g., $C_2$-$C_{10}$ alkylenyl, $C_2$-$C_8$ alkylenyl, $C_2$, $C_3$, $C_4$, $C_5$, $C_6$, $C_7$, or $C_8$ alkylenyl). In some embodiments, Lipids of the Disclosure have a structure of Formula (VII-B), wherein $X^2$ is $C_2$-$C_{14}$ alkylenyl. In some embodiments, Lipids of the Disclosure have a structure of Formula (VII-B), wherein $X^{2a}$ is $C_2$-$C_{14}$ alkylenyl In some embodiments, Lipids of the Disclosure have a structure of Formula (VII-B), wherein $Y^1$ and/or $Y^{1a}$ are/is

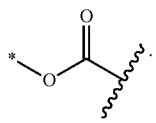

In some embodiments, Lipids of the Disclosure have a structure of Formula (VII-B), wherein $Y^1$ is

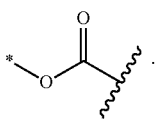 [SMILES: *OC(*)=O]

In some embodiments, Lipids of the Disclosure have a structure of Formula (VII-B), wherein $Y^{1a}$ is

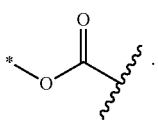 [SMILES: *OC(*)=O]

In some embodiments, Lipids of the Disclosure have a structure of Formula (VII-B), wherein $Y^1$ and/or $Y^{1a}$ are/is

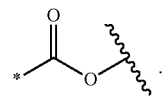

In some embodiments, Lipids of the Disclosure have a structure of Formula (VII-B), wherein $Y^1$ is

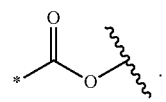

In some embodiments, Lipids of the Disclosure have a structure of Formula (VII-B), wherein $Y^{1a}$ is

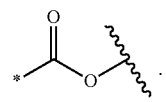

In some embodiments, Lipids of the Disclosure have a structure of Formula (VII-B), wherein $Y^1$ and/or $Y^{1a}$ are/is

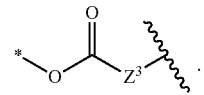

In some embodiments, Lipids of the Disclosure have a structure of Formula (VII-B), wherein $Y^1$ is

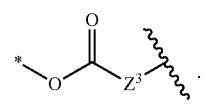

In some embodiments, Lipids of the Disclosure have a structure of Formula (VII-B), wherein $Y^{1a}$ is

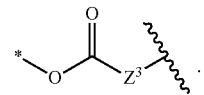

In some embodiments, Lipids of the Disclosure have a structure of Formula (VII-B), wherein $Y^1$ and/or $Y^{1a}$ are/is

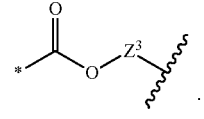

In some embodiments, Lipids of the Disclosure have a structure of Formula (VII-B), wherein $Y^1$ is

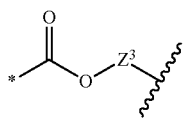

In some embodiments, Lipids of the Disclosure have a structure of Formula (VII-B), wherein $Y^{1a}$ is

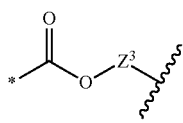

In some embodiments, Lipids of the Disclosure have a structure of Formula (VII-B), wherein $Q^1$ and/or $Q^{1a}$ are/is $—C(R^{2'})(R^{3'})(R^{12'})$. In some embodiments, Lipids of the Disclosure have a structure of Formula (VII-B), wherein $Q^1$ is $—C(R^{2'})(R^{3'})(R^{12'})$. In some embodiments, Lipids of the Disclosure have a structure of Formula (VII-B), wherein $Q^{1a}$ is $—C(R^{2'})(R^{3'})(R^{12'})$.

In some embodiments, Lipids of the Disclosure have a structure of Formula (VII-B), wherein $X^3$ is optionally substituted $C_1$-$C_{14}$ alkylenyl (e.g., $C_1$-$C_6$, $C_1$-$C_4$ alkylenyl). In some embodiments, Lipids of the Disclosure have a structure of Formula (VII-B), wherein $X^3$ is $C_1$-$C_{14}$ alkylenyl.

In some embodiments, Lipids of the Disclosure have a structure of Formula (VII-B), wherein $R^2$, $R^3$, $R^{12}$, $R^{2'}$, $R^{3'}$, and/or $R^{12'}$ are hydrogen. In some embodiments, Lipids of the Disclosure have a structure of Formula (VII-B), wherein $R^2$ is hydrogen. In some embodiments, Lipids of the Disclosure have a structure of Formula (VII-B), wherein $R^3$ is hydrogen. In some embodiments, Lipids of the Disclosure have a structure of Formula (VII-B), wherein $R^{12}$ is hydrogen. In some embodiments, Lipids of the Disclosure have a structure of Formula (VII-B), wherein $R^{2'}$ is hydrogen. In some embodiments, Lipids of the Disclosure have a structure of Formula (VII-B), wherein $R^{3'}$ is hydrogen. In some embodiments, Lipids of the Disclosure have a structure of Formula (VII-B), wherein $R^{12'}$ is hydrogen.

In some embodiments, Lipids of the Disclosure have a structure of Formula (VII-B), wherein $R^2$, $R^3$, $R^{12}$, $R^{2'}$, $R^{3'}$, and/or $R^{12'}$ are optionally substituted $C_1$-$C_{14}$ alkyl (e.g., $C_4$-$C_{10}$ alkyl, $C_5$, $C_6$, $C_7$, $C_8$, $C_9$ alkyl). In some embodiments, Lipids of the Disclosure have a structure of Formula (VII-B), wherein $R^2$ is $C_4$-$C_{10}$ alkyl. In some embodiments, Lipids of the Disclosure have a structure of Formula (VII-B), wherein $R^3$ is $C_4$-$C_{10}$ alkyl. In some embodiments, Lipids of the Disclosure have a structure of Formula (VII-B), wherein $R^{12}$ is $C_4$-$C_{10}$ alkyl. In some embodiments, Lipids of the Disclosure have a structure of Formula (VII-B), wherein $R^{2'}$ is $C_4$-$C_{10}$ alkyl. In some embodiments, Lipids of the Disclosure have a structure of Formula (VII-B), wherein $R^{3'}$ is $C_4$-$C_{10}$ alkyl. In some embodiments, Lipids of the Disclosure have a structure of Formula (VII-B), wherein $R^{12'}$ is $C_4$-$C_{10}$ alkyl.

In some embodiments, Lipids of the Disclosure have a structure of Formula (VII-B), wherein $R^4$ is optionally substituted $C_4$-$C_{14}$ alkyl (e.g., $C_8$-$C_{14}$ alkyl, linear $C_8$-$C_{14}$ alkyl, $C_8$, $C_9$, $C_{10}$, $C_{11}$, $C_{12}$, $C_{13}$, or $C_{14}$ alkyl). In some embodiments, Lipids of the Disclosure have a structure of Formula (VII-B), wherein $R^4$ is linear $C_8$-$C_{14}$ alkyl. In some embodiments, Lipids of the Disclosure have a structure of Formula (VII-B), wherein $R^4$ is linear $C_{11}$ alkyl.

In some embodiments, Lipids of the Disclosure have a structure of Formula (VII-B), wherein $L^1$ is $C_1$-$C_3$ alkylenyl.

In some embodiments, Lipids of the Disclosure have a structure of Formula (VII-B), wherein $R^6$ is (hydroxy)$C_1$-$C_6$ alkyl.

In some embodiments, Lipids of the Disclosure have a structure of Formula (VII-B), wherein $R^{7a}$ is

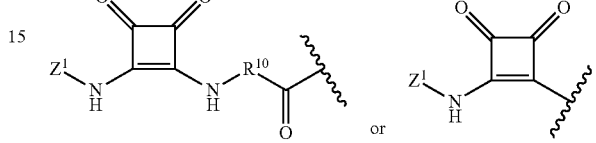

In some embodiments, Lipids of the Disclosure have a structure of Formula (VII-B), wherein $R^{7a}$ is

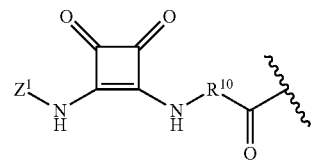

In some embodiments, Lipids of the Disclosure have a structure of Formula (VII-B), wherein $R^{7a}$ is

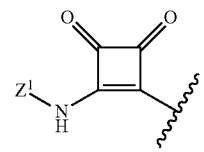

In some embodiments, Lipids of the Disclosure have a structure of Formula (VII-B), wherein $R^{7a}$ is selected from the group consisting of $—C(=O)N(R')R^{7b}$, $—C(=S)N(R')R^{7b}$, and $—N=C(R^{7b})(R^{7c})$. In some embodiments, Lipids of the Disclosure have a structure of Formula (VII-B), wherein $R^{7a}$ is $—C(=O)N(R')R^{7b}$. In some embodiments, Lipids of the Disclosure have a structure of Formula (VII-B), wherein $R^{7a}$ is $—C(=S)N(R')R^{7b}$. In some embodiments, Lipids of the Disclosure have a structure of Formula (VII-B), wherein $R^{7a}$ is $—N=C(R^{7b})(R^{7c})$.

In some embodiments, Lipids of the Disclosure have a structure of Formula (VII-B), wherein $R^{8a}$ is selected from the group consisting of $—C(=O)N(R')R^{8b}$, $—C(=S)N(R')R^{8b}$, and $—N=C(R^{8b})(R^{8c})$. In some embodiments, Lipids of the Disclosure have a structure of Formula (VII-B), wherein $R^{8a}$ is $—C(=O)N(R')R^{8b}$. In some embodiments, Lipids of the Disclosure have a structure of Formula (VII-B), wherein $R^{8a}$ is $—C(=S)N(R')R^{8b}$. In some embodiments, Lipids of the Disclosure have a structure of Formula (VII-B), wherein $R^{8a}$ is $—N=C(R^{8b})(R^{8c})$.

In some embodiments, Lipids of the Disclosure have a structure of Formula (VII-B), wherein $R^{8a}$ is

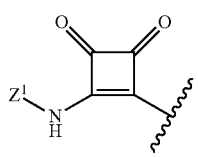

In some embodiments, Lipids of the Disclosure have a structure of Formula (VII-B), wherein $R^{9b}$ is (hydroxy)$C_1$-$C_6$ alkyl.

In some embodiments, Lipids of the Disclosure have a structure of Formula (VII-B), wherein $R^{10b}$ is (amino)$C_1$-$C_6$ alkyl.

In some embodiments, Lipids of the Disclosure have a structure of Formula (VII-B), wherein $R^{11a}$ is —$OR^{11b}$ or —$OC(=O)R^{11b}$. In some embodiments, Lipids of the Disclosure have a structure of Formula (VII-B), wherein $R^{11a}$ is —$OR^{11b}$. In some embodiments, Lipids of the Disclosure have a structure of Formula (VII-B), wherein $R^{11a}$ is —$OC(=O)R^{11b}$.

In some embodiments, Lipids of the Disclosure have a structure of Formula (VII-B), wherein $R^{11a}$ is —$N(R'')R^{11b}$ or —$N(R'')C(=O)R^{11b}$. In some embodiments, Lipids of the Disclosure have a structure of Formula (VII-B), wherein $R^{11a}$ is —$N(R'')R^{11b}$. In some embodiments, Lipids of the Disclosure have a structure of Formula (VII-B), wherein $R^{11a}$ is —$N(R'')C(=O)R^{11b}$.

In some embodiments, Lipids of the Disclosure have a structure of Formula (VII-B), wherein $R^{1b}$ is (amino)$C_1$-$C_6$ alkyl.

Formula (III-C)

In some embodiments, Lipids of the Disclosure have a structure of Formula (III-C):

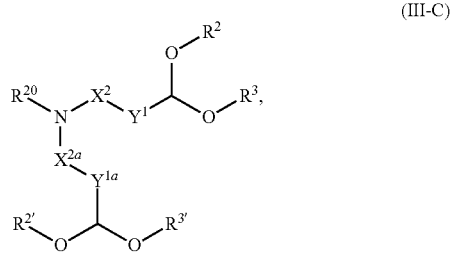

(III-C)

or a pharmaceutically acceptable salt thereof, wherein
  $R^{20}$ is $C_1$-$C_6$ alkylenyl-$NR^{20'}C(O)OR^{20''}$;
  $R^{20'}$ is hydrogen or optionally substituted $C_1$-$C_6$ alkyl;
  $R^{20''}$ is optionally substituted $C_1$-$C_6$ alkyl, phenyl, or benzyl;
  $Z^1$ is optionally substituted $C_1$-$C_6$ alkyl;
  $X^2$ and $X^{2a}$ are independently optionally substituted $C_2$-$C_{14}$ alkylenyl;
  $Y^1$ and $Y^{1a}$ are independently

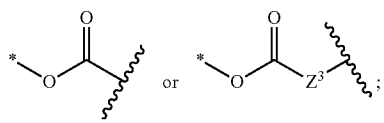

wherein the bond marked with an "*" is attached to $X^2$ or $X^{2a}$;
  $Z^3$ is independently optionally substituted $C_2$-$C_6$ alkylenyl;
  $R^2$ and $R^3$ are independently optionally substituted $C_4$-$C_{14}$ alkyl; and
  $R^{2'}$ and $R^{3'}$ are independently optionally substituted $C_4$-$C_{14}$ alkyl.

In some embodiments, Lipids of the Disclosure have a structure of Formula (III-C), wherein $R^{20}$ is —$CH_2CH_2CH_2NHC(O)O$-t-butyl or —$CH_2CH_2CH_2NHC(O)O$-benzyl. In some embodiments, Lipids of the Disclosure have a structure of Formula (III-C), wherein $R^{20}$ is —$CH_2CH_2CH_2NHC(O)O$-t-butyl. In some embodiments, Lipids of the Disclosure have a structure of Formula (III-C), wherein $R^{20}$ is —$CH_2CH_2CH_2NHC(O)O$-benzyl.

In some embodiments, Lipids of the Disclosure have a structure of Formula (III-C), wherein $X^2$ and $X^{2a}$ are independently $C_4$-$C_8$ alkylenyl (e.g., $C_5$, $C_6$, $C_7$ alkylenyl). In some embodiments, Lipids of the Disclosure have a structure of Formula (III-C), wherein $X^2$ is $C_6$ alkyl. In some embodiments, Lipids of the Disclosure have a structure of Formula (III-C), wherein $X^{2a}$ is $C_6$ alkyl In some embodiments, Lipids of the Disclosure have a structure of Formula (III-C), wherein $Y^1$ and $Y^{1a}$ are

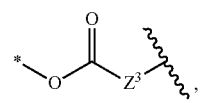

wherein $Z^3$ is $C_2$-$C_4$alkylenyl (e.g., $C_2$ alkylenyl). In some embodiments, Lipids of the Disclosure have a structure of Formula (III-C), wherein $Y^1$ is

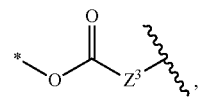

wherein $Z^3$ is $C_2$-$C_4$alkylenyl (e.g., $C_2$ alkylenyl). In some embodiments, Lipids of the Disclosure have a structure of Formula (III-C), wherein $Y^{1a}$ is

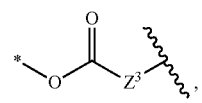

wherein $Z^3$ is $C_2$-$C_4$alkylenyl (e.g., $C_2$ alkylenyl).

In some embodiments, Lipids of the Disclosure have a structure of Formula (III-C), wherein R2, R3, R2' and R3' are independently optionally substituted C4-C10 alkyl (e.g., C6-C9alkyl, C6, C7, C8, C9 alkyl). In some embodiments, Lipids of the Disclosure have a structure of Formula (III-C), wherein R2 is C6-C9alkyl. In some embodiments, Lipids of the Disclosure have a structure of Formula (III-C), wherein R3 is C6-C9alkyl. In some embodiments, Lipids of the Disclosure have a structure of Formula (III-C), wherein $R^{2'}$ is $C_6$-$C_9$alkyl. In some embodiments, Lipids of the Disclosure have a structure of Formula (III-C), wherein $R^{3'}$ is $C_6$-$C_9$alkyl.

Formula (III-D)

In some embodiments, Lipids of the Disclosure have a structure of Formula (III-D):

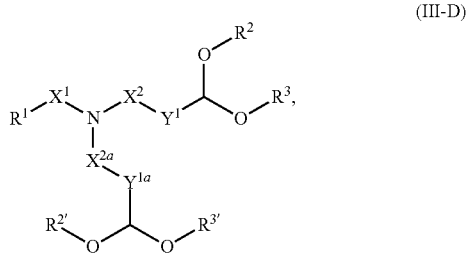

(III-D)

or a pharmaceutically acceptable salt thereof, wherein
$R^1$ is —OH;
$X^1$ is optionally substituted $C_4$ alkylenyl;
$X^2$ and $X^{2a}$ are independently optionally substituted $C_2$-$C_{14}$ alkylenyl;
$Y^1$ and $Y^{1a}$ are independently

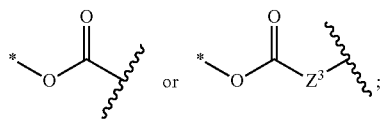

$Z^3$ is independently optionally substituted $C_2$-$C_6$ alkylenyl;
$R^2$ and $R^3$ are independently optionally substituted $C_4$-$C_{14}$ alkyl or $C_1$-$C_2$ alkyl substituted with optionally substituted cyclopropyl; or
$R^{2'}$ and $R^{3'}$ are independently optionally substituted $C_4$-$C_{14}$ alkyl or $C_1$-$C_2$ alkyl substituted with optionally substituted cyclopropyl.

In some embodiments, Lipids of the Disclosure have a structure of Formula (III-D), wherein $X^1$ is $C_4$ alkylenyl.

In some embodiments, Lipids of the Disclosure have a structure of Formula (III-D), wherein $X^2$ and $X^{2a}$ are independently optionally substituted $C_4$-$C_{10}$ alkylenyl (e.g., $C_5$, $C_6$, $C_7$, $C_8$, $C_9$, or $C_{10}$ alkylenyl). In some embodiments, Lipids of the Disclosure have a structure of Formula (III-D), wherein $X^2$ is $C_4$-$C_{10}$ alkylenyl. In some embodiments, Lipids of the Disclosure have a structure of Formula (III-D), wherein $X^{2a}$ is $C_4$-$C_{10}$ alkylenyl.

In some embodiments, Lipids of the Disclosure have a structure of Formula (III-D), wherein $Y^1$ and $Y^{1a}$ are independently

wherein $Z^3$ is independently $C_2$-$C_4$ alkylenyl (e.g., $C_2$, $C_4$ alkylenyl).

In some embodiments, Lipids of the Disclosure have a structure of Formula (III-D), wherein $R^2$, $R^3$, $R^{2'}$ and $R^{3'}$ are independently $C_6$-$C_{14}$ alkyl (e.g., $C_6$, $C_7$, $C_8$, $C_9$, $C_{10}$, $C_{11}$, $C_{12}$, $C_{13}$, or $C_{14}$ alkyl) or $C_1$-$C_2$ alkyl substituted with optionally substituted cyclopropyl. In some embodiments, Lipids of the Disclosure have a structure of Formula (III-D), wherein $R^2$, $R^3$, $R^{2'}$ and $R^{3'}$ are independently $C_6$-$C_{14}$ alkyl (e.g., $C_6$, $C_7$, $C_8$, $C_9$, $C_{10}$, $C_{11}$, $C_{12}$, $C_{13}$, or $C_{14}$ alkyl). In some embodiments, Lipids of the Disclosure have a structure of Formula (III-D), wherein $R^2$ is $C_6$-$C_{14}$ alkyl. In some embodiments, Lipids of the Disclosure have a structure of Formula (III-D), wherein $R^3$ is $C_6$-$C_{14}$ alkyl. In some embodiments, Lipids of the Disclosure have a structure of Formula (III-D), wherein $R^{2'}$ is $C_6$-$C_{14}$ alkyl. In some embodiments, Lipids of the Disclosure have a structure of Formula (III-D), wherein $R^{3'}$ is $C_6$-$C_{14}$ alkyl. In some embodiments, Lipids of the Disclosure have a structure of Formula (III-D), wherein $R^2$ is $C_1$-$C_2$ alkyl substituted with substituted cyclopropyl. In some embodiments, Lipids of the Disclosure have a structure of Formula (III-D), wherein $R^3$ is $C_1$-$C_2$ alkyl substituted with substituted cyclopropyl. In some embodiments, Lipids of the Disclosure have a structure of Formula (III-D), wherein $R^{2'}$ is $C_1$-$C_2$ alkyl substituted with substituted cyclopropyl. In some embodiments, Lipids of the Disclosure have a structure of Formula (III-D), wherein $R^{3'}$ is $C_1$-$C_2$ alkyl substituted with substituted cyclopropyl In some embodiments, Lipids of the Disclosure have a structure of Formula (III-D), wherein $R^2$, $R^3$, $R^{2'}$ and $R^{3'}$ are independently $C_1$-$C_2$ alkyl substituted with cyclopropylene-($C_1$-$C^6$alkylenyl optionally substituted with cyclopropylene substituted with $C_1$-$C_6$alkyl). In some embodiments, Lipids of the Disclosure have a structure of Formula (III-D), wherein $R^2$ is $C_1$-$C_2$ alkyl substituted with cyclopropylene-($C_1$-$C_6$alkylenyl optionally substituted with cyclopropylene substituted with $C_1$-$C_6$alkyl). In some embodiments, Lipids of the Disclosure have a structure of Formula (III-D), wherein $R^3$ is $C_1$-$C_2$ alkyl substituted with cyclopropylene-($C_1$-$C^6$alkylenyl optionally substituted with cyclopropylene substituted with $C_1$-$C_6$alkyl). In some embodiments, Lipids of the Disclosure have a structure of Formula (III-D), wherein $R^{2'}$ is $C_1$-$C_2$ alkyl substituted with cyclopropylene-($C_1$-$C^6$alkylenyl optionally substituted with cyclopropylene substituted with $C_1$-$C_6$alkyl). In some embodiments, Lipids of the Disclosure have a structure of Formula (III-D), wherein $R^{3'}$ is $C_1$-$C_2$ alkyl substituted with cyclopropylene-($C_1$-$C^6$alkylenyl optionally substituted with cyclopropylene substituted with $C_1$-$C_6$alkyl).

Formula (III-E)

In some embodiments, Lipids of the Disclosure have a structure of Formula (III-E):

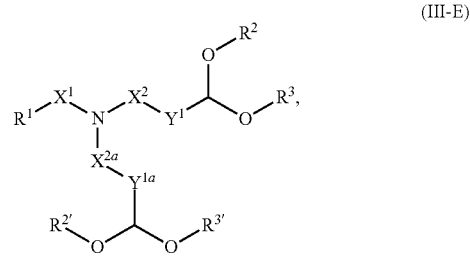

(III-E)

or a pharmaceutically acceptable salt thereof, wherein
$R^1$ is —OH;
$X^1$ is branched $C_2$-$C_8$ alkylenyl
$X^2$ and $X^{2a}$ are independently optionally substituted $C_2$-$C_{14}$ alkylenyl;
$Y^1$ and $Y^{1a}$ are independently

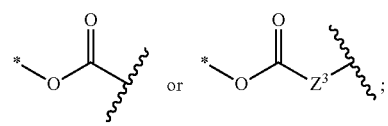

$Z^3$ is independently optionally substituted $C_2$-$C_6$ alkylenyl;

$R^2$ and $R^3$ are independently optionally substituted $C_4$-$C_{14}$ alkyl;

$R^{2'}$ and $R^{3'}$ are independently optionally substituted $C_4$-$C_{14}$ alkyl.

In some embodiments, Lipids of the Disclosure have a structure of Formula (III-E), wherein $X^1$ is branched $C_6$ alkylenyl.

In some embodiments, Lipids of the Disclosure have a structure of Formula (III-E), wherein $X^2$ and $X^{2a}$ are independently $C_4$-$C_{10}$ alkylenyl (e.g., $C_6$, $C_7$, $C_8$ alkylenyl). In some embodiments, Lipids of the Disclosure have a structure of Formula (III-E), wherein $X^2$ is $C_4$-$C_{10}$ alkylenyl. In some embodiments, Lipids of the Disclosure have a structure of Formula (III-E), wherein $X^{2a}$ is $C_4$-$C_{10}$ alkylenyl In some embodiments, Lipids of the Disclosure have a structure of Formula (III-E), wherein $Y^1$ and $Y^{1a}$ are

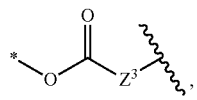

wherein $Z^3$ is independently optionally substituted $C_2$ alkylenyl. In some embodiments, Lipids of the Disclosure have a structure of Formula (III-E), wherein $Y^1$ is

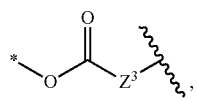

wherein $Z^3$ is independently optionally substituted $C_2$ alkylenyl. In some embodiments, Lipids of the Disclosure have a structure of Formula (III-E), wherein $Y^{1a}$ is

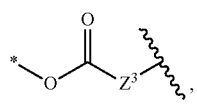

wherein $Z^3$ is independently optionally substituted $C_2$ alkylenyl.

In some embodiments, Lipids of the Disclosure have a structure of Formula (III-E), wherein $R^2$, $R^3$, $R^{2'}$ and $R^{3'}$ are independently $C_6$-$C_{12}$ alkyl (e.g., $C_9$ alkyl) or $C_4$-$C_{10}$ alkyl (e.g., $C_4$, $C_6$ alkyl) optionally substituted with $C_2$-$C_8$alkenylene (e.g., $C_4$, $C_6$ alkenylene). In some embodiments, Lipids of the Disclosure have a structure of Formula (III-E), wherein $R^2$ is $C_6$-$C_{12}$ alkyl. In some embodiments, Lipids of the Disclosure have a structure of Formula (III-E), wherein $R^3$ is $C_6$-$C_{12}$ alkyl. In some embodiments, Lipids of the Disclosure have a structure of Formula (III-E), wherein $R^{2'}$ is $C_6$-$C_{12}$ alkyl. In some embodiments, Lipids of the Disclosure have a structure of Formula (III-E), wherein $R^{3'}$ is $C_6$-$C_{12}$ alkyl. In some embodiments, Lipids of the Disclosure have a structure of Formula (III-E), wherein $R^2$ is $C_4$-$C_{10}$ alkyl optionally substituted with $C_2$-$C_8$alkenylene. In some embodiments, Lipids of the Disclosure have a structure of Formula (III-E), wherein $R^3$ is $C_4$-$C_{10}$ alkyl optionally substituted with $C_2$-$C_8$alkenylene. In some embodiments, Lipids of the Disclosure have a structure of Formula (III-E), wherein $R^{2'}$ is $C_4$-$C_{10}$ alkyl optionally substituted with $C_2$-$C_8$alkenylene. In some embodiments, Lipids of the Disclosure have a structure of Formula (III-E), wherein $R^{3'}$ is $C_4$-$C_{10}$ alkyl optionally substituted with $C_2$-$C_8$alkenylene.

Formula (III-F)

In some embodiments, Lipids of the Disclosure have a structure of Formula (III-F):

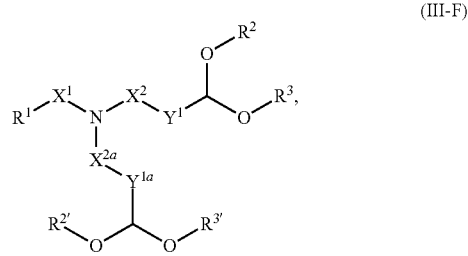

(III-F)

or a pharmaceutically acceptable salt thereof, wherein $R^1$ is —OH;

$X^1$ is optionally substituted $C_2$-$C_6$ alkylenyl;

$X^2$ and $X^{2a}$ are independently optionally substituted $C_2$-$C_{14}$ alkylenyl;

each of $Y^1$ and $Y^{1a}$ is a bond;

$R^2$ and $R^3$ are independently optionally substituted $C_4$-$C_{14}$ alkyl; and $R^{2'}$ and $R^{3'}$ are independently optionally substituted $C_4$-$C_{14}$ alkyl.

In some embodiments, Lipids of the Disclosure have a structure of Formula (III-E), wherein $X^1$ is $C_4$ alkylenyl.

In some embodiments, Lipids of the Disclosure have a structure of Formula (III-E), wherein $X^2$ and $X^{2a}$ are independently $C_4$-$C_{10}$ alkylenyl (e.g., $C_6$-$C_8$ alkylenyl, $C_6$, $C_7$, $C_8$ alkylenyl). In some embodiments, Lipids of the Disclosure have a structure of Formula (III-E), wherein $X^2$ is $C_4$-$C_{10}$ alkylenyl. In some embodiments, Lipids of the Disclosure have a structure of Formula (III-E), wherein $X^{2a}$ is $C_4$-$C_{10}$ alkylenyl.

In some embodiments, Lipids of the Disclosure have a structure of Formula (III-E), wherein $R^2$, $R^3$, $R^{2'}$ and $R^{3'}$ are independently $C_6$-$C_{10}$ alkyl (e.g., $C_7$. $C_8$ alkyl). In some embodiments, Lipids of the Disclosure have a structure of Formula (III-E), wherein $R^2$ is $C_6$-$C_{10}$ alkyl. In some embodiments, Lipids of the Disclosure have a structure of Formula (III-E), wherein $R^3$ is $C_6$-$C_{10}$ alkyl. In some embodiments, Lipids of the Disclosure have a structure of Formula (III-E), wherein $R^{2'}$ is $C_6$-$C_{10}$ alkyl. In some embodiments, Lipids of the Disclosure have a structure of Formula (III-E), wherein $R^{3'}$ is $C_6$-$C_{10}$ alkyl.

Formula (VIII-B)

In some embodiments, Lipids of the Disclosure have a structure of Formula (VIII-B):

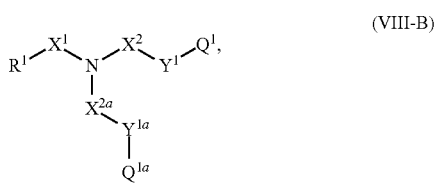

(VIII-B)

or a pharmaceutically acceptable salt thereof, wherein:
X$^1$ is a bond,
R$^1$ is C$_1$-C$_6$ alkyl,
X$^2$ is C$_2$-C$_6$ alkylenyl,
X$^{2a}$ is C$_2$-C$_{14}$ alkylenyl,
wherein X$^2$ or X$^{2a}$ is substituted with OH or C$_{1-4}$alkylenyl-OH,
Y$^1$ is

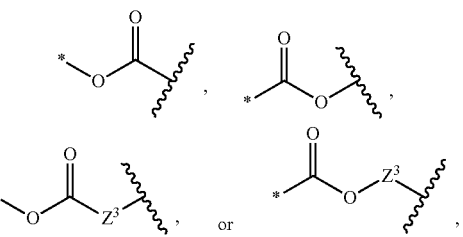

wherein the bond marked with an "*" is attached to X$^2$;
Y$^{1a}$ is

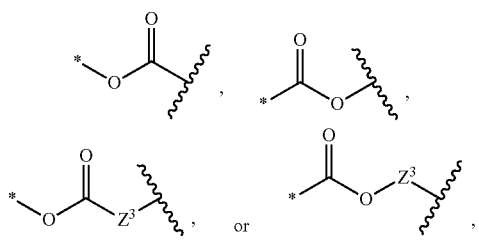

wherein the bond marked with an "*" is attached to X$^{2a}$;
each Z$^3$ is independently optionally substituted C$_1$-C$_6$ alkylenyl or optionally substituted C$_2$-C$_{14}$ alkylenyl;
Q$^1$ is —C(R$^2$)(R$^3$)(R$^{12}$);
Q$^{1a}$ is —C(R$^{2'}$)(R$^{3'}$)(R$^{12'}$);
R$^2$, R$^3$, and R$^{12}$ are independently hydrogen, optionally substituted C$_1$-C$_{14}$ alkyl, or optionally substituted C$_2$-C$_{14}$ alkenylenyl, and
R$^{2'}$, R$^{3'}$, and R$^{12'}$ are independently hydrogen, optionally substituted C$_1$-C$_{14}$ alkyl, or optionally substituted C$_2$-C$_{14}$ alkenylenyl.

In some embodiments, Lipids of the Disclosure have a structure of Formula (VIII-B), wherein R$^1$ is methyl.

In some embodiments, Lipids of the Disclosure have a structure of Formula (VIII-B), wherein X$^2$ is C$_4$, C$_5$, or C$_6$ alkylenyl.

In some embodiments, Lipids of the Disclosure have a structure of Formula (VIII-B), wherein X$^{2a}$ is C$_4$-C$_8$ alkylenyl (e.g., C$_5$, C$_6$, or C$_7$ alkylenyl).

In some embodiments, Lipids of the Disclosure have a structure of Formula (VIII-B), wherein Y$^1$ is

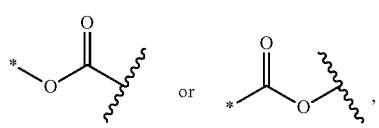 [SMILES: *OC(*)=O ; *OC(*)=O]

and Y$^{1a}$ is

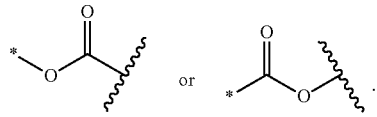 [SMILES: *OC(*)=O ; *OC(*)=O]

In some embodiments, Lipids of the Disclosure have a structure of Formula (VIII-B), wherein Y$^1$ is

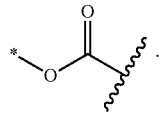

In some embodiments, Lipids of the Disclosure have a structure of Formula (VIII-B), wherein Y$^1$ is

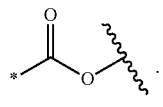

In some embodiments, Lipids of the Disclosure have a structure of Formula (VIII-B), wherein Y$^{1a}$ is

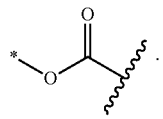

In some embodiments, Lipids of the Disclosure have a structure of Formula (VIII-B), wherein Y$^{1a}$ is

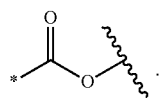

In some embodiments, Lipids of the Disclosure have a structure of Formula (VIII-B), wherein R$^2$, R$^3$, R$^{12}$, R$^{2'}$, R$^{3'}$, and R$^{12'}$ are independently hydrogen or C$_5$-C$_{12}$ alkyl (e.g., C$_6$, C$_7$, C$_8$, C$_9$, C$_{10}$, C$_{11}$ alkyl). In some embodiments, Lipids of the Disclosure have a structure of Formula (VIII-B), wherein R$^2$ is hydrogen. In some embodiments, Lipids of the Disclosure have a structure of Formula (VIII-B), wherein R$^3$ is hydrogen. In some embodiments, Lipids of the Disclosure have a structure of Formula (VIII-B), wherein R$^{2'}$ is hydrogen. In some embodiments, Lipids of the Disclosure have a structure of Formula (VIII-B), wherein R$^{3'}$ is hydrogen. In some embodiments, Lipids of the Disclosure have a structure of Formula (VIII-B), wherein R$^2$ is C$_5$-C$_{12}$ alkyl. In some embodiments, Lipids of the Disclosure have a structure of Formula (VIII-B), wherein R$^3$ is C$_5$-C$_{12}$ alkyl. In some embodiments, Lipids of the Disclosure have a structure of Formula (VIII-B), wherein R$^{2'}$ is C$_5$-C$_{12}$ alkyl. In some embodiments, Lipids of the Disclosure have a structure of Formula (VIII-B), wherein R$^{3'}$ is C$_5$-C$_{12}$ alkyl.

Formula (X)

In some embodiments, Lipids of the Disclosure have a structure of Formula (X):

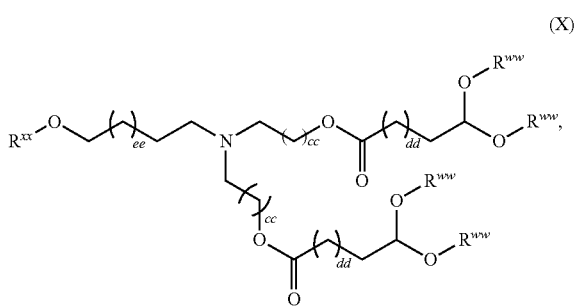

(X)

or a pharmaceutically acceptable salt thereof, wherein
each cc is independently selected from 3 to 9;
$R^{xx}$ is selected from hydrogen and optionally substituted $C_1$-$C_6$ alkyl; and
(i) ee is 1,
each dd is independently selected from 1 to 4; and
each $R^{ww}$ is independently selected from the group consisting of $C_4$-$C_{14}$ alkyl, branched $C_4$-$C_{12}$ alkenyl, $C_4$-$C_{12}$ alkenyl comprising at least two double bonds, and $C_9$-$C_{12}$ alkenyl, wherein any —$(CH_2)_2$— of the $C_4$-$C_{14}$ alkyl can be optionally replaced with $C_2$-$C_6$ cycloalkylenyl;
(ii) ee is 0,
each dd is 1; and
each $R^{ww}$ is linear $C_4$-$C_{12}$ alkyl.

In some embodiments, Lipids of the Disclosure have a structure of Formula (X), wherein $R^{xx}$ is H. In some embodiments, Lipids of the Disclosure have a structure of Formula (X), wherein $R^{xx}$ is optionally substituted $C_1$-$C_6$ alkyl. In some embodiments, Lipids of the Disclosure have a structure of Formula (X), wherein $R^{xx}$ is $C_1$ alkyl. In some embodiments, Lipids of the Disclosure have a structure of Formula (X), wherein $R^{xx}$ is $C_2$ alkyl. In some embodiments, Lipids of the Disclosure have a structure of Formula (X), wherein $R^{xx}$ is $C_3$ alkyl. In some embodiments, Lipids of the Disclosure have a structure of Formula (X), wherein $R^{xx}$ is $C_4$ alkyl. In some embodiments, Lipids of the Disclosure have a structure of Formula (X), wherein $R^{xx}$ is $C_5$ alkyl. In some embodiments, Lipids of the Disclosure have a structure of Formula (X), wherein $R^{xx}$ is $C_6$ alkyl.

In some embodiments, Lipids of the Disclosure have a structure of Formula (X), wherein each $R^{ww}$ is independently selected from the group consisting of $C_4$-$C_{14}$ alkyl, branched $C_4$-$C_{12}$ alkenyl, $C_4$-$C_{12}$ alkenyl comprising at least two double bonds, and $C_9$-$C_{12}$ alkenyl, wherein any —$(CH_2)_2$— of the $C_4$-$C_{14}$ alkyl can be optionally replaced with $C_2$-$C_6$ cycloalkylenyl. In some embodiments, Lipids of the Disclosure have a structure of Formula (X), wherein each $R^{ww}$ is $C_4$-$C_{14}$ alkyl, wherein any —$(CH_2)_2$— of the $C_4$-$C_{14}$ alkyl can be optionally replaced with $C_2$-$C_6$ cycloalkylenyl. In some embodiments, Lipids of the Disclosure have a structure of Formula (X), wherein each $R^{ww}$ is $C_4$-$C_{14}$ alkyl, wherein any —$(CH_2)_2$— of the $C_4$-$C_{14}$ alkyl can be optionally replaced with cyclopropylene. In some embodiments, Lipids of the Disclosure have a structure of Formula (X), wherein each $R^{ww}$ is branched $C_4$-$C_{12}$ alkenyl. In some embodiments, Lipids of the Disclosure have a structure of Formula (X), wherein each $R^{ww}$ is $C_4$-$C_{12}$ alkenyl comprising at least two double bonds. In some embodiments, Lipids of the Disclosure have a structure of Formula (X), wherein each $R^{ww}$ is $C_9$-$C_{12}$ alkenyl. In some embodiments, Lipids of the Disclosure have a structure of Formula (X), wherein each $R^{ww}$ is linear $C_4$-$C_{12}$ alkyl. In some embodiments,
Lipids of the Disclosure have a structure of Formula (X), wherein each $R^{ww}$ is independently selected from the group consisting of $C_6$-$C_{14}$ alkyl, branched $C_8$-$C_{12}$ alkenyl, $C_8$-$C_{12}$ alkenyl comprising at least two double bonds, and $C_9$-$C_{12}$ alkenyl, wherein any —$(CH_2)_2$— of the $C_6$-$C_{14}$ alkyl can be optionally replaced with cyclopropylene. In some embodiments, Lipids of the Disclosure have a structure of Formula (X), wherein each $R^{ww}$ is $C_6$-$C_{14}$ alkyl, wherein any —$(CH_2)_2$— of the $C_6$-$C_{14}$ alkyl can be optionally replaced with cyclopropylene. In some embodiments, Lipids of the Disclosure have a structure of Formula (X), wherein each $R^{ww}$ is branched $C_8$-$C_{12}$ alkenyl, e.g., (linear or branched $C_3$-$C_5$ alkylenyl)-(branched $C_5$-$C_7$ alkenyl), e.g., (branched $C_5$ alkylenyl)-(branched $C_5$ alkenyl), e.g.,

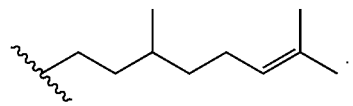 [SMILES: *CCC(C)CCC=C(C)C]

In some embodiments, Lipids of the Disclosure have a structure of Formula (X), wherein each $R^{ww}$ is $C_8$-$C_{12}$ alkenyl comprising at least two double bonds. In some embodiments, Lipids of the Disclosure have a structure of Formula (X), wherein each $R^{ww}$ is $C_9$-$C_{12}$ alkenyl.

In some embodiments, Lipids of the Disclosure have a structure of Formula (X), wherein each $R^{ww}$ is independently selected from the group consisting of $C_6$-$C_{14}$ alkyl (e.g., $C_6$, $C_8$, $C_9$, $C_{10}$, $C_{11}$, $C_{13}$ alkyl), wherein any —$(CH_2)_2$— of the $C_6$-$C_{14}$ alkyl can be optionally replaced with cyclopropylene.

In some embodiments, Lipids of the Disclosure have a structure of Formula (X), wherein each $R^{ww}$ is independently branched $C_8$-$C_{12}$ alkenyl (e.g., branched $C_{10}$ alkenyl).

In some embodiments, Lipids of the Disclosure have a structure of Formula (X), wherein each $R^{ww}$ is independently $C_8$-$C_{12}$ alkenyl comprising at least two double bonds (e.g., $C_9$ or $C_{10}$ alkenyl comprising two double bonds).

In some embodiments, Lipids of the Disclosure have a structure of Formula (X), wherein each $R^{ww}$ is independently (C1 alkylenyl)-(cyclopropylene-$C_6$ alkyl) or (C2 alkylenyl)-(cyclopropylene-$C_2$ alkyl). In some embodiments, Lipids of the Disclosure have a structure of Formula (X), wherein each $R^{ww}$ is independently (C1 alkylenyl)-(cyclopropylene-$C_6$ alkyl). In some embodiments, Lipids of the Disclosure have a structure of Formula (X), wherein each $R^{ww}$ is independently ($C_2$ alkylenyl)-(cyclopropylene-$C_2$ alkyl).

In some embodiments, Lipids of the Disclosure have a structure of Formula (X), wherein each $R^{ww}$ is $C_4$ alkyl. In some embodiments, Lipids of the Disclosure have a structure of Formula (X), wherein each $R^{ww}$ is $C_5$ alkyl. In some embodiments, Lipids of the Disclosure have a structure of Formula (X), wherein each $R^{ww}$ is $C_6$ alkyl. In some embodiments, Lipids of the Disclosure have a structure of Formula (X), wherein each $R^{ww}$ is $C_7$ alkyl. In some embodiments, Lipids of the Disclosure have a structure of Formula (X), wherein each $R^{ww}$ is $C_8$ alkyl. In some embodiments, Lipids of the Disclosure have a structure of Formula (X), wherein each $R^{ww}$ is $C_9$ alkyl. In some embodiments, Lipids of the Disclosure have a structure of Formula (X), wherein each $R^{ww}$ is $C_{10}$ alkyl. In some embodiments, Lipids of the Disclosure have a structure of Formula (X), wherein each $R^{ww}$ is $C_{11}$ alkyl. In some embodiments, Lipids of the Disclosure have a structure of Formula (X), wherein each $R^{ww}$ is $C_{12}$ alkyl. In some embodiments, Lipids of the Disclosure have a structure of Formula (X), wherein each $R^{ww}$ is $C_{13}$ alkyl. In some embodiments, Lipids of the Disclosure have a structure of Formula (X), wherein each $R^{ww}$ is $C_{14}$ alkyl.

In some embodiments, Lipids of the Disclosure have a structure of Formula (X), wherein each $R^{ww}$ is $C_9$ alkenyl. In some embodiments, Lipids of the Disclosure have a structure of Formula (X), wherein each $R^{ww}$ is $C_{10}$ alkenyl. In some embodiments, Lipids of the Disclosure have a structure of Formula (X), wherein each $R^{ww}$ is $C_{11}$ alkenyl. In some embodiments, Lipids of the Disclosure have a structure of Formula (X), wherein each $R^{ww}$ is $C_{12}$ alkenyl.

In some embodiments, Lipids of the Disclosure have a structure of Formula (X), wherein each $R^{ww}$ is $C_8$ alkenyl comprising at least two double bonds. In some embodiments, Lipids of the Disclosure have a structure of Formula (X), wherein each $R^{ww}$ is $C_9$ alkenyl comprising at least two double bonds. In some embodiments, Lipids of the Disclosure have a structure of Formula (X), wherein each $R^{ww}$ is $C_{10}$ alkenyl comprising at least two double bonds. In some embodiments, Lipids of the Disclosure have a structure of Formula (X), wherein each $R^{ww}$ is $C_{11}$ alkenyl comprising at least two double bonds. In some embodiments, Lipids of the Disclosure have a structure of Formula (X), wherein each $R^{ww}$ is $C_{12}$ alkenyl comprising at least two double bonds. In some embodiments, Lipids of the Disclosure have a structure of Formula (X), wherein each $R^{ww}$ is $C_{13}$ alkenyl comprising at least two double bonds. In some embodiments, Lipids of the Disclosure have a structure of Formula (X), wherein each $R^{ww}$ is $C_{14}$ alkenyl comprising at least two double bonds.

In some embodiments, Lipids of the Disclosure have a structure of Formula (X), wherein each $R^{ww}$ is $C_9$ alkyl, wherein one —$(CH_2)_2$— of the $C_9$ alkyl is replaced with $C_2$-$C_6$ cycloalkylenyl. In some embodiments, Lipids of the Disclosure have a structure of Formula (X), wherein each $R^{ww}$ is $C_9$ alkyl, wherein one —$(CH_2)_2$— of the $C_9$ alkyl is replaced with cyclopropylene. In some embodiments, Lipids of the Disclosure have a structure of Formula (X), wherein each $R^{ww}$ is $C_9$ alkyl, wherein two —$(CH_2)_2$— of the $C_9$ alkyl are replaced with $C_2$-$C_6$ cycloalkylenyl. In some embodiments, Lipids of the Disclosure have a structure of Formula (X), wherein each $R^{ww}$ is $C_9$ alkyl, wherein two —$(CH_2)_2$— of the $C_9$ alkyl are replaced with cyclopropylene.

In some embodiments, Lipids of the Disclosure have a structure of Formula (X), wherein each $R^{ww}$ is linear $C_4$ alkyl. In some embodiments, Lipids of the Disclosure have a structure of Formula (X), wherein each $R^{ww}$ is linear $C_5$ alkyl. In some embodiments, Lipids of the Disclosure have a structure of Formula (X), wherein each $R^{ww}$ is linear $C_6$ alkyl. In some embodiments, Lipids of the Disclosure have a structure of Formula (X), wherein each $R^{ww}$ is linear $C_7$ alkyl. In some embodiments, Lipids of the Disclosure have a structure of Formula (X), wherein each $R^{ww}$ is linear $C_8$ alkyl. In some embodiments, Lipids of the Disclosure have a structure of Formula (X), wherein each $R^{ww}$ is linear $C_9$ alkyl. In some embodiments, Lipids of the Disclosure have a structure of Formula (X), wherein each $R^{ww}$ is linear $C_{10}$ alkyl. In some embodiments, Lipids of the Disclosure have a structure of Formula (X), wherein each $R^{ww}$ is linear $C_{11}$ alkyl. In some embodiments, Lipids of the Disclosure have a structure of Formula (X), wherein each $R^{ww}$ is linear $C_{12}$ alkyl. In some embodiments, Lipids of the Disclosure have a structure of Formula (X), wherein each $R^{ww}$ is linear $C_{13}$ alkyl. In some embodiments, Lipids of the Disclosure have a structure of Formula (X), wherein each $R^{ww}$ is linear $C_{14}$ alkyl.

In some embodiments, Lipids of the Disclosure have a structure of Formula (X), wherein each $R^{ww}$ is branched $C_8$ alkenyl. In some embodiments, Lipids of the Disclosure have a structure of Formula (X), wherein each $R^{ww}$ is branched $C_9$ alkenyl. In some embodiments, Lipids of the Disclosure have a structure of Formula (X), wherein each $R^{ww}$ is branched $C_{10}$ alkenyl. In some embodiments, Lipids of the Disclosure have a structure of Formula (X), wherein each $R^{W}$ is branched $C_{11}$ alkenyl. In some embodiments, Lipids of the Disclosure have a structure of Formula (X), wherein each $R^{ww}$ is branched $C_{12}$ alkenyl.

In some embodiments, Lipids of the Disclosure have a structure of Formula (X), wherein each cc is independently selected from 3 to 7. In some embodiments, Lipids of the Disclosure have a structure of Formula (X), wherein each cc is 3. In some embodiments, Lipids of the Disclosure have a structure of Formula (X), wherein each cc is 4. In some embodiments, Lipids of the Disclosure have a structure of Formula (X), wherein each cc is 5. In some embodiments, Lipids of the Disclosure have a structure of Formula (X), wherein each cc is 6. In some embodiments, Lipids of the Disclosure have a structure of Formula (X), wherein each cc is 7. In some embodiments, Lipids of the Disclosure have a structure of Formula (X), wherein each cc is 8. In some embodiments, Lipids of the Disclosure have a structure of Formula (X), wherein each cc is 9.

In some embodiments, Lipids of the Disclosure have a structure of Formula (X), wherein each dd is independently selected from 1 to 4. In some embodiments, Lipids of the Disclosure have a structure of Formula (X), wherein each dd is 1. In some embodiments, Lipids of the Disclosure have a structure of Formula (X), wherein each dd is 2. In some embodiments, Lipids of the Disclosure have a structure of Formula (X), wherein each dd is 3. In some embodiments, Lipids of the Disclosure have a structure of Formula (X), wherein each dd is 4.

In some embodiments, Lipids of the Disclosure have a structure of Formula (X), wherein ee is 1.

In some embodiments, Lipids of the Disclosure have a structure of Formula (X), wherein ee is 0.

Formula (X-A)

In some embodiments, Lipids of the Disclosure have a structure of Formula (X), wherein the Lipids of the Disclosure have a structure of Formula (X-A):

(X-A)

or a pharmaceutically acceptable salt thereof, wherein
each cc is independently selected from 3 to 7;
each dd is independently selected from 1 to 4;
$R^{xx}$ is selected from hydrogen and optionally substituted $C_1$-$C_6$ alkyl; and each $R^{ww}$ is independently selected from the group consisting of $C_4$-$C_{14}$ alkyl or (linear or branched $C_3$-$C_5$ alkylenyl)-(branched $C_5$-$C_7$alkenyl).

In some embodiments, Lipids of the Disclosure have a structure of Formula (X-A), wherein $R^{xx}$ is hydrogen. In some embodiments, Lipids of the Disclosure have a structure of Formula (X-A), wherein $R^{xx}$ is $C_1$ alkyl. In some embodiments, Lipids of the Disclosure have a structure of Formula (X-A), wherein $R^{xx}$ is $C_2$ alkyl. In some embodiments, Lipids of the Disclosure have a structure of Formula (X-A), wherein $R^{xx}$ is $C_3$ alkyl. In some embodiments, Lipids of the Disclosure have a structure of Formula (X-A), wherein $R^{xx}$ is $C_4$ alkyl. In some embodiments, Lipids of the Disclosure have a structure of Formula (X-A), wherein $R^{xx}$ is $C_5$ alkyl. In some embodiments, Lipids of the Disclosure have a structure of Formula (X-A), wherein $R^{xx}$ is $C_6$ alkyl.

In some embodiments, Lipids of the Disclosure have a structure of Formula (X-A), wherein each cc is 4, 5, 6, or 7. In some embodiments, Lipids of the Disclosure have a structure of Formula (X-A), wherein each cc is 3. In some embodiments, Lipids of the Disclosure have a structure of Formula (X-A), wherein each cc is 4. In some embodiments, Lipids of the Disclosure have a structure of Formula (X-A), wherein each cc is 5. In some embodiments, Lipids of the Disclosure have a structure of Formula (X-A), wherein each cc is 6. In some embodiments, Lipids of the Disclosure have a structure of Formula (X-A), wherein each cc is 7.

In some embodiments, Lipids of the Disclosure have a structure of Formula (X-A), wherein each dd is 1 or 3. In some embodiments, Lipids of the Disclosure have a structure of Formula (X-A), wherein each dd is 1. In some embodiments, Lipids of the Disclosure have a structure of Formula (X-A), wherein each dd is 2. In some embodiments, Lipids of the Disclosure have a structure of Formula (X-A), wherein each dd is 3. In some embodiments, Lipids of the Disclosure have a structure of Formula (X-A), wherein each dd is 4.

In some embodiments, Lipids of the Disclosure have a structure of Formula (X-A), wherein each $R^{ww}$ is $C_4$-$C_{14}$ alkyl. In some embodiments, Lipids of the Disclosure have a structure of Formula (X-A), wherein each $R^{ww}$ is $C_4$ alkyl. In some embodiments, Lipids of the Disclosure have a structure of Formula (X-A), wherein each $R^{ww}$ is $C_5$ alkyl. In some embodiments, Lipids of the Disclosure have a structure of Formula (X-A), wherein each $R^{ww}$ is $C_6$ alkyl. In some embodiments, Lipids of the Disclosure have a structure of Formula (X-A), wherein each $R^{ww}$ is $C_7$ alkyl. In some embodiments, Lipids of the Disclosure have a structure of Formula (X-A), wherein each $R^{ww}$ is $C_8$ alkyl. In some embodiments, Lipids of the Disclosure have a structure of Formula (X-A), wherein each $R^{ww}$ is $C_9$ alkyl. In some embodiments, Lipids of the Disclosure have a structure of Formula (X-A), wherein each $R^{ww}$ is $C_{10}$ alkyl. In some embodiments, Lipids of the Disclosure have a structure of Formula (X-A), wherein each $R^{ww}$ is $C_{11}$ alkyl. In some embodiments, Lipids of the Disclosure have a structure of Formula (X-A), wherein each $R^{ww}$ is $C_{12}$ alkyl. In some embodiments, Lipids of the Disclosure have a structure of Formula (X-A), wherein each $R^{ww}$ is $C_{13}$ alkyl. In some embodiments, Lipids of the Disclosure have a structure of Formula (X-A), wherein each $R^{ww}$ is $C_{14}$ alkyl.

In some embodiments, Lipids of the Disclosure have a structure of Formula (X-A), wherein each $R^{ww}$ is (linear or branched $C_3$-$C_5$ alkylenyl)-(branched $C_5$-$C_7$alkenyl), e.g., (branched $C_5$ alkylenyl)-(branched $C_5$alkenyl), e.g.,

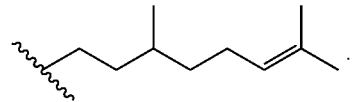 [SMILES: *CCC(C)CCC=C(C)C]

In some embodiments, Lipids of the Disclosure comprise an acyclic core. In some embodiments, Lipids of the Disclosure are selected from any lipid in Table (I) below or a pharmaceutically acceptable salt thereof:

Table (I)

Non-Limiting Examples of Ionizable Lipids with an Acyclic Core

| Structure | Compound No. |
|---|---|
| 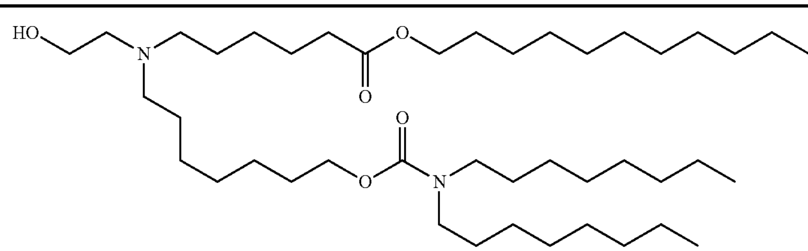 | 1 |
| 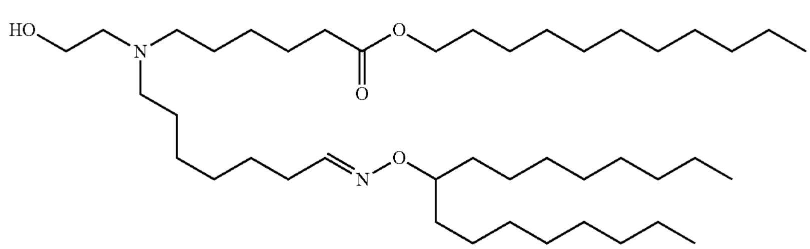 [SMILES: CCCCCCCCCCCOC(=O)CCCCCN(CCO)CCCCCC/C=N/OC(CCCCCCCC)CCCCCCCC] | 2 |

Table (I)-continued
Non-Limiting Examples of Ionizable Lipids with an Acyclic Core
| Structure | Compound No. |
|---|---|
| 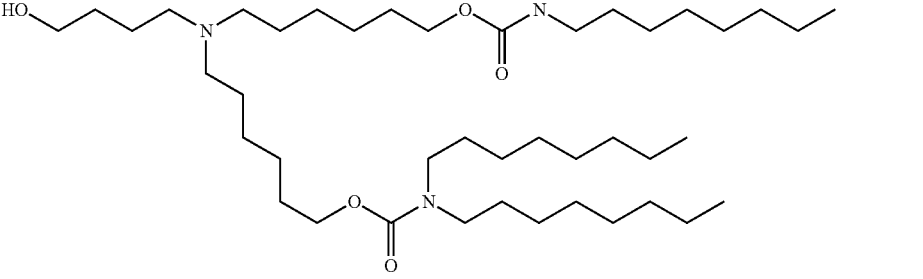 | 3 |
| 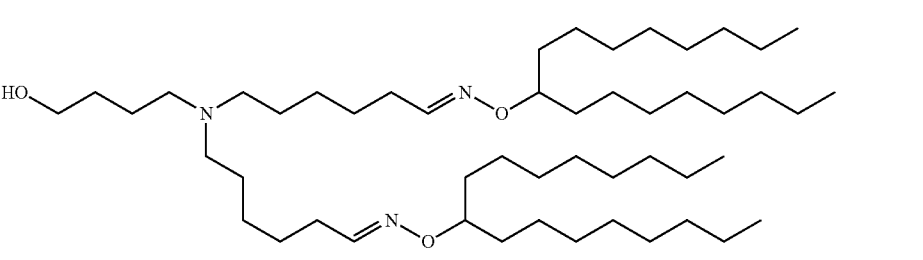 [SMILES: CCCCCCCCC(CCCCCCCC)O/N=C/CCCCCN(CCCCO)CCCCC/C=N/OC(CCCCCCCC)CCCCCCCC] | 4 |
| 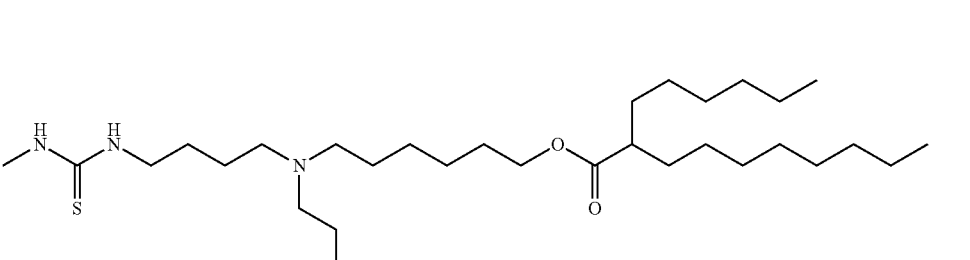 | 5 |
| 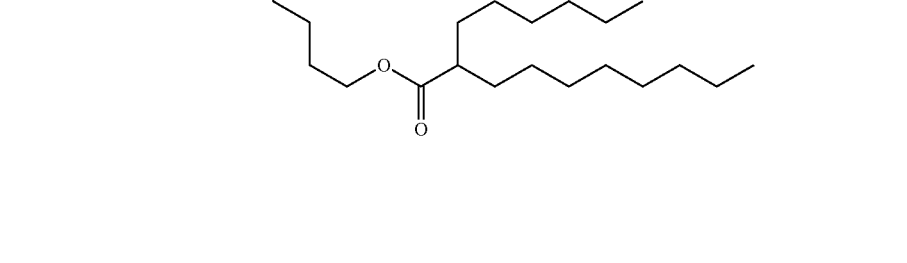 | 6 |

TABLE (I)-continued
Non-Limiting Examples of Ionizable Lipids with an Acyclic Core
| Structure | Compound No. |
|---|---|
| 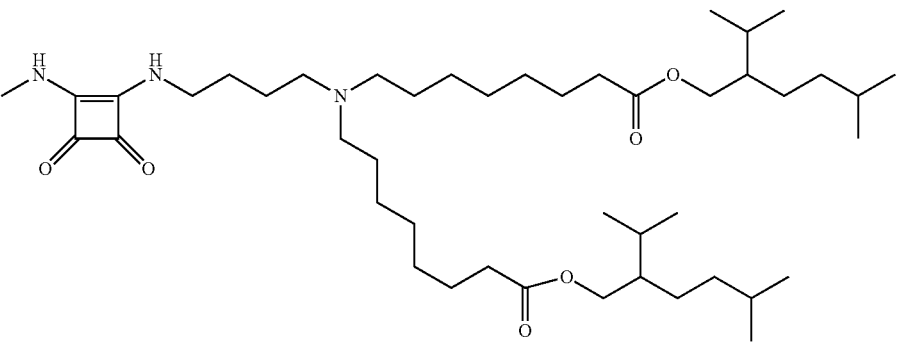 [SMILES: CNc1c(NCCCCN(CCCCCCCC(=O)OCC(CCC(C)C)C(C)C)CCCCCCCC(=O)OCC(CCC(C)C)C(C)C)c(=O)c1=O] | 7 |
| 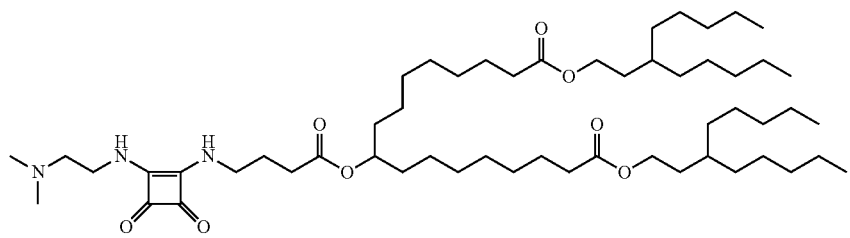 [SMILES: CCCCCC(CCCCC)CCOC(=O)CCCCCCCC(CCCCCCCC(=O)OCCC(CCCCC)CCCCC)OC(=O)CCCNc1c(NCCN(C)C)c(=O)c1=O] | 8 |
| 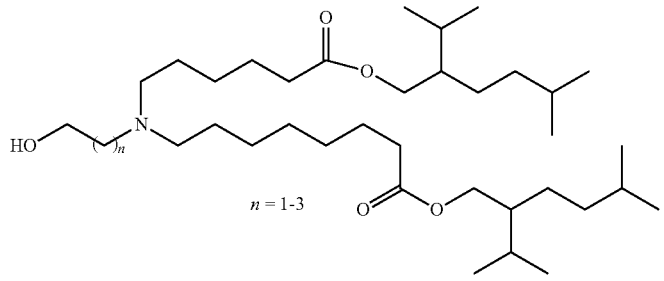 | 9 |
| 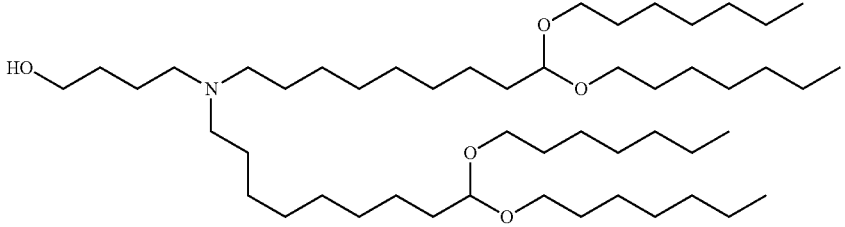 [SMILES: CCCCCCCOC(CCCCCCCCN(CCCCO)CCCCCCCCC(OCCCCCCC)OCCCCCCC)OCCCCCCC] | 10 |
| 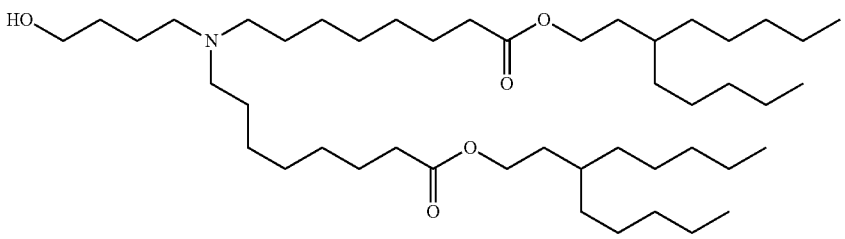 [SMILES: CCCCCC(CCCCC)CCOC(=O)CCCCCCCN(CCCCO)CCCCCCCC(=O)OCCC(CCCCC)CCCCC] | 11 |

Table (I)-continued

Non-Limiting Examples of Ionizable Lipids with an Acyclic Core

| Structure | Compound No. |
|---|---|
| 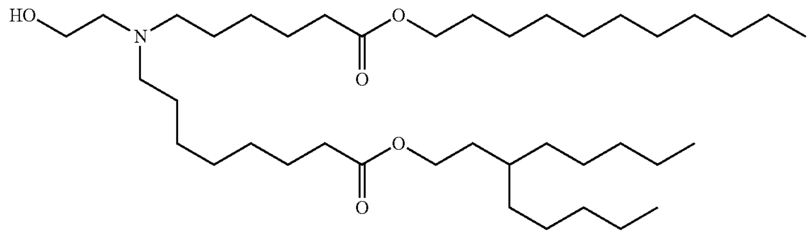 [SMILES: CCCCCCCCCCCOC(=O)CCCCCN(CCO)CCCCCCCC(=O)OCCC(CCCCC)CCCCC] | 13 |
| 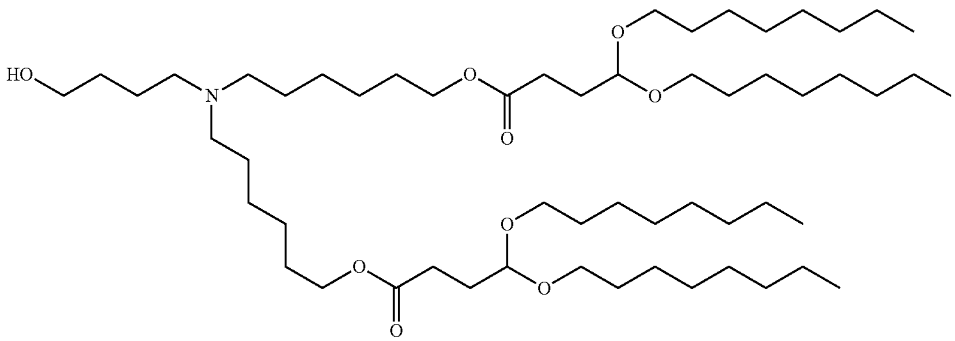 [SMILES: CCCCCCCCOC(CCC(=O)OCCCCCCN(CCCCO)CCCCCCOC(=O)CCC(OCCCCCCCC)OCCCCCCCC)OCCCCCCCC] | 14 |
| 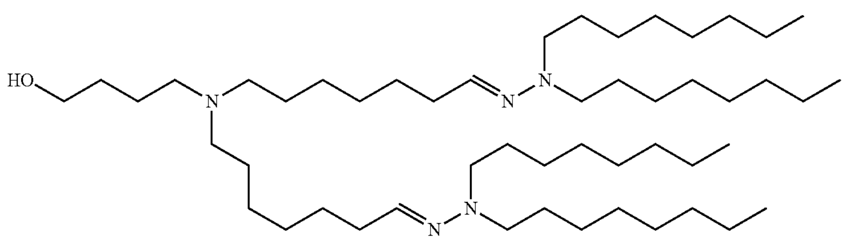 [SMILES: CCCCCCCCN(CCCCCCCC)/N=C/CCCCCCN(CCCCO)CCCCCC/C=N/N(CCCCCCCC)CCCCCCCC] | 15 |
| 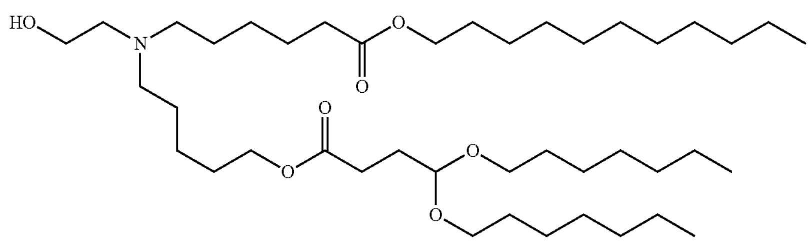 [SMILES: CCCCCCCCCCCOC(=O)CCCCCN(CCO)CCCCCOC(=O)CCC(OCCCCCCC)OCCCCCCC] | 16 |
| 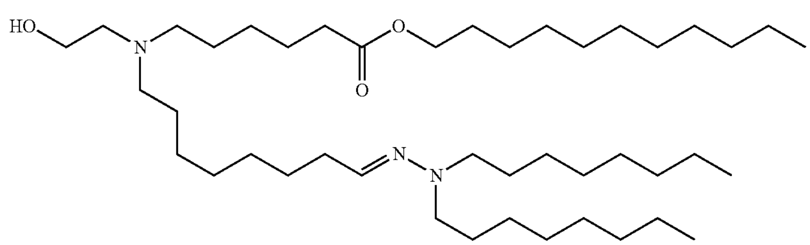 [SMILES: CCCCCCCCCCCOC(=O)CCCCCN(CCO)CCCCCCC/C=N/N(CCCCCCCC)CCCCCCCC] | 17 |
| 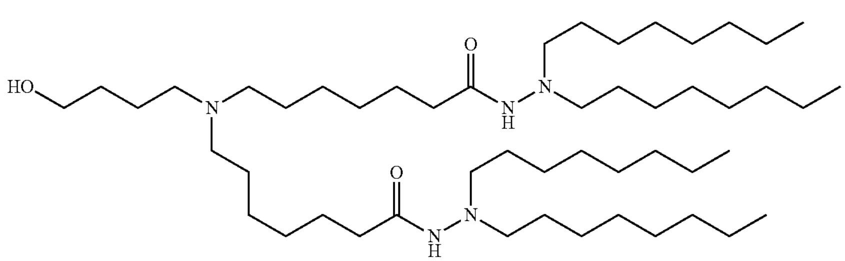 [SMILES: CCCCCCCCN(CCCCCCCC)NC(=O)CCCCCCN(CCCCO)CCCCCCC(=O)NN(CCCCCCCC)CCCCCCCC] | 18 |

Table (I)-continued

Non-Limiting Examples of Ionizable Lipids with an Acyclic Core

| Structure | Compound No. |
|---|---|
| 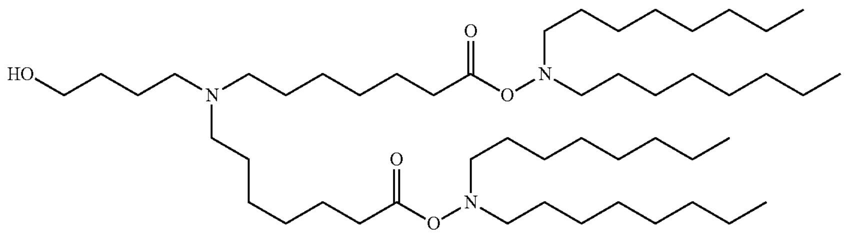 [SMILES: CCCCCCCCN(CCCCCCCC)OC(=O)CCCCCCN(CCCCO)CCCCCCC(=O)ON(CCCCCCCC)CCCCCCCC] | 19 |
| 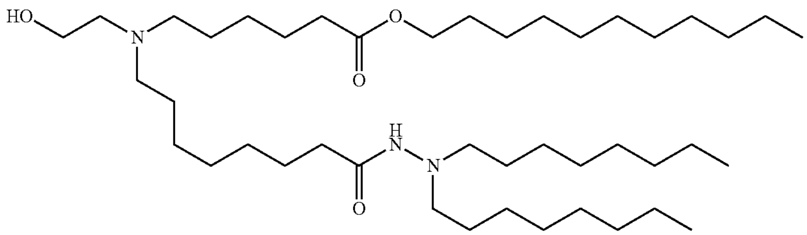 [SMILES: CCCCCCCCCCCOC(=O)CCCCCN(CCO)CCCCCCCC(=O)NN(CCCCCCCC)CCCCCCCC] | 20 |
| 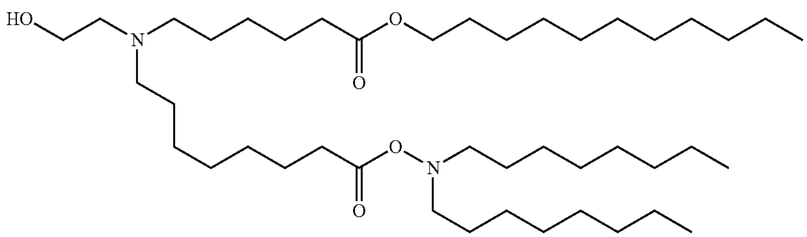 [SMILES: CCCCCCCCCCCOC(=O)CCCCCN(CCO)CCCCCCCC(=O)ON(CCCCCCCC)CCCCCCCC] | 21 |
| 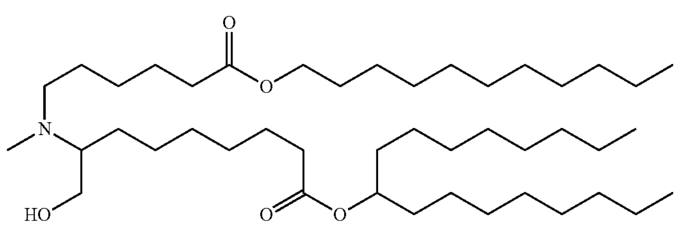 [SMILES: CCCCCCCCCCCOC(=O)CCCCCN(C)C(CO)CCCCCCC(=O)OC(CCCCCCCC)CCCCCCCC] | 22 |
| 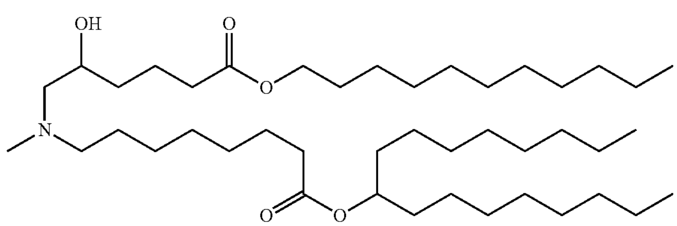 [SMILES: CCCCCCCCCCCOC(=O)CCCC(O)CN(C)CCCCCCCC(=O)OC(CCCCCCCC)CCCCCCCC] | 23 |
| 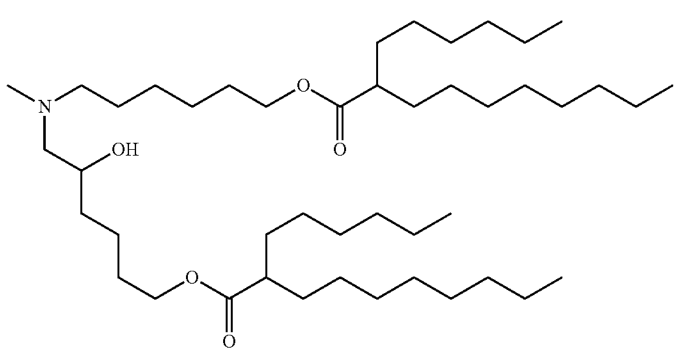 [SMILES: CCCCCCCCC(CCCCCC)C(=O)OCCCCCCN(C)CC(O)CCCCOC(=O)C(CCCCCC)CCCCCCCC] | 24 |

Table (I)-continued

Non-Limiting Examples of Ionizable Lipids with an Acyclic Core

| Structure | Compound No. |
|---|---|
| 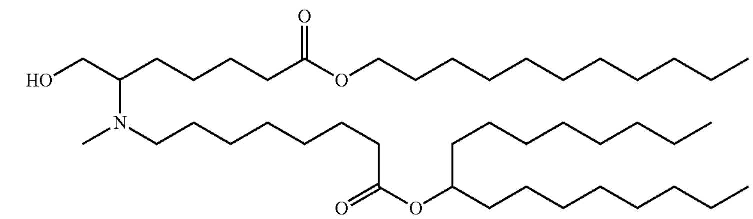 [SMILES: CCCCCCCCCCCOC(=O)CCCCC(CO)N(C)CCCCCCCC(=O)OC(CCCCCCCC)CCCCCCCC] | 25 |
| 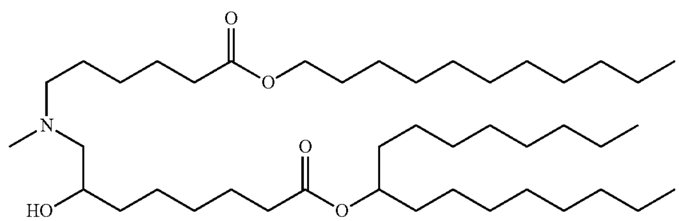 [SMILES: CCCCCCCCCCCOC(=O)CCCCCN(C)CC(O)CCCCCC(=O)OC(CCCCCCCC)CCCCCCCC] | 26 |
| 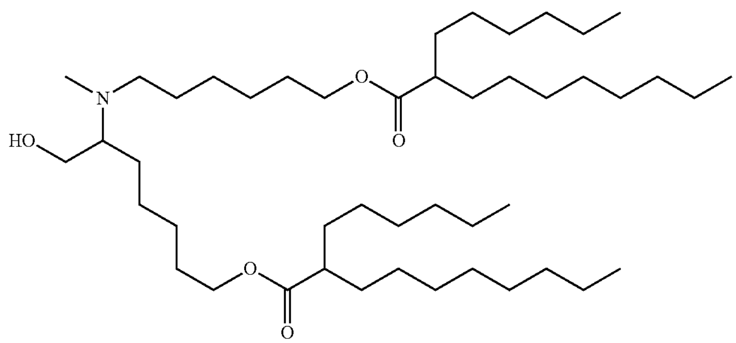 [SMILES: CCCCCCCCC(CCCCCC)C(=O)OCCCCCCN(C)C(CO)CCCCCOC(=O)C(CCCCCC)CCCCCCCC] | 27 |
| 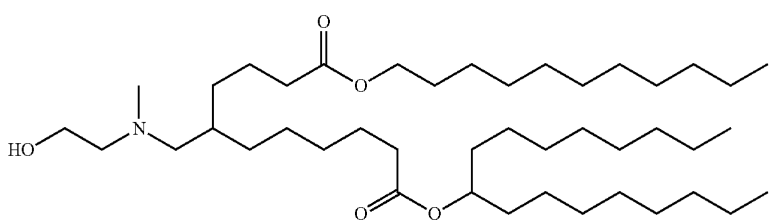 [SMILES: CCCCCCCCCCCOC(=O)CCCC(CCCCCC(=O)OC(CCCCCCCC)CCCCCCCC)CN(C)CCO] | 28 |
| 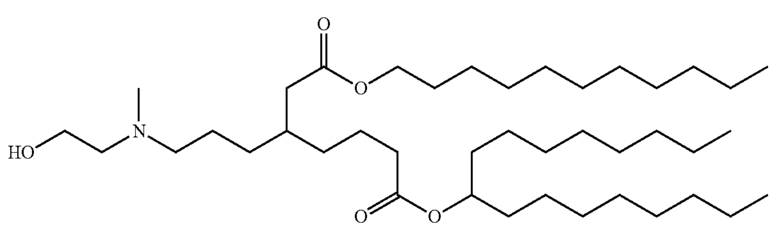 [SMILES: CCCCCCCCCCCOC(=O)CC(CCCC(=O)OC(CCCCCCCC)CCCCCCCC)CCCN(C)CCO] | 29 |
| 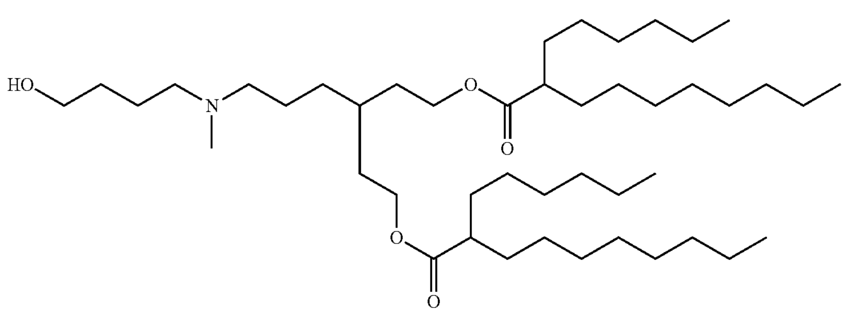 [SMILES: CCCCCCCCC(CCCCCC)C(=O)OCCC(CCCN(C)CCCCO)CCOC(=O)C(CCCCCC)CCCCCCCC] | 30 |

TABLE (I)-continued
Non-Limiting Examples of Ionizable Lipids with an Acyclic Core
| Structure | Compound No. |
|---|---|
| 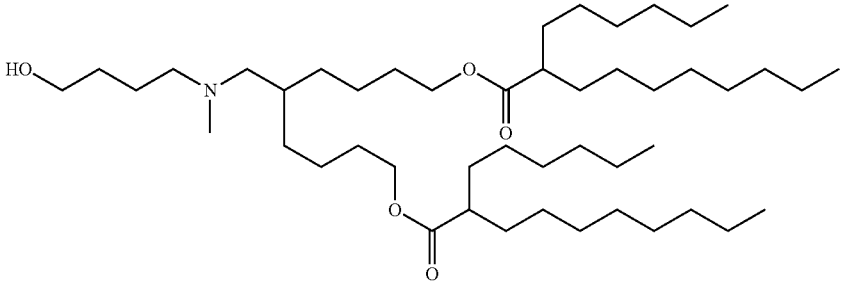 [SMILES: CCCCCCCCC(CCCCCC)C(=O)OCCCCC(CCCCOC(=O)C(CCCCCC)CCCCCCCC)CN(C)CCCCO] | 31 |
| 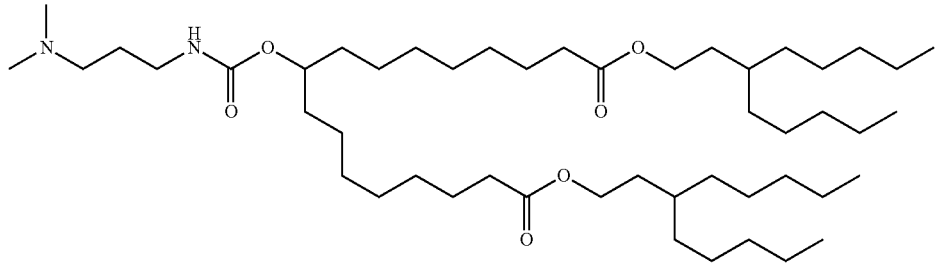 [SMILES: CCCCCC(CCCCC)CCOC(=O)CCCCCCCC(CCCCCCCC(=O)OCCC(CCCCC)CCCCC)OC(=O)NCCCN(C)C] | 32 |
| 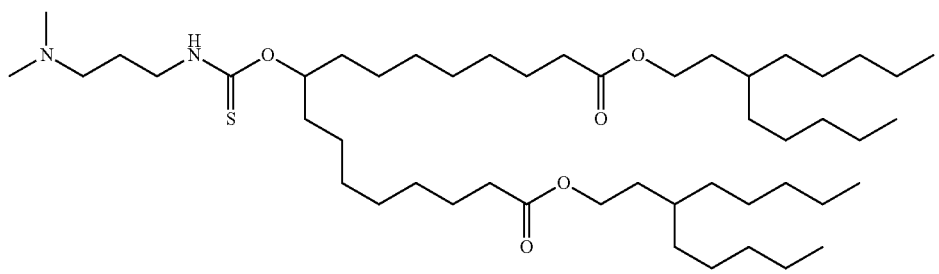 [SMILES: CCCCCC(CCCCC)CCOC(=O)CCCCCCCC(CCCCCCCC(=O)OCCC(CCCCC)CCCCC)OC(=S)NCCCN(C)C] | 33 |
| 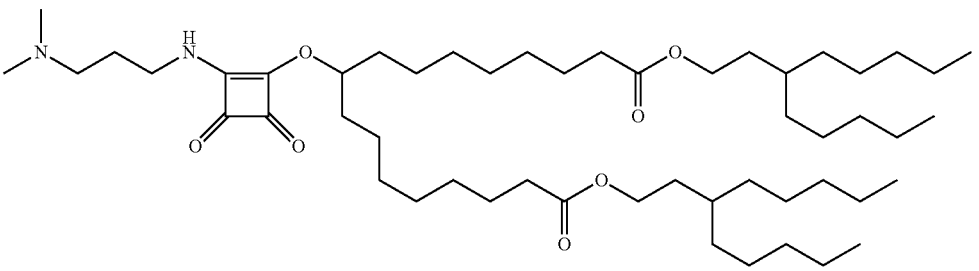 [SMILES: CCCCCC(CCCCC)CCOC(=O)CCCCCCCC(CCCCCCCC(=O)OCCC(CCCCC)CCCCC)Oc1c(NCCCN(C)C)c(=O)c1=O] | 34 |
| 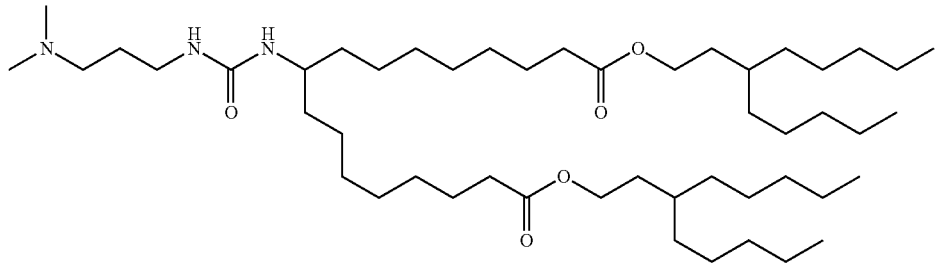 [SMILES: CCCCCC(CCCCC)CCOC(=O)CCCCCCCC(CCCCCCCC(=O)OCCC(CCCCC)CCCCC)NC(=O)NCCCN(C)C] | 35 |

Table (I)-continued

Non-Limiting Examples of Ionizable Lipids with an Acyclic Core

| Structure | Compound No. |
|---|---|
| 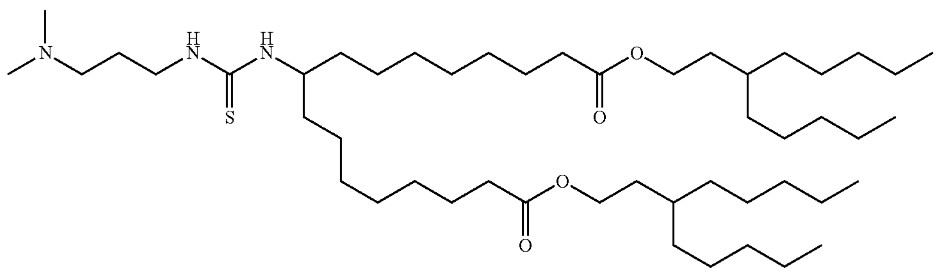 [SMILES: CCCCCC(CCCCC)CCOC(=O)CCCCCCCC(CCCCCCCC(=O)OCCC(CCCCC)CCCCC)NC(=S)NCCCN(C)C] | 36 |
| 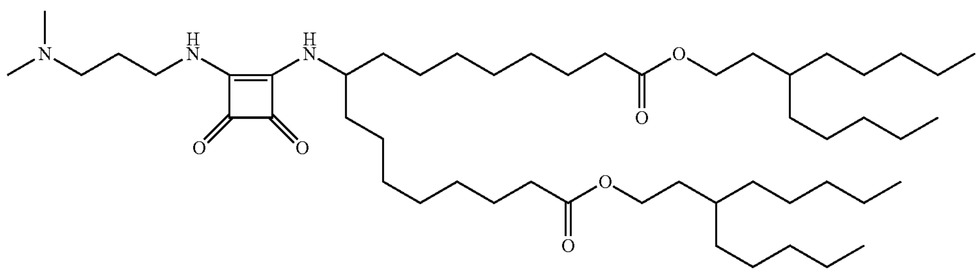 [SMILES: CCCCCC(CCCCC)CCOC(=O)CCCCCCCC(CCCCCCCC(=O)OCCC(CCCCC)CCCCC)Nc1c(NCCCN(C)C)c(=O)c1=O] | 37 |
| 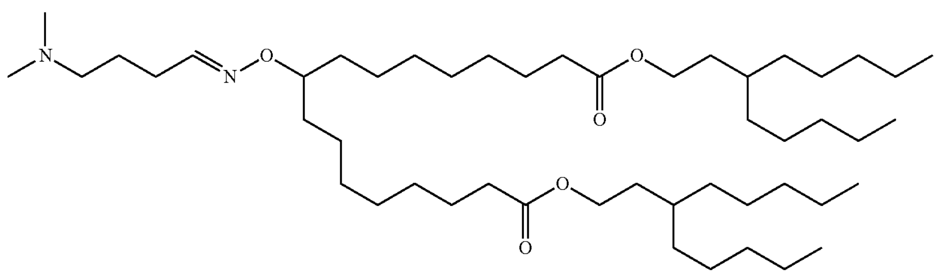 [SMILES: CCCCCC(CCCCC)CCOC(=O)CCCCCCCC(CCCCCCCC(=O)OCCC(CCCCC)CCCCC)O/N=C/CCCN(C)C] | 38 |
| 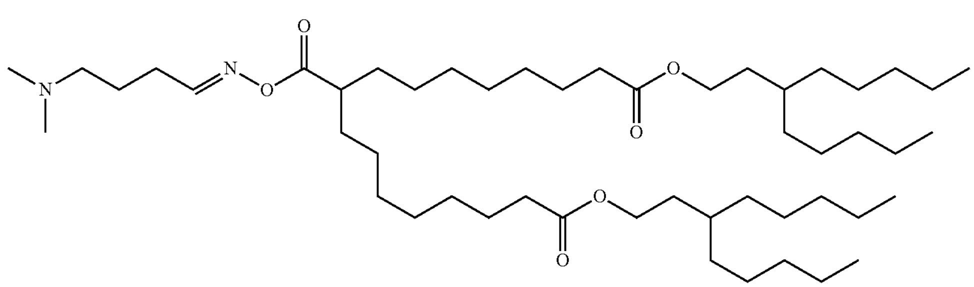 [SMILES: CCCCCC(CCCCC)CCOC(=O)CCCCCCCC(CCCCCCCC(=O)OCCC(CCCCC)CCCCC)C(=O)O/N=C/CCCN(C)C] | 39 |
| 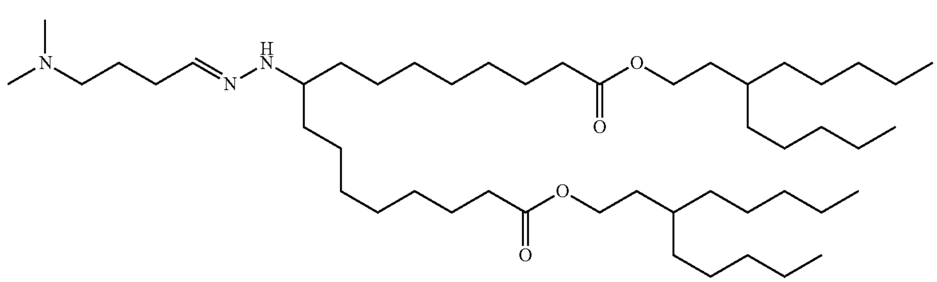 [SMILES: CCCCCC(CCCCC)CCOC(=O)CCCCCCCC(CCCCCCCC(=O)OCCC(CCCCC)CCCCC)N/N=C/CCCN(C)C] | 40 |

Table (I)-continued

Non-Limiting Examples of Ionizable Lipids with an Acyclic Core

| Structure | Compound No. |
|---|---|
| 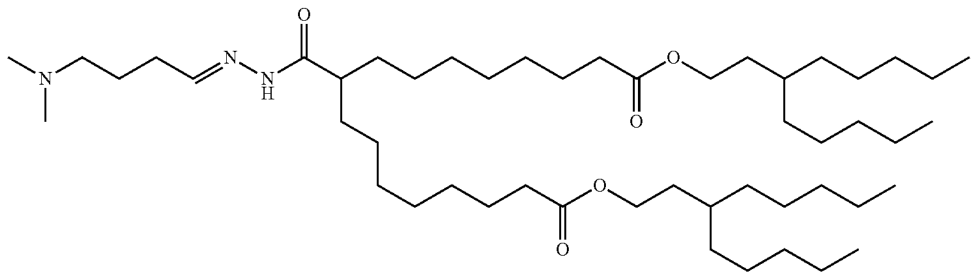 [SMILES: CCCCCC(CCCCC)CCOC(=O)CCCCCCCC(CCCCCCCC(=O)OCCC(CCCCC)CCCCC)C(=O)N/N=C/CCCN(C)C] | 41 |
| 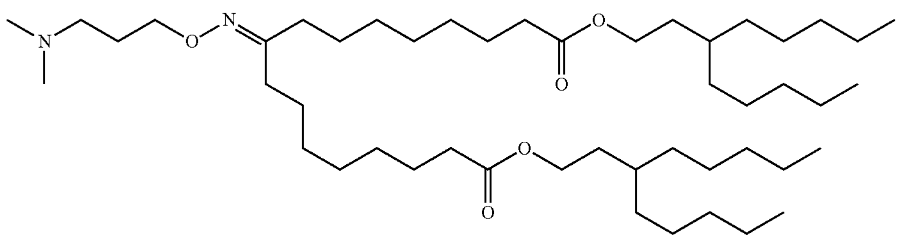 [SMILES: CCCCCC(CCCCC)CCOC(=O)CCCCCCCC(CCCCCCCC(=O)OCCC(CCCCC)CCCCC)=NOCCCN(C)C] | 42 |
| 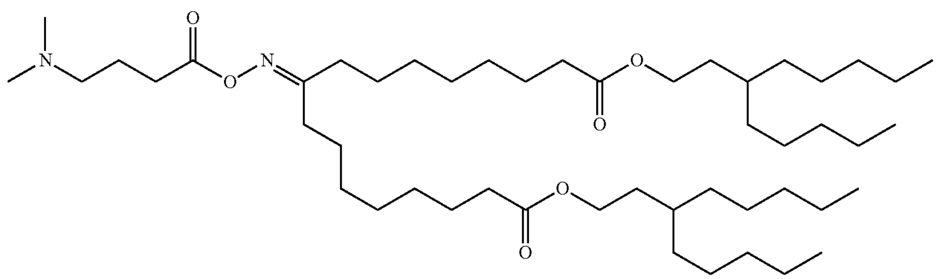 [SMILES: CCCCCC(CCCCC)CCOC(=O)CCCCCCCC(CCCCCCCC(=O)OCCC(CCCCC)CCCCC)=NOC(=O)CCCN(C)C] | 43 |
| 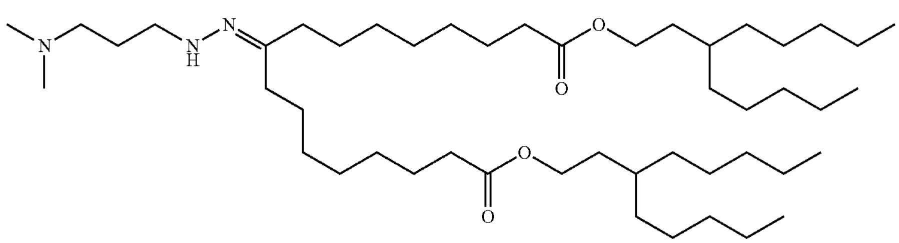 [SMILES: CCCCCC(CCCCC)CCOC(=O)CCCCCCCC(CCCCCCCC(=O)OCCC(CCCCC)CCCCC)=NNCCCN(C)C] | 44 |
| 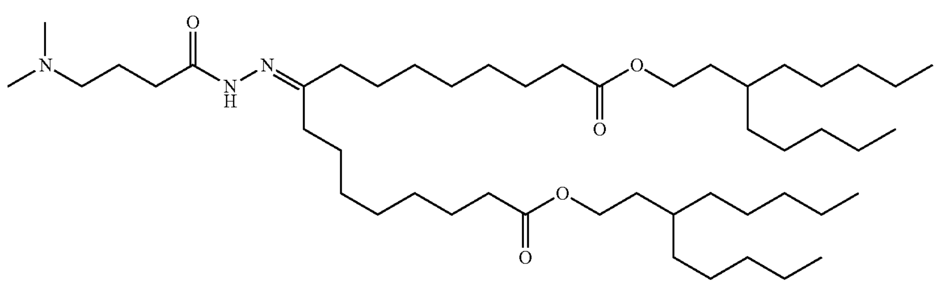 [SMILES: CCCCCC(CCCCC)CCOC(=O)CCCCCCCC(CCCCCCCC(=O)OCCC(CCCCC)CCCCC)=NNC(=O)CCCN(C)C] | 45 |
| 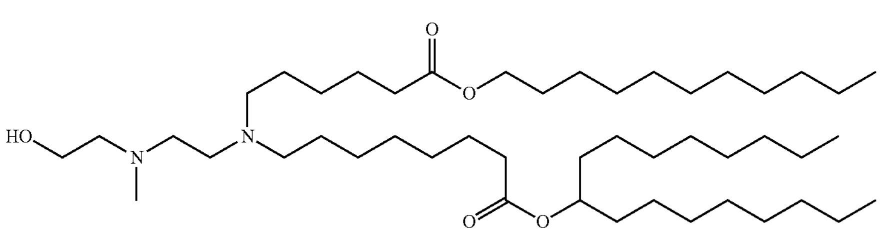 [SMILES: CCCCCCCCCCCOC(=O)CCCCCN(CCCCCCCC(=O)OC(CCCCCCCC)CCCCCCCC)CCN(C)CCO] | 46 |

Table (I)-continued
Non-Limiting Examples of Ionizable Lipids with an Acyclic Core
| Structure | Compound No. |
|---|---|
| 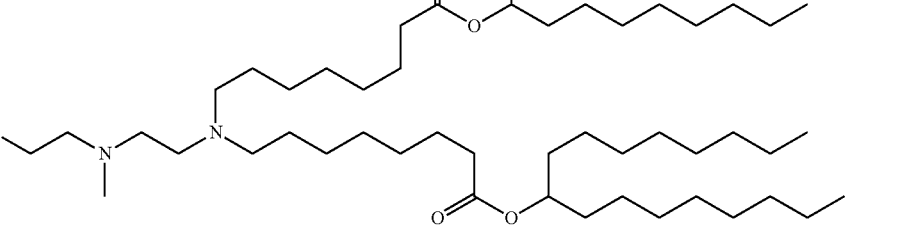 | 47 |
| 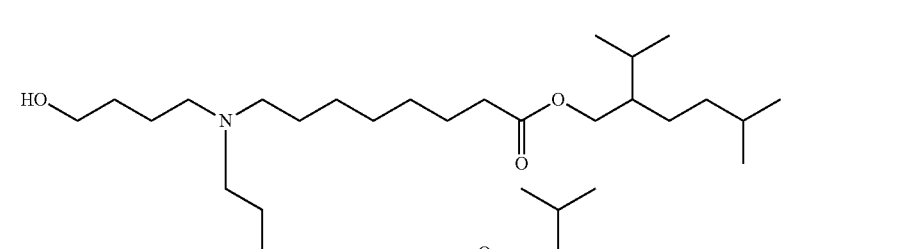 | 48 |
| 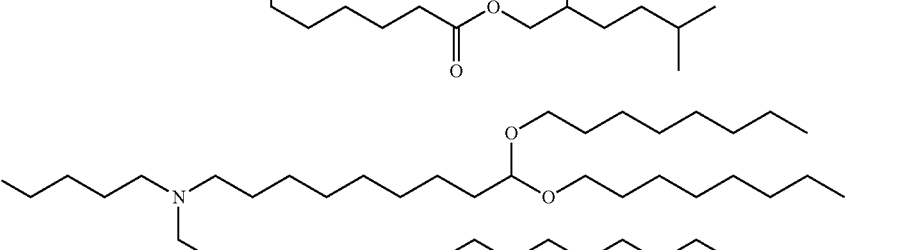 | 49 |
| 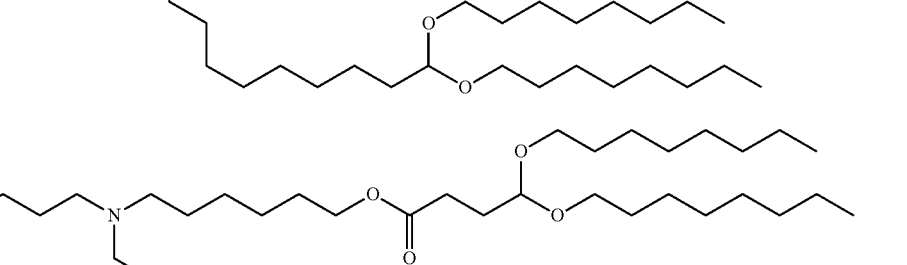 | 50 |
| 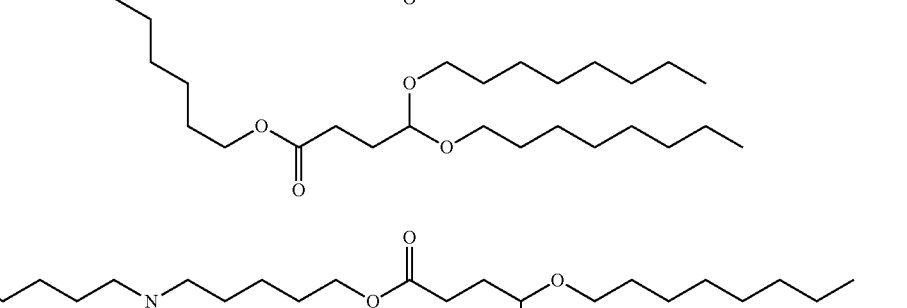 | 51 |

Table (I)-continued

Non-Limiting Examples of Ionizable Lipids with an Acyclic Core

| Structure | Compound No. |
|---|---|
| 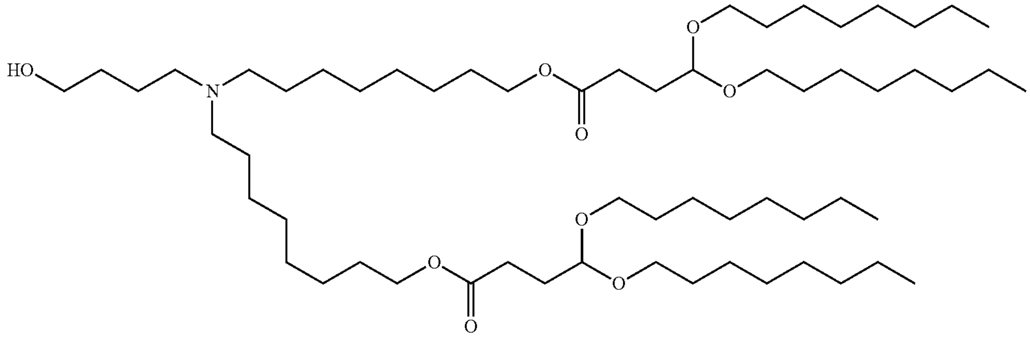 [SMILES: CCCCCCCCOC(CCC(=O)OCCCCCCCCN(CCCCO)CCCCCCCCOC(=O)CCC(OCCCCCCCC)OCCCCCCCC)OCCCCCCCC] | 52 |
| 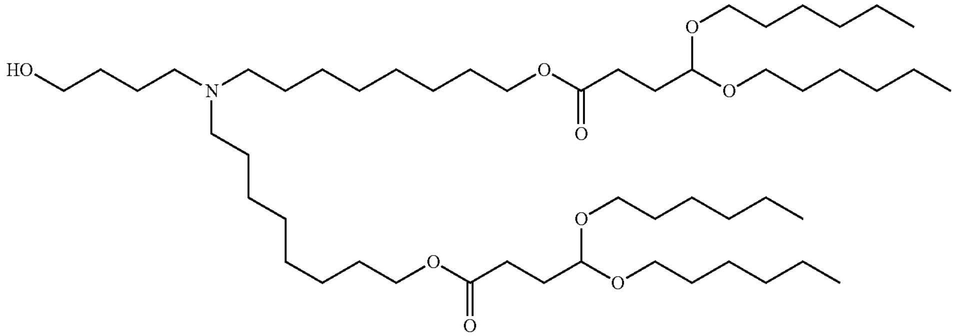 [SMILES: CCCCCCOC(CCC(=O)OCCCCCCCCN(CCCCO)CCCCCCCCOC(=O)CCC(OCCCCCC)OCCCCCC)OCCCCCC] | 53 |
| 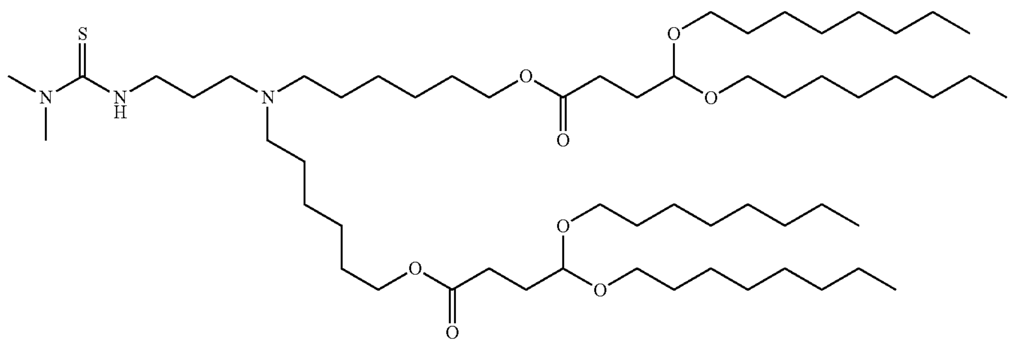 [SMILES: CCCCCCCCOC(CCC(=O)OCCCCCCN(CCCCCCOC(=O)CCC(OCCCCCCCC)OCCCCCCCC)CCCNC(=S)N(C)C)OCCCCCCCC] | 54 |
| 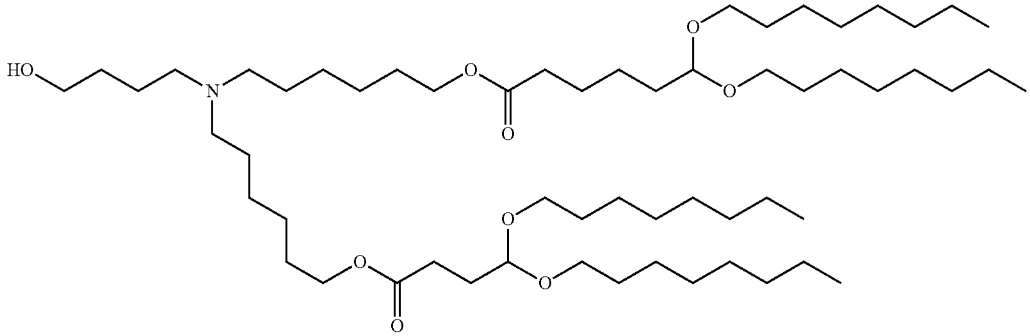 [SMILES: CCCCCCCCOC(CCCCC(=O)OCCCCCCN(CCCCO)CCCCCCOC(=O)CCC(OCCCCCCCC)OCCCCCCCC)OCCCCCCCC] | 55 |

Table (I)-continued

Non-Limiting Examples of Ionizable Lipids with an Acyclic Core

| Structure | Compound No. |
|---|---|
| 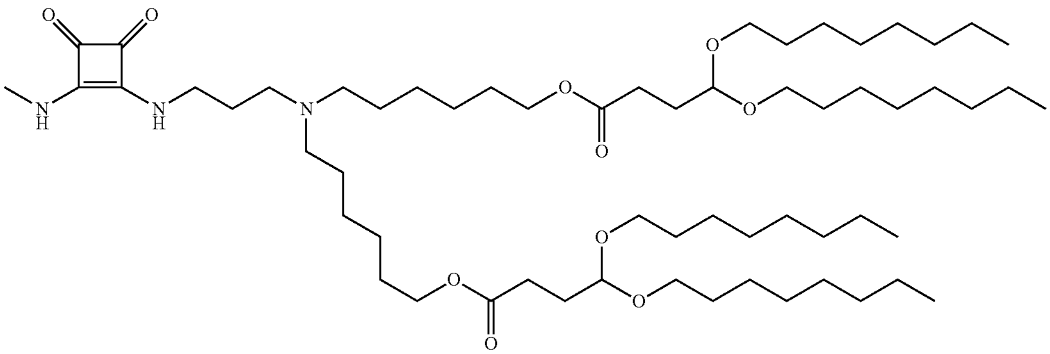 [SMILES: CCCCCCCCOC(CCC(=O)OCCCCCCN(CCCCCCOC(=O)CCC(OCCCCCCCC)OCCCCCCCC)CCCNc1c(NC)c(=O)c1=O)OCCCCCCCC] | 56 |
| 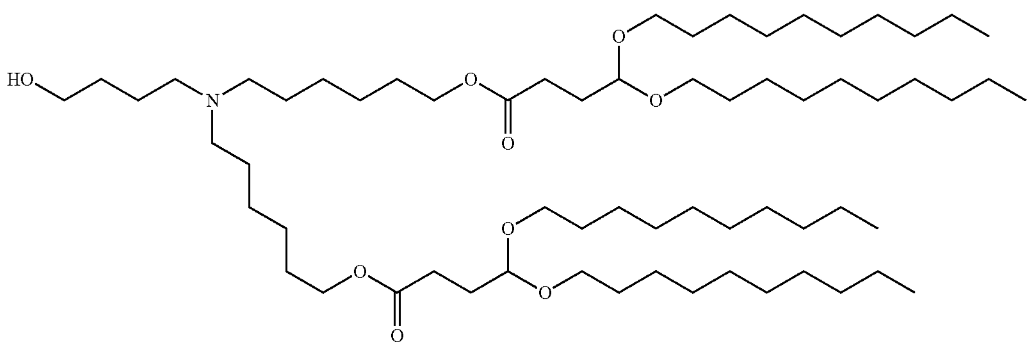 [SMILES: CCCCCCCCCCOC(CCC(=O)OCCCCCCN(CCCCO)CCCCCCOC(=O)CCC(OCCCCCCCCCC)OCCCCCCCCCC)OCCCCCCCCCC] | 57 |
| 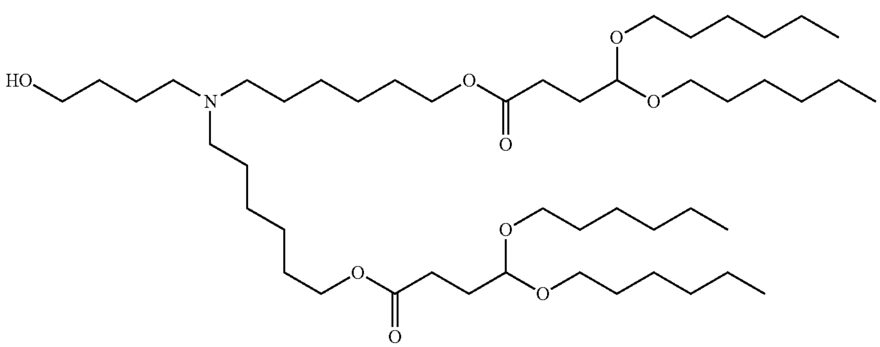 [SMILES: CCCCCCOC(CCC(=O)OCCCCCCN(CCCCO)CCCCCCOC(=O)CCC(OCCCCCC)OCCCCCC)OCCCCCC] | 58 |
| 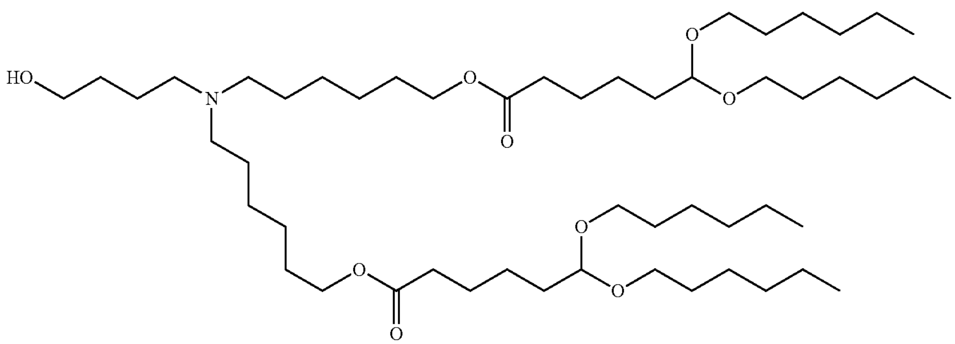 [SMILES: CCCCCCOC(CCCCC(=O)OCCCCCCN(CCCCO)CCCCCCOC(=O)CCCCC(OCCCCCC)OCCCCCC)OCCCCCC] | 59 |

Table (I)-continued

Non-Limiting Examples of Ionizable Lipids with an Acyclic Core

| Structure | Compound No. |
|---|---|
| 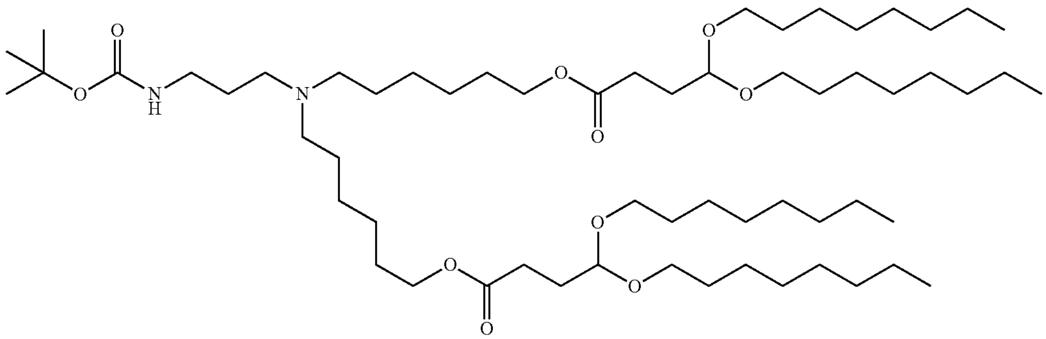 [SMILES: CCCCCCCCOC(CCC(=O)OCCCCCCN(CCCCCCOC(=O)CCC(OCCCCCCCC)OCCCCCCCC)CCCNC(=O)OC(C)(C)C)OCCCCCCCC] | 60 |
| 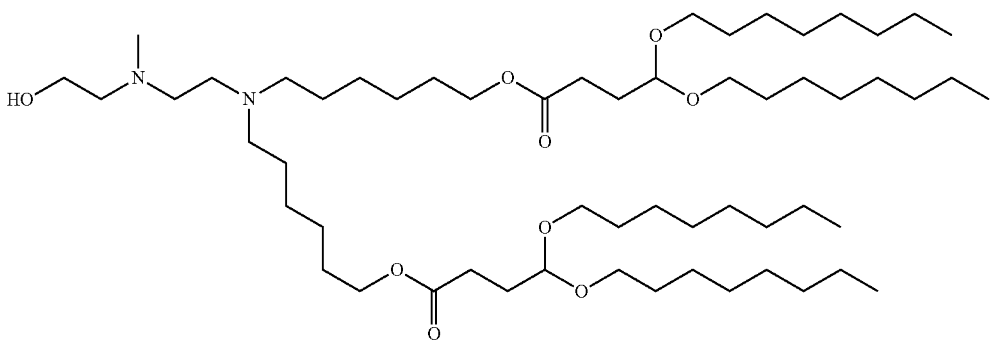 [SMILES: CCCCCCCCOC(CCC(=O)OCCCCCCN(CCCCCCOC(=O)CCC(OCCCCCCCC)OCCCCCCCC)CCN(C)CCO)OCCCCCCCC] | 61 |
| 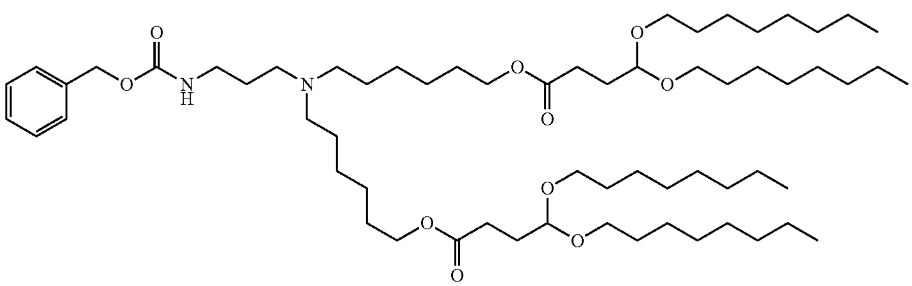 [SMILES: CCCCCCCCOC(CCC(=O)OCCCCCCN(CCCCCCOC(=O)CCC(OCCCCCCCC)OCCCCCCCC)CCCNC(=O)OCc1ccccc1)OCCCCCCCC] | 62 |
| 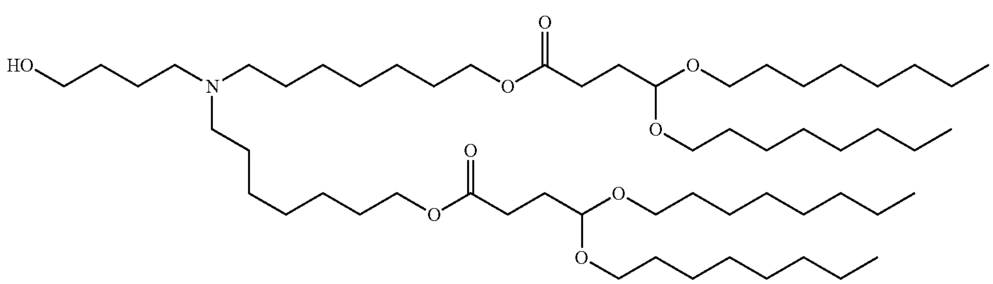 [SMILES: CCCCCCCCOC(CCC(=O)OCCCCCCCN(CCCCO)CCCCCCCOC(=O)CCC(OCCCCCCCC)OCCCCCCCC)OCCCCCCCC] | 64 |
| 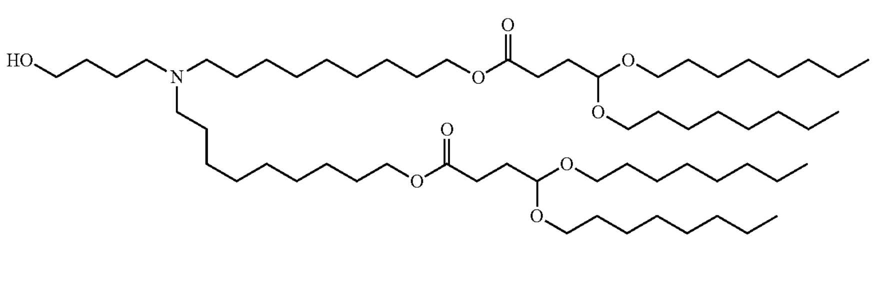 [SMILES: CCCCCCCCOC(CCC(=O)OCCCCCCCCCN(CCCCO)CCCCCCCCCOC(=O)CCC(OCCCCCCCC)OCCCCCCCC)OCCCCCCCC] | 65 |

Table (I)-continued

Non-Limiting Examples of Ionizable Lipids with an Acyclic Core

| Structure | Compound No. |
|---|---|
| 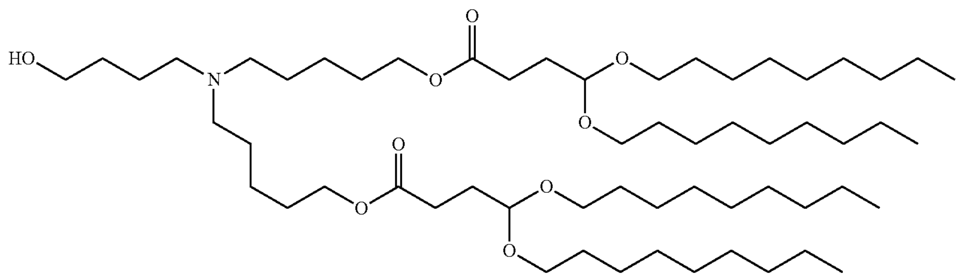 [SMILES: CCCCCCCCCOC(CCC(=O)OCCCCCN(CCCCO)CCCCCOC(=O)CCC(OCCCCCCCCC)OCCCCCCCCC)OCCCCCCCCC] | 66 |
| 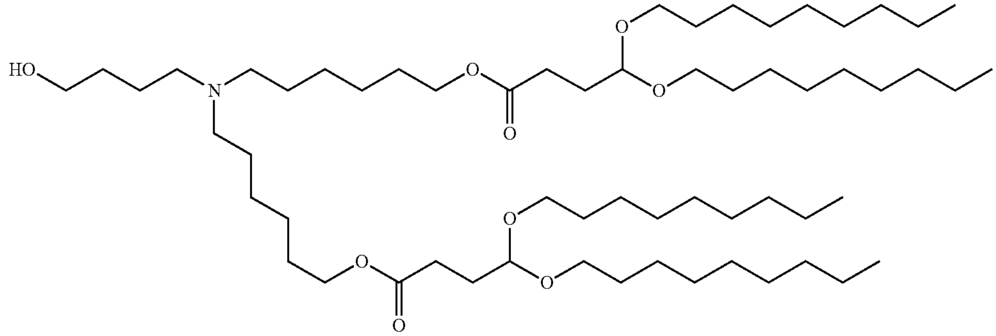 [SMILES: CCCCCCCCCOC(CCC(=O)OCCCCCCN(CCCCO)CCCCCCOC(=O)CCC(OCCCCCCCCC)OCCCCCCCCC)OCCCCCCCCC] | 67 |
| 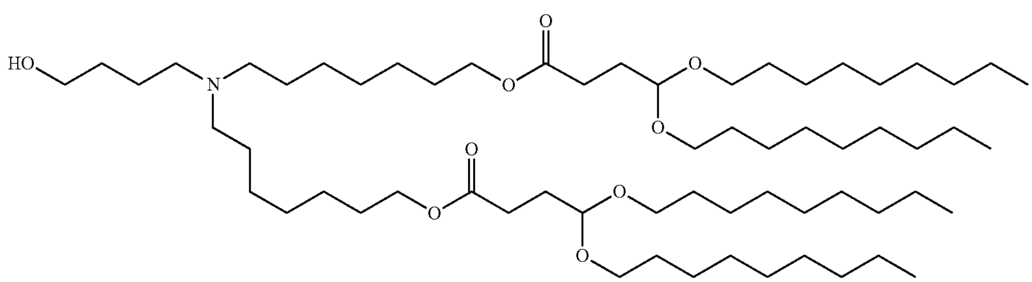 [SMILES: CCCCCCCCCOC(CCC(=O)OCCCCCCCN(CCCCO)CCCCCCCOC(=O)CCC(OCCCCCCCCC)OCCCCCCCCC)OCCCCCCCCC] | 68 |
| 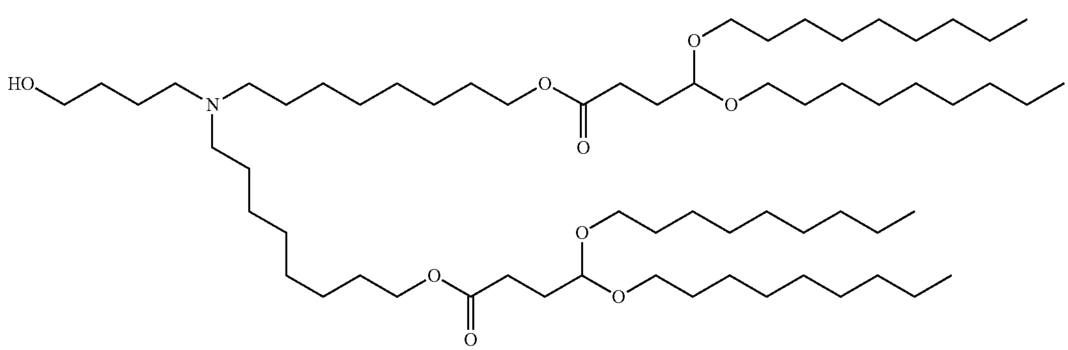 [SMILES: CCCCCCCCCOC(CCC(=O)OCCCCCCCCN(CCCCO)CCCCCCCCOC(=O)CCC(OCCCCCCCCC)OCCCCCCCCC)OCCCCCCCCC] | 69 |
| 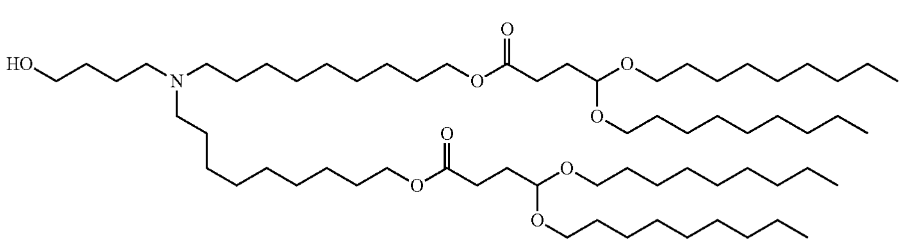 [SMILES: CCCCCCCCCOC(CCC(=O)OCCCCCCCCCN(CCCCO)CCCCCCCCCOC(=O)CCC(OCCCCCCCCC)OCCCCCCCCC)OCCCCCCCCC] | 70 |

Table (I)-continued
Non-Limiting Examples of Ionizable Lipids with an Acyclic Core
| Structure | Compound No. |
|---|---|
| 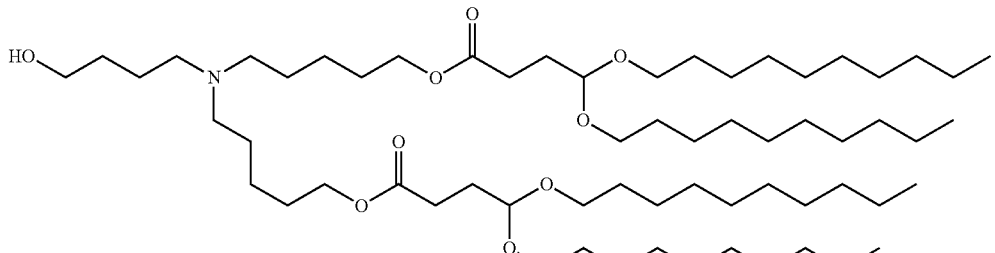 | 71 |
| 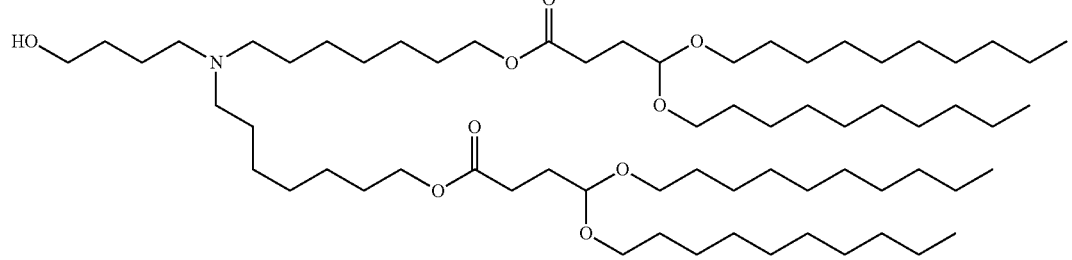 | 72 |
| 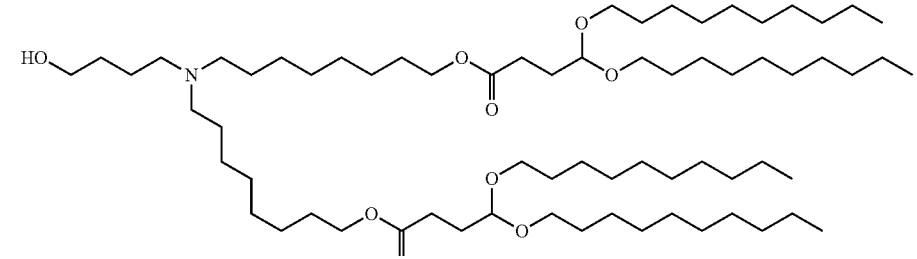 | 73 |
| 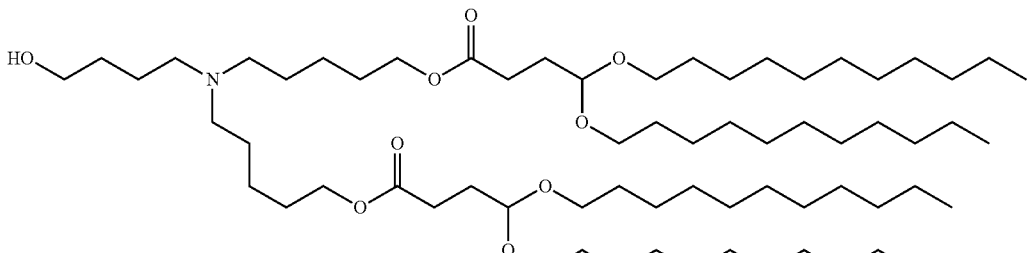 | 74 |
| 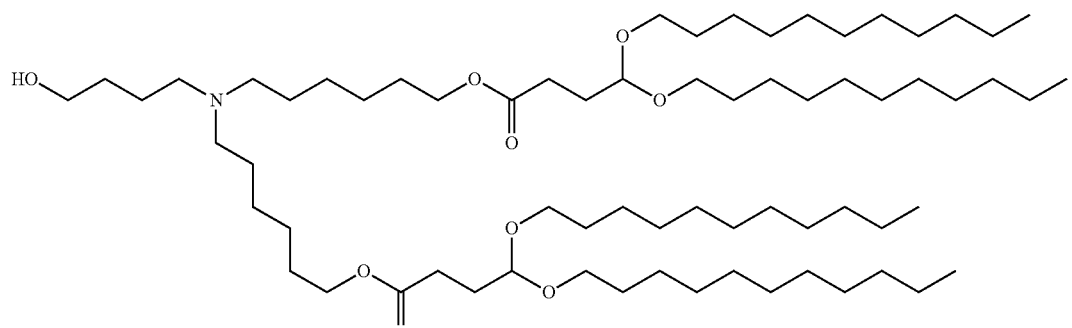 | 75 |

Table (I)-continued

Non-Limiting Examples of Ionizable Lipids with an Acyclic Core

| Structure | Compound No. |
|---|---|
| 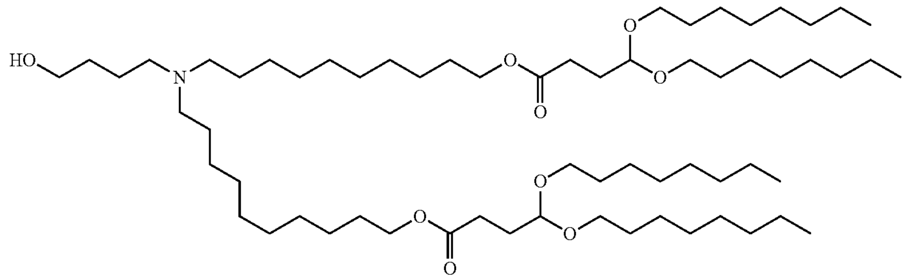 [SMILES: CCCCCCCCOC(CCC(=O)OCCCCCCCCCCN(CCCCO)CCCCCCCCCCOC(=O)CCC(OCCCCCCCC)OCCCCCCCC)OCCCCCCCC] | 76 |
| 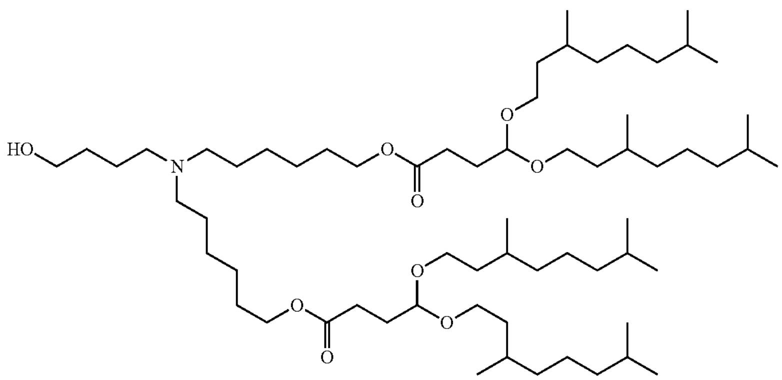 [SMILES: CC(C)CCCC(C)CCOC(CCC(=O)OCCCCCCN(CCCCO)CCCCCCOC(=O)CCC(OCCC(C)CCCC(C)C)OCCC(C)CCCC(C)C)OCCC(C)CCCC(C)C] | 77 |
| 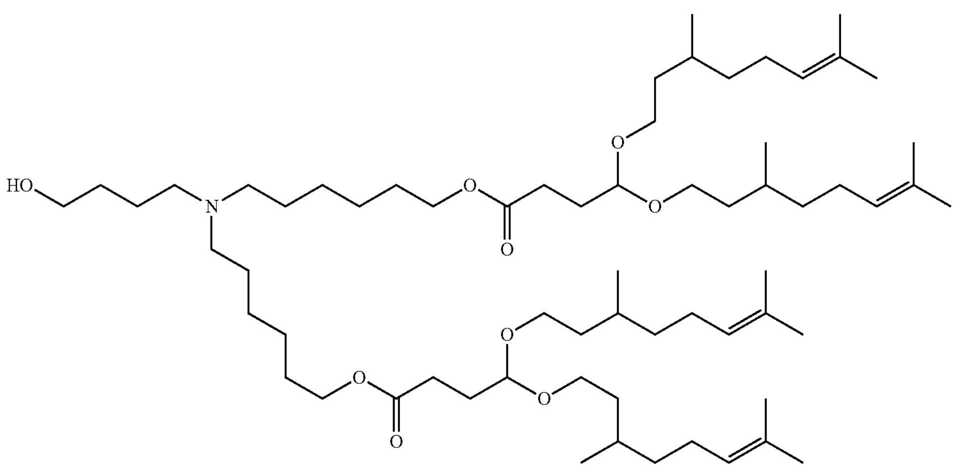 [SMILES: CC(C)=CCCC(C)CCOC(CCC(=O)OCCCCCCN(CCCCO)CCCCCCOC(=O)CCC(OCCC(C)CCC=C(C)C)OCCC(C)CCC=C(C)C)OCCC(C)CCC=C(C)C] | 78 |

Table (I)-continued

Non-Limiting Examples of Ionizable Lipids with an Acyclic Core

| Structure | Compound No. |
|---|---|
| 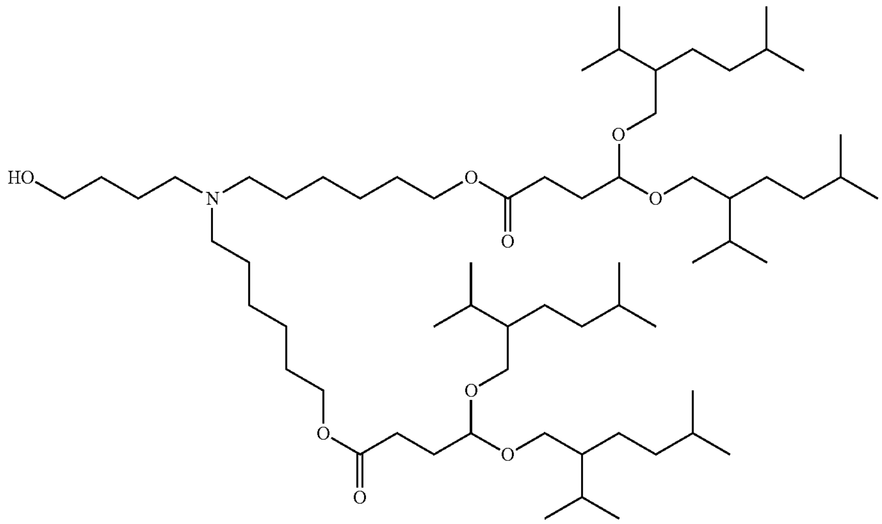 [SMILES: CC(C)CCC(COC(CCC(=O)OCCCCCCN(CCCCO)CCCCCCOC(=O)CCC(OCC(CCC(C)C)C(C)C)OCC(CCC(C)C)C(C)C)OCC(CCC(C)C)C(C)C)C(C)C] | 79 |
| 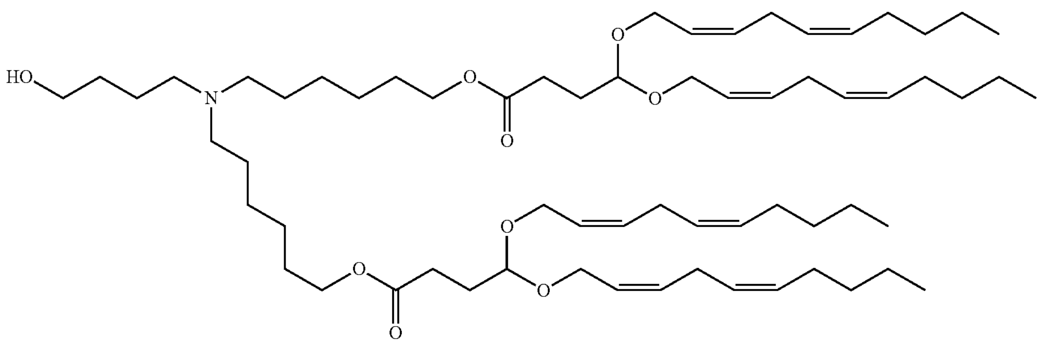 [SMILES: CCCC/C=C\C/C=C\COC(CCC(=O)OCCCCCCN(CCCCO)CCCCCCOC(=O)CCC(OC/C=C\C/C=C\CCCC)OC/C=C\C/C=C\CCCC)OC/C=C\C/C=C\CCCC] | 80 |
| 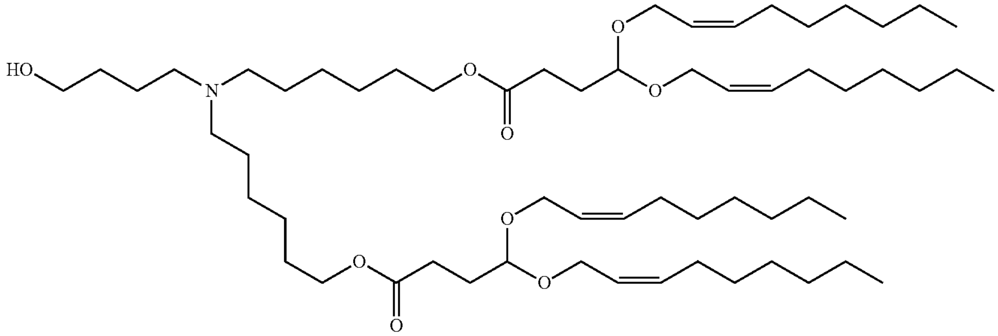 [SMILES: CCCCCC/C=C\COC(CCC(=O)OCCCCCCN(CCCCO)CCCCCCOC(=O)CCC(OC/C=C\CCCCCC)OC/C=C\CCCCCC)OC/C=C\CCCCCC] | 81 |
| 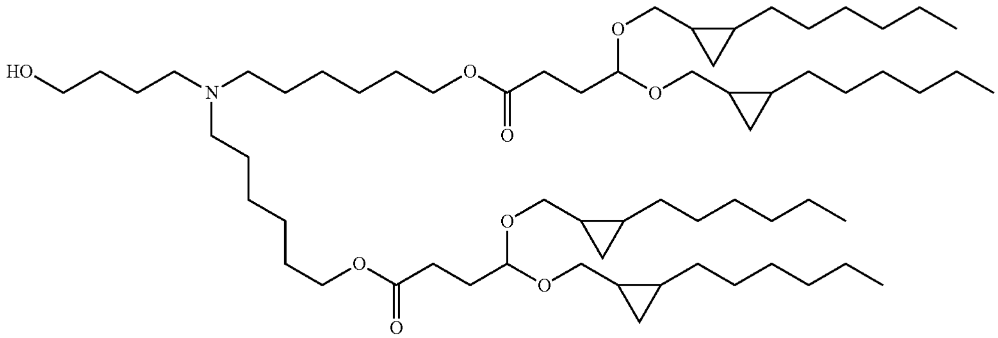 [SMILES: CCCCCCC1CC1COC(CCC(=O)OCCCCCCN(CCCCO)CCCCCCOC(=O)CCC(OCC1CC1CCCCCC)OCC1CC1CCCCCC)OCC1CC1CCCCCC] | 82 |

Table (I)-continued

Non-Limiting Examples of Ionizable Lipids with an Acyclic Core

| Structure | Compound No. |
|---|---|
| 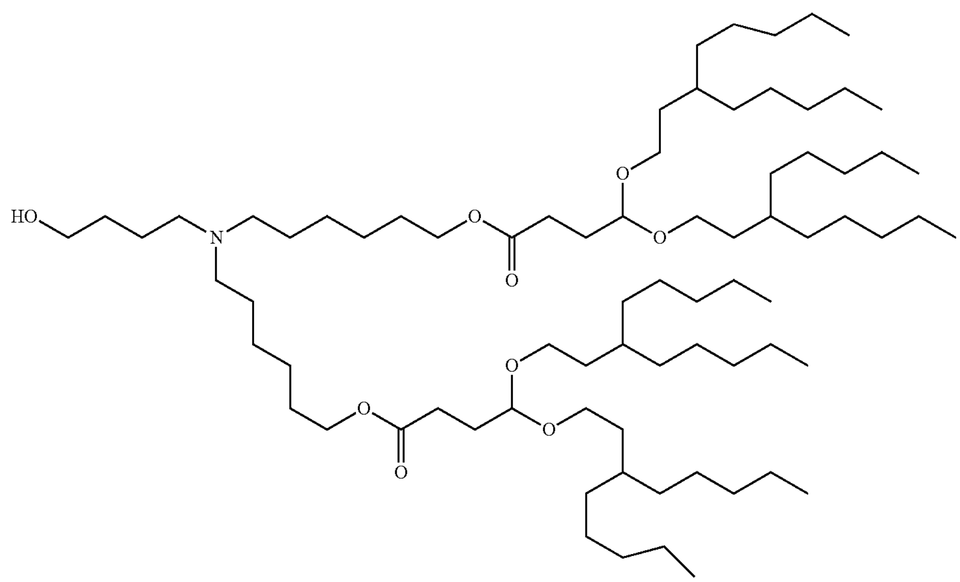 [SMILES: CCCCCC(CCCCC)CCOC(CCC(=O)OCCCCCCN(CCCCO)CCCCCCOC(=O)CCC(OCCC(CCCCC)CCCCC)OCCC(CCCCC)CCCCC)OCCC(CCCCC)CCCCC] | 83 |
| 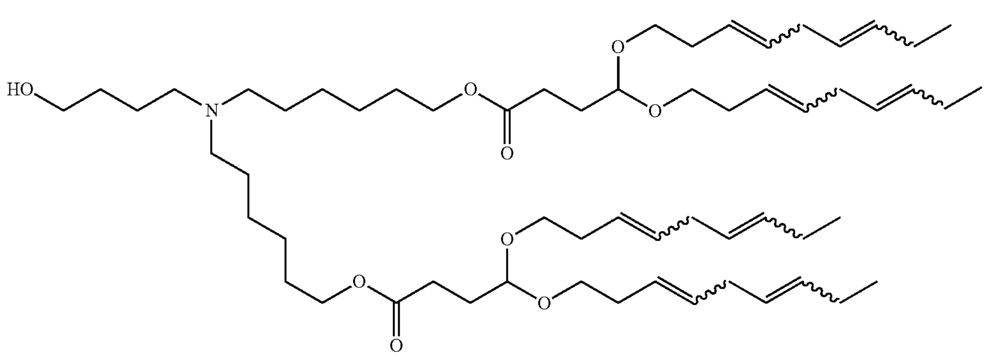 | 84 |
| 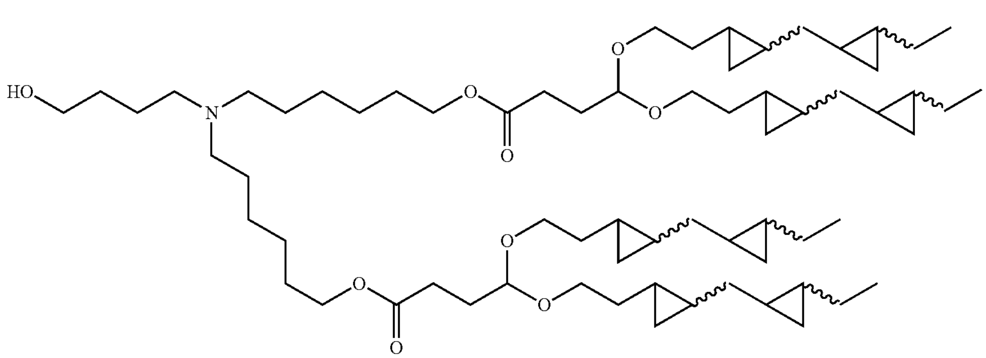 | 85 |

Table (I)-continued
Non-Limiting Examples of Ionizable Lipids with an Acyclic Core
| Structure | Compound No. |
|---|---|
| 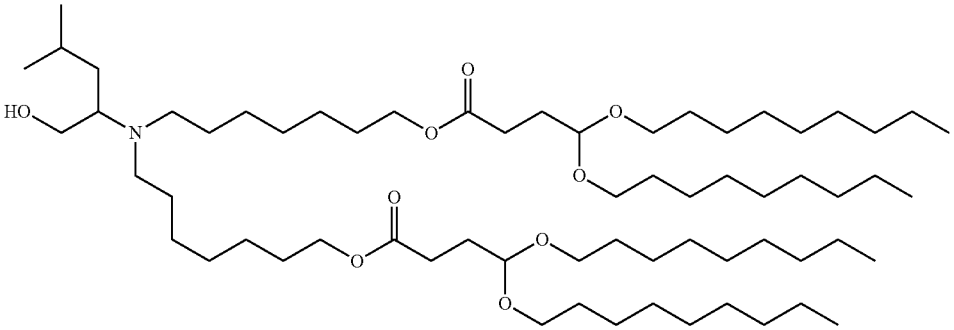 [SMILES: CCCCCCCCCOC(CCC(=O)OCCCCCCCN(CCCCCCCOC(=O)CCC(OCCCCCCCCC)OCCCCCCCCC)C(CO)CC(C)C)OCCCCCCCCC] | 86 |
| 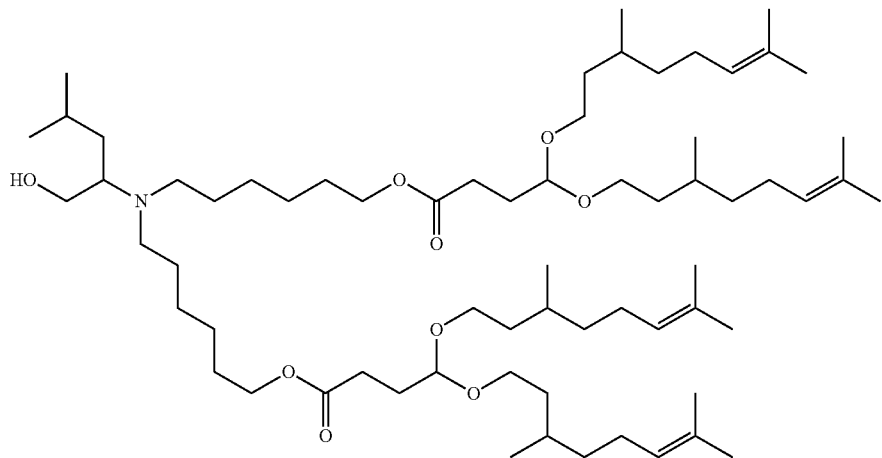 [SMILES: CC(C)=CCCC(C)CCOC(CCC(=O)OCCCCCCN(CCCCCCOC(=O)CCC(OCCC(C)CCC=C(C)C)OCCC(C)CCC=C(C)C)C(CO)CC(C)C)OCCC(C)CCC=C(C)C] | 87 |
| 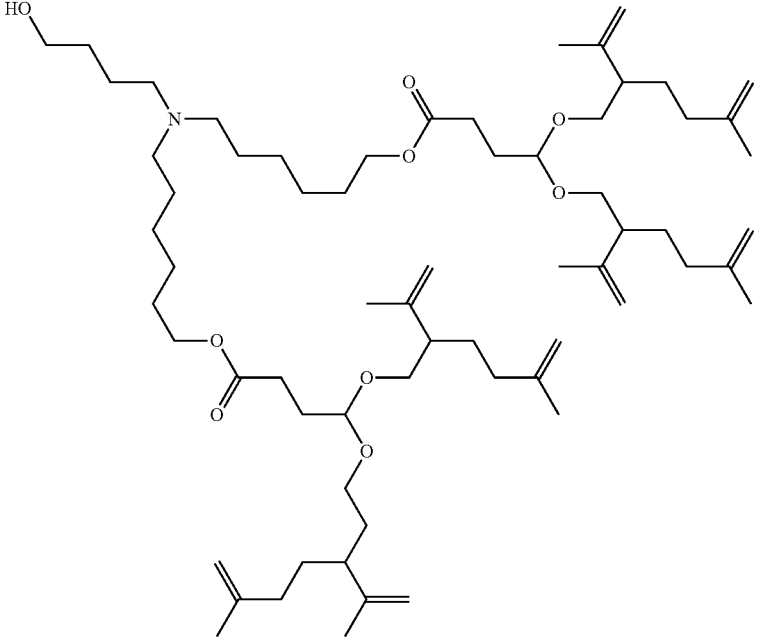 | 88 |

Table (I)-continued

Non-Limiting Examples of Ionizable Lipids with an Acyclic Core

| Structure | Compound No. |
|---|---|
| 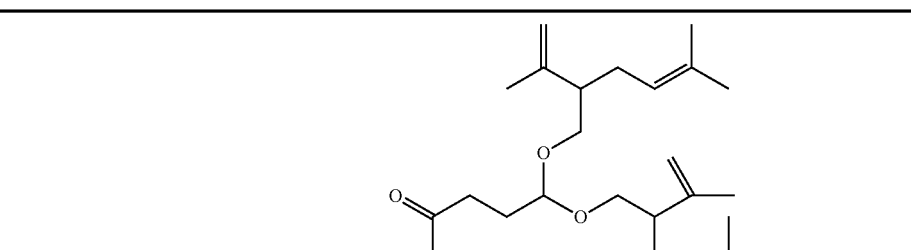 | 89 |

In some embodiments, an LNP of the present disclosure comprises an ionizable lipid disclosed in PCT Application Publication WO2023044333A1, which is incorporated by reference herein, in its entirety.

Formula (CY')

In some embodiments, an LNP disclosed herein comprises an ionizable lipid of Formula (CY)

$$\text{(CY)}$$

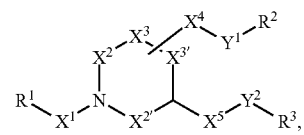

or a pharmaceutically acceptable salt thereof, wherein:

$R^1$ is selected from the group consisting of —OH, —OAc, $R^{1a}$,

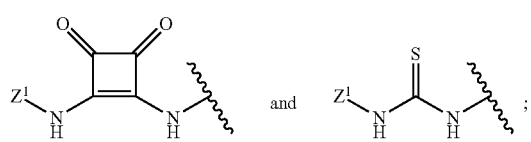

$Z^1$ is optionally substituted $C_1$-$C_6$ alkyl;
$X^1$ is optionally substituted $C_2$-$C_6$ alkylenyl;
$X^2$ is selected from the group consisting of a bond, —CH$_2$— and —CH$_2$CH$_2$—;
$X^{2'}$ is selected from the group consisting of a bond, —CH$_2$— and —CH$_2$CH$_2$—;
$X^3$ is selected from the group consisting of a bond, —CH$_2$— and —CH$_2$CH$_2$—;
$X^{3'}$ is selected from the group consisting of a bond, —CH$_2$— and —CH$_2$CH$_2$—;

$X^4$ and $X^5$ are independently optionally substituted $C_2$-$C_{14}$ alkylenyl or optionally substituted $C_2$-$C_{14}$ alkenylenyl;

$Y^1$ and $Y^2$ are independently selected from the group consisting of

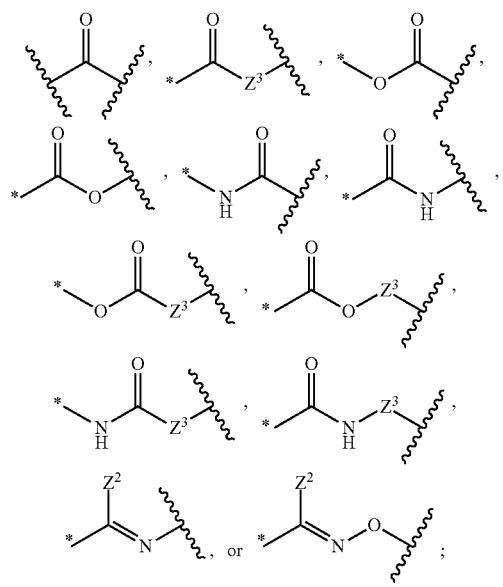

wherein the bond marked with an "*" is attached to $X^4$ or $X^5$;

each $Z^2$ is independently H or optionally substituted $C_1$-$C_6$ alkyl;

each $Z^3$ is independently optionally substituted $C_1$-$C_6$ alkylenyl;

$R^2$ is selected from the group consisting of optionally substituted $C_4$-$C_{20}$ alkyl, optionally substituted $C_2$-$C_{14}$ alkenyl, and —(CH$_2$)$_p$CH(OR$^6$)(OR$^7$);

R³ is selected from the group consisting of optionally substituted C₄-C₂₀ alkyl, optionally substituted C₂-C₁₄ alkenyl, or —(CH₂)$_q$CH(OR⁸)(OR⁹);

R$^{1a}$ is:

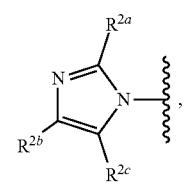

R$^{1a}$-1

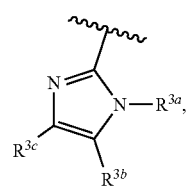

R$^{1a}$-2

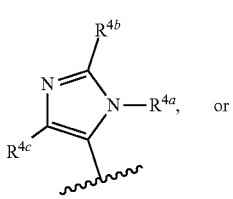

R$^{1a}$-3, or

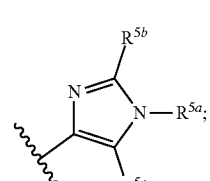

R$^{1a}$-4

R$^{2a}$, R$^{2b}$, and R$^{2c}$ are independently hydrogen and C₁-C₆ alkyl;

R$^{3a}$, R$^{3b}$, and R$^{3c}$ are independently hydrogen and C₁-C₆ alkyl;

R$^{4a}$, R$^{4b}$, and R$^{4c}$ are independently hydrogen and C₁-C₆ alkyl;

R$^{5a}$, R$^{5b}$, and R$^{5c}$ are independently hydrogen and C₁-C₆ alkyl;

R⁶, R⁷, R⁸, and R⁹ are independently optionally substituted C₁-C₁₄ alkyl, optionally substituted C₂-C₁₄ alkenyl, or —(CH₂)$_m$-A-(CH₂)$_n$H;

each A is independently a C₃-C₈ cycloalkylenyl;

each m is independently 0, 1, 2, 3, 4, 5, 6, 7, 8, 9, 10, 11, or 12;

each n is independently 0, 1, 2, 3, 4, 5, 6, 7, 8, 9, 10, 11, or 12;

p is selected from the group consisting of 0, 1, 2, 3, 4, 5, 6, and 7; and q is selected from the group consisting of 0, 1, 2, 3, 4, 5, 6, and 7.

Formulas (CY-I), (CY-II), (CY-III), (CY-IV), and (CY-V)

In some embodiments, the present disclosure includes a compound of Formula (CY-I), (CY-II), (CY-II), (CY-IV), or (CY-V):

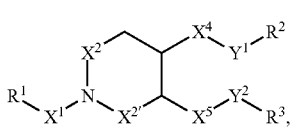 (CY-I)

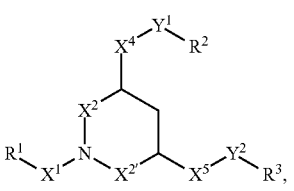 (CY-II)

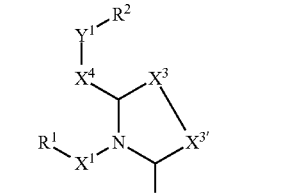 (CY-III)

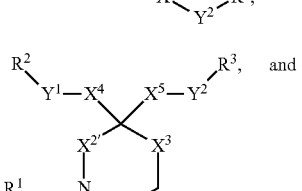 (CY-IV), and

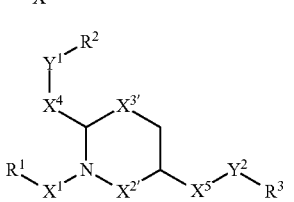 (CY-V)

or a pharmaceutically acceptable salt thereof,
wherein X¹, X², X$^{2'}$, X³, X$^{3'}$, X⁴, X⁵, Y¹, Y², R¹, R², and R³ are defined herein.

Formulas (CY-VI) and (CY-VII)

In some embodiments, the present disclosure includes a compound of Formula (CY-VI) or (CY-VII):

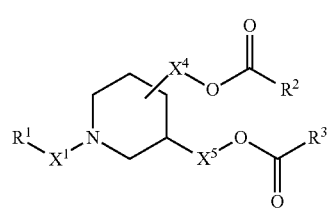 (CY-VI)

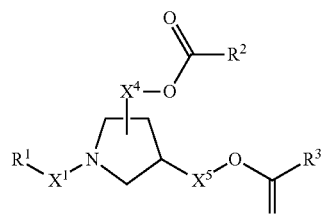 (CY-VII)

or a pharmaceutically acceptable salt thereof,
wherein X¹, X⁴, X⁵, R¹, R², and R³ are defined herein.

Formulas (CY-VIII) and (CY-IX)

In some embodiments, the present disclosure includes a compound of Formula (CY-VIII) or (CY-IX):

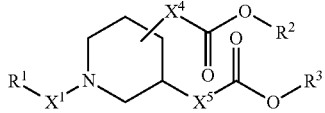
(CY-VIII)

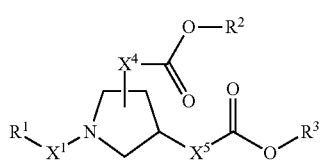
(CY-IX)

or pharmaceutically acceptable salt thereof.

wherein $X^1$, $X^4$, $X^5$, $R^1$, $R^2$, and $R^3$ are defined herein.

Formulas (CY-IV-a), (CY-IV-b), and (CY-IV-c)

In some embodiments, the present disclosure includes a compound of Formula (CY-IV-a), (CY-IV-b), or (CY-IV-c)

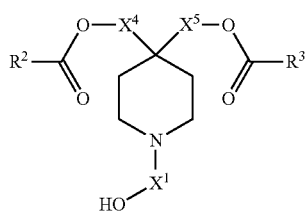
(CY-IV-a)

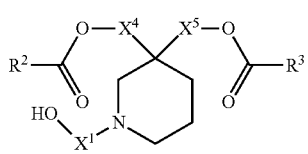
(CY-IV-b)

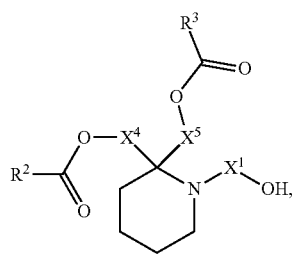
(CY-IV-c)

or pharmaceutically acceptable salt thereof.

wherein $X^1$, $X^4$, $X^5$, $R^2$, and $R^3$ are defined herein.

Formulas (CY-IV-d), (CY-IV-e), and (CY-IV-f)

In some embodiments, the present disclosure includes a compound of Formula (CY-IV-d), (CY-IV-e), or (CY-IV-f)

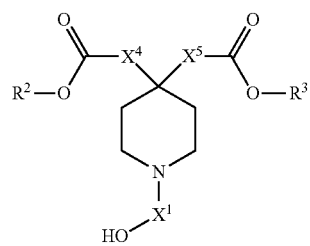
(CY-IV-d)

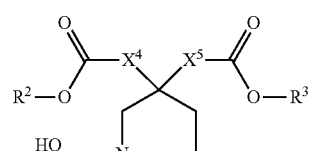
(CY-IV-e)

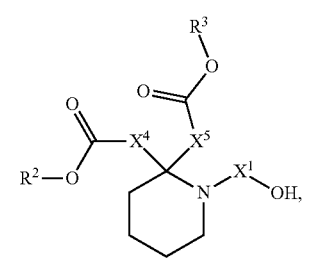
(CY-IV-f)

or pharmaceutically acceptable salt thereof.

wherein $X^1$, $X^4$, $X^5$, $R^2$, and $R^3$ are defined herein.

Formula (CY-IV)

In some embodiments, Lipids of the Disclosure have a structure of Formula (CY-IV'):

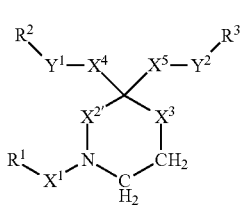
(CY-IV')

or a pharmaceutically acceptable salt thereof, wherein $R^1$, $R^2$, $R^3$, $X^1$, $X^2$, $X^3$, $X^4$, $X^5$, $Y^1$, and $Y^2$ are as defined in connection with Formula (CY-I')

In some embodiments, Lipids of the Disclosure have a structure of Formula (CY-IV'), wherein:

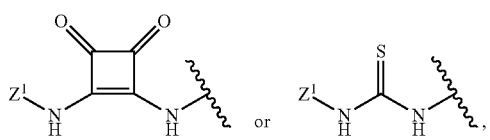

wherein $Z^1$ is optionally substituted $C_1$-$C_6$ alkyl;

$X^1$ is optionally substituted $C_2$-$C_6$ alkylenyl;

$X^2$ and $X^3$ are independently a bond, —$CH_2$—, or —$CH_2CH_2$—;

$X^4$ and $X^5$ are independently optionally substituted $C_2$-$C_{14}$ alkylenyl;

$Y^1$ and $Y^2$ are independently

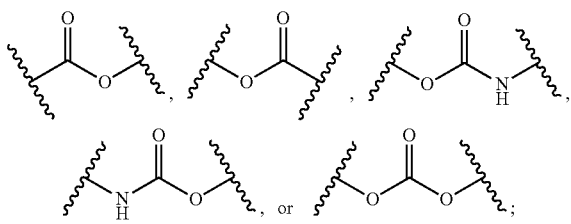

$R^2$ and $R^3$ are independently optionally substituted $C_4$-$C_{20}$ alkyl;

$R^{1a}$ is:

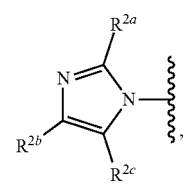 $R^{1a}$-1

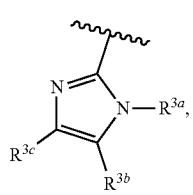 $R^{1a}$-2

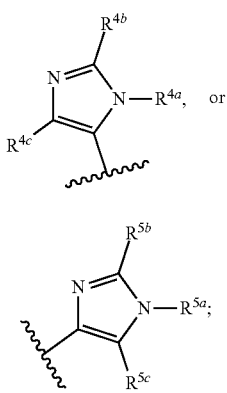 $R^{1a}$-3, or $R^{1a}$-4

$R^{2a}$, $R^{2b}$ and $R^{2c}$ are independently hydrogen and $C_1$-$C_6$ alkyl;

$R^{3a}$, $R^{3b}$, and $R^{3c}$ are independently hydrogen and $C_1$-$C_6$ alkyl; $R^{4a}$, $R^{4b}$, and $R^{4c}$ are independently hydrogen and $C_1$-$C_6$ alkyl; and $R^{5a}$, $R^{5b}$, and $R^{5c}$ are independently hydrogen and $C_1$-$C_6$ alkyl In some embodiments, Lipids of the Disclosure have a structure of Formula (CY-IV'), wherein $R^1$ is —OH,

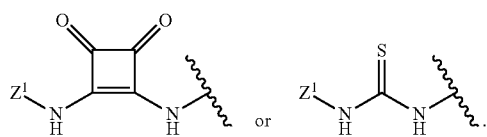

In some embodiments, Lipids of the Disclosure have a structure of Formula (CY-IV'), wherein $Y^1$ and $Y^2$ are independently:

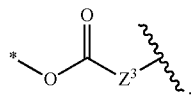

In some embodiments, Lipids of the Disclosure have a structure of Formula (CY-IV'), wherein $R^2$ is —CH(OR$^6$)(OR$^7$).

In some embodiments, Lipids of the Disclosure have a structure of Formula (CY-IV'), wherein $R^3$ is —CH(OR$^8$)(OR$^9$).

Non-limiting examples of lipids having a structure of Formula (CY-IV') include compounds CY7, CY8, CY19, CY20, CY21, CY28, CY29, CY40, CY41, CY42, CY48, CY49, CY58, CY59, and CY60.

Formula (CY-VI')

In some embodiments, Lipids of the Disclosure have a structure of Formula (CY-VI'):

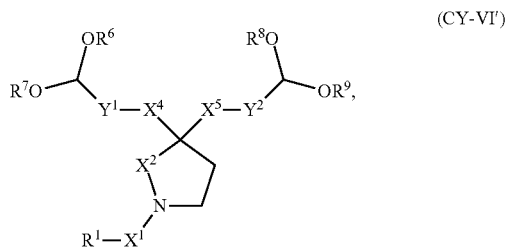

(CY-VI')

or a pharmaceutically acceptable salt thereof, wherein $R^1$, $R^6$, $R^7$, $R^8$, $R^9$, $X^1$, $X^2$, $X^3$, $X^4$, $X^5$, $Y^1$, and $Y^2$ are as defined in connection with Formula (CY-I').

In some embodiments, Lipids of the Disclosure have a structure of Formula (CY-VI'), or a pharmaceutically acceptable salt thereof, wherein $R^1$ is —OH.

In some embodiments, Lipids of the Disclosure have a structure of Formula (CY-VI'), or a pharmaceutically acceptable salt thereof, wherein $X^1$ is $C_2$-$C_6$ alkylenyl.

In some embodiments, Lipids of the Disclosure have a structure of Formula (CY-VI'), or a pharmaceutically acceptable salt thereof, wherein $X^2$ is —CH$_2$CH$_2$—.

In some embodiments, Lipids of the Disclosure have a structure of Formula (CY-VI'), or a pharmaceutically acceptable salt thereof, wherein $X^4$ is $C_2$-$C_6$ alkylenyl.

In some embodiments, Lipids of the Disclosure have a structure of Formula (CY-VI'), or a pharmaceutically acceptable salt thereof, wherein $X^5$ is $C_2$-$C_6$ alkylenyl.

In some embodiments, Lipids of the Disclosure have a structure of Formula (CY-VI'), or a pharmaceutically acceptable salt thereof, wherein $Y^1$ is:

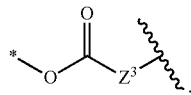

In some embodiments, Lipids of the Disclosure have a structure of Formula (CY-VI'), or a pharmaceutically acceptable salt thereof, wherein $Y^2$ is:

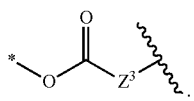

In some embodiments, Lipids of the Disclosure have a structure of Formula (CY-VI'), or a pharmaceutically acceptable salt thereof, wherein each $Z^3$ is independently optionally substituted $C_1$-$C_6$ alkylenyl.

In some embodiments, Lipids of the Disclosure have a structure of Formula (CY-VI'), or a pharmaceutically acceptable salt thereof, wherein each $Z^3$ is —CH$_2$CH$_2$—.

In some embodiments, Lipids of the Disclosure have a structure of Formula (CY-VI'), or a pharmaceutically acceptable salt thereof, wherein $R^6$ is $C_5$-$C_{14}$ alkyl.

In some embodiments, Lipids of the Disclosure have a structure of Formula (CY-VI'), or a pharmaceutically acceptable salt thereof, wherein $R^7$ is $C_5$-$C_{14}$ alkyl.

In some embodiments, Lipids of the Disclosure have a structure of Formula (CY-VI'), or a pharmaceutically acceptable salt thereof, wherein $R^6$ is $C_6$-$C_{14}$ alkenyl.

In some embodiments, Lipids of the Disclosure have a structure of Formula (CY-VI'), or a pharmaceutically acceptable salt thereof, wherein $R^7$ is $C_6$-$C_{14}$ alkenyl.

In some embodiments, Lipids of the Disclosure have a structure of Formula (CY-VI'), or a pharmaceutically acceptable salt thereof, wherein $R^8$ is $C_5$-$C_{16}$ alkyl.

In some embodiments, Lipids of the Disclosure have a structure of Formula (CY-VI'), or a pharmaceutically acceptable salt thereof, wherein $R^9$ is $C_5$-$C_{14}$ alkyl.

In some embodiments, Lipids of the Disclosure have a structure of Formula (CY-VI'), or a pharmaceutically acceptable salt thereof, wherein $R^8$ is $C_6$-$C_{14}$ alkenyl.

In some embodiments, Lipids of the Disclosure have a structure of Formula (CY-VI'), or a pharmaceutically acceptable salt thereof, wherein $R^9$ is $C_6$-$C_{14}$ alkenyl.

In some embodiments, Lipids of the Disclosure comprise a heterocyclic core, wherein the heteroatom is nitrogen. In some embodiments, the heterocyclic core comprises pyrrolidine or a derivative thereof. In some embodiments, the heterocyclic core comprises piperidine or a derivative thereof. In some embodiments, Lipids of the Disclosure are selected from any lipid in Table (II) below or a pharmaceutically acceptable salt thereof:

$R^1$

In some embodiments, $R^1$ is selected from the group consisting of —OH, —OAc, $R^{1a}$

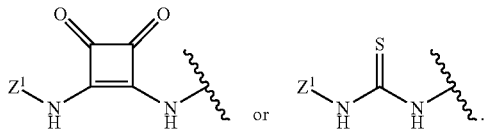

In some embodiments, $R^1$ is —OH or —OAc. In some embodiments, $R^1$ is OH. In some embodiments, $R^1$ is —OAc. In some embodiments, $R^1$ is $R^{1a}$. In some embodiments, $R^1$ is imidazolyl. In some embodiments, $R^1$ is

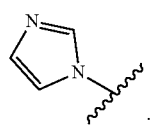

$R^2$

In some embodiments, $R^2$ is selected from the group consisting of optionally substituted $C_4$-$C_{20}$ alkyl, optionally substituted $C_2$-$C_{14}$ alkenyl, and —(CH$_2$)$_p$CH(OR$^6$)(OR$^7$).

In some embodiments, $R^2$ is optionally substituted $C_4$-$C_{20}$ alkyl. In some embodiments, $R^2$ is optionally substituted $C_8$-$C_{17}$ alkyl. In some embodiments, $R^2$ is optionally substituted $C_9$-$C_{16}$ alkyl. In some embodiments, $R^2$ is optionally substituted $C_8$-$C_{10}$ alkyl. In some embodiments, $R^2$ is optionally substituted $C_1$-$C_{13}$ alkyl. In some embodiments, $R^2$ is optionally substituted $C_{14}$-$C_{16}$ alkyl. In some embodiments, $R^2$ is optionally substituted $C_9$ alkyl. In some embodiments, $R^2$ is optionally substituted $C_{10}$ alkyl. In some embodiments, $R^2$ is optionally substituted $C_{11}$ alkyl. In some embodiments, $R^2$ is optionally substituted $C_{12}$ alkyl. In some embodiments, $R^2$ is optionally substituted $C_{13}$ alkyl. In some embodiments, $R^2$ is optionally substituted $C_{14}$ alkyl. In some embodiments, $R^2$ is optionally substituted $C_{15}$ alkyl. In some embodiments, $R^2$ is optionally substituted $C_{16}$ alkyl.

In some embodiments, $R^2$ is optionally substituted $C_2$-$C_{14}$ alkenyl. In some embodiments, $R^2$ is optionally substituted $C_5$-$C_{14}$ alkenyl. In some embodiments, $R^2$ is optionally substituted $C_7$-$C_{14}$ alkenyl. In some embodiments, $R^2$ is optionally substituted $C_9$-$C_{14}$ alkenyl. In some embodiments, $R^2$ is optionally substituted $C_{10}$-$C_{14}$ alkenyl. In some embodiments, $R^2$ is optionally substituted $C_{12}$-$C_{14}$ alkenyl.

In some embodiments, $R^2$ is —(CH$_2$)$_p$CH(OR$^6$)(OR$^7$). In some embodiments, $R^2$ is —CH(OR$^6$)(OR$^7$). In some embodiments, $R^2$ is —CH$_2$CH(OR$^6$)(OR$^7$). In some embodiments, $R^2$ is —(CH$_2$)$_2$CH(OR$^6$)(OR$^7$). In some embodiments, $R^2$ is —(CH$_2$)$_3$CH(OR$^6$)(OR$^7$). In some embodiments, $R^2$ is —(CH$_2$)$_4$CH(OR$^6$)(OR$^7$).

In some embodiments, $R^2$ is selected from the group consisting of

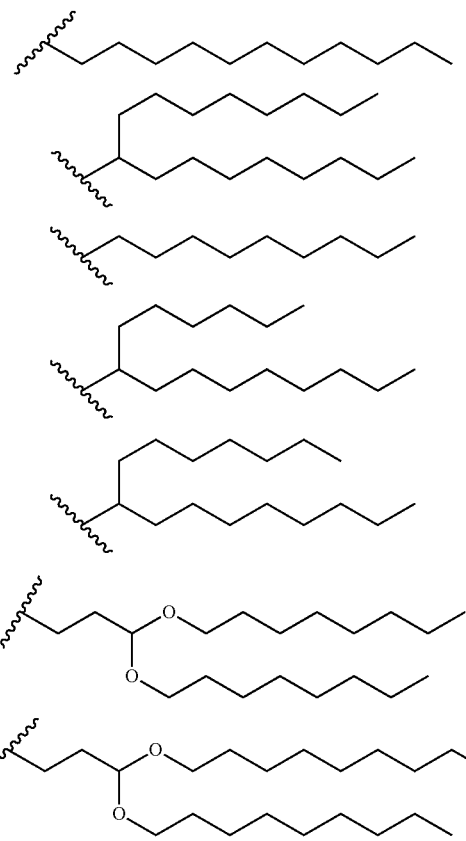

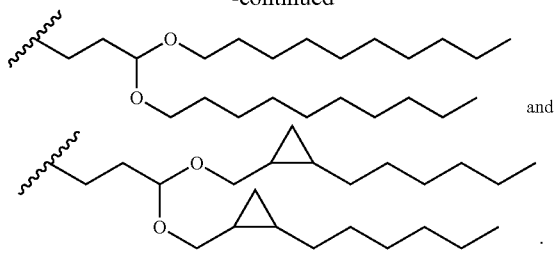

and $R^3$

In some embodiments, $R^3$ is selected from the group consisting of optionally substituted $C_4$-$C_{20}$ alkyl, optionally substituted $C_2$-$C_{14}$ alkenyl, and —$(CH_2)_q CH(OR^6)(OR^7)$.

In some embodiments, $R^3$ is optionally substituted $C_4$-$C_{20}$ alkyl. In some embodiments, $R^3$ is optionally substituted $C_8$-$C_{17}$ alkyl. In some embodiments, $R^3$ is optionally substituted $C_9$-$C_{16}$ alkyl. In some embodiments, $R^3$ is optionally substituted $C_8$-$C_{10}$ alkyl. In some embodiments, $R^3$ is optionally substituted $C_1$-$C_{13}$ alkyl. In some embodiments, $R^3$ is optionally substituted $C_{14}$-$C_{16}$ alkyl. In some embodiments, $R^3$ is optionally substituted $C_9$ alkyl. In some embodiments, $R^3$ is optionally substituted $C_{10}$ alkyl. In some embodiments, $R^3$ is optionally substituted $C_{11}$ alkyl. In some embodiments, $R^3$ is optionally substituted $C_{12}$ alkyl. In some embodiments, $R^3$ is optionally substituted $C_{13}$ alkyl. In some embodiments, $R^3$ is optionally substituted $C_{14}$ alkyl. In some embodiments, $R^3$ is optionally substituted $C_{15}$ alkyl. In some embodiments, $R^3$ is optionally substituted $C_{16}$ alkyl.

In some embodiments, $R^3$ is optionally substituted $C_2$-$C_{14}$ alkenyl. In some embodiments, $R^3$ is optionally substituted $C_5$-$C_{14}$ alkenyl. In some embodiments, $R^3$ is optionally substituted $C_7$-$C_{14}$ alkenyl. In some embodiments, $R^3$ is optionally substituted $C_9$-$C_{14}$ alkenyl. In some embodiments, $R^3$ is optionally substituted $C_{10}$-$C_{14}$ alkenyl. In some embodiments, $R^3$ is optionally substituted $C_{12}$-$C_{14}$ alkenyl.

In some embodiments, $R^3$ is —$(CH_2)_q CH(OR^8)(OR^9)$. In some embodiments, $R^3$ is —$CH(OR^8)(OR^9)$. In some embodiments, $R^3$ is —$CH_2 CH(OR^8)(OR^9)$. In some embodiments, $R^3$ is —$(CH_2)_2 CH(OR^8)(OR^9)$. In some embodiments, $R^3$ is —$(CH_2)_3 CH(OR^8)(OR^9)$. In some embodiments, $R^3$ is —$(CH_2)_4 CH(OR^8)(OR^9)$.

In some embodiments, $R^3$ is selected from the group consisting of

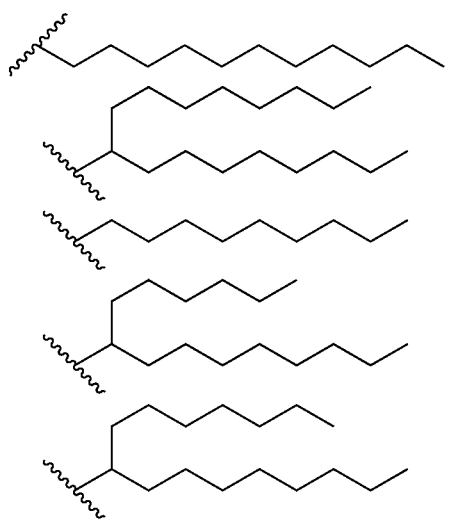

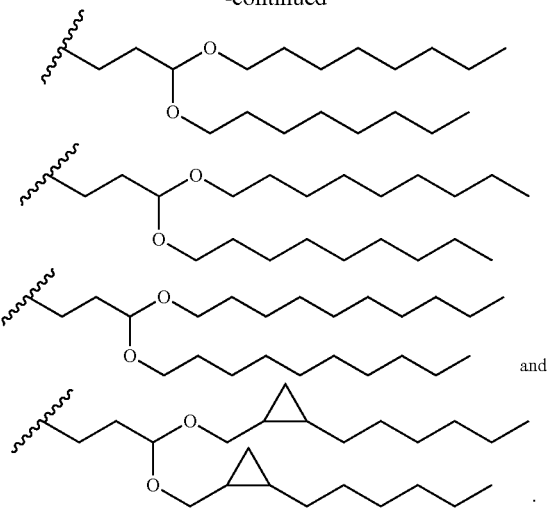

and $R^6, R^7, R^8, R^9$

In some embodiments, $R^6$, $R^7$, $R^8$, and $R^9$ are independently optionally substituted $C_1$-$C_{14}$ alkyl, optionally substituted $C_2$-$C_{14}$ alkenyl, or —$(CH_2)_m$-A-$(CH_2)_n$H. In some embodiments, $R^6$, $R^7$, $R^8$, and $R^9$ are independently optionally substituted $C_1$-$C_{14}$ alkyl. In some embodiments, $R^6$, $R^7$, R', and $R^9$ are independently optionally substituted $C_2$-$C_{14}$ alkenyl. In some embodiments, $R^6$, $R^7$, R', and $R^9$ are independently —$(CH_2)_m$-A-$(CH_2)_n$H.

In some embodiments, $R^6$ is optionally substituted $C_1$-$C_{14}$ alkyl, optionally substituted $C_2$-$C_{14}$ alkenyl, or —$(CH_2)_m$-A-$(CH_2)_n$H. In some embodiments, $R^6$ is optionally substituted $C_3$-$C_{10}$ alkyl. In some embodiments, $R^6$ is optionally substituted $C_4$-$C_{10}$ alkyl. In some embodiments, $R^6$ is independently optionally substituted $C_5$-$C_{10}$ alkyl. In some embodiments, $R^6$ is optionally substituted $C_9$-$C_{10}$ alkyl. In some embodiments, $R^6$ is optionally substituted $C_1$-$C_{14}$ alkyl. In some embodiments, $R^6$ is optionally substituted $C_2$-$C_{14}$ alkenyl. In some embodiments, $R^6$ is —$(CH_2)_m$-A-$(CH_2)_n$H.

In some embodiments, $R^7$ is optionally substituted $C_1$-$C_{14}$ alkyl, optionally substituted $C_2$-$C_{14}$ alkenyl, or —$(CH_2)_m$-A-$(CH_2)_n$H. In some embodiments, $R^7$ is optionally substituted $C_3$-$C_{10}$ alkyl. In some embodiments, $R^7$ is optionally substituted $C_4$-$C_{10}$ alkyl. In some embodiments, $R^7$ is optionally substituted $C_5$-$C_{10}$ alkyl. In some embodiments, $R^7$ is optionally substituted $C_9$-$C_{10}$ alkyl. In some embodiments, $R^7$ is optionally substituted $C_1$-$C_{14}$ alkyl. In some embodiments, $R^7$ is optionally substituted optionally substituted $C_2$-$C_{14}$ alkenyl. In some embodiments, $R^7$ is —$(CH_2)_m$-A-$(CH_2)_n$H.

In some embodiments, $R^8$ is optionally substituted $C_1$-$C_{14}$ alkyl, optionally substituted $C_2$-$C_{14}$ alkenyl, or —$(CH_2)_m$-A-$(CH_2)_n$H. In some embodiments, $R^8$ is optionally substituted $C_3$-$C_{10}$ alkyl. In some embodiments, $R^8$ is optionally substituted $C_4$-$C_{10}$ alkyl. In some embodiments, $R^8$ is optionally substituted $C_5$-$C_{10}$ alkyl. In some embodiments, $R^8$ is optionally substituted $C_9$-$C_{10}$ alkyl. In some embodiments, $R^8$ is optionally substituted $C_1$-$C_{14}$ alkyl. In some embodiments, $R^8$ is optionally substituted $C_2$-$C_{14}$ alkenyl. In some embodiments, $R^8$ is —$(CH_2)_m$-A-$(CH_2)_n$H.

In some embodiments, $R^9$ is optionally substituted $C_1$-$C_{14}$ alkyl, optionally substituted $C_2$-$C_{14}$ alkenyl, or —$(CH_2)_m$-A-$(CH_2)_n$H. In some embodiments, $R^9$ is optionally substituted $C_3$-$C_{10}$ alkyl. In some embodiments, $R^9$ is optionally substituted $C_4$-$C_{10}$ alkyl. In some embodiments, $R^9$ is optionally substituted $C_5$-$C_{10}$ alkyl. In some embodiments, $R^9$ is optionally substituted $C_9$-$C_{10}$ alkyl. In some embodiments, $R^9$ is optionally substituted $C_1$-$C_{14}$ alkyl. In some embodiments, $R^9$ is optionally substituted $C_2$-$C_{14}$ alkenyl. In some embodiments, $R^9$ is —$(CH_2)_m$-A-$(CH_2)_n$H.

In some embodiments, each m is independently 0, 1, 2, 3, 4, 5, 6, 7, 8, 9, 10, 11, or 12. In some embodiments, each m is 0. In some embodiments, each m is 1. In some embodiments, each m is 2. In some embodiments, each m is 3. In some embodiments, each m is 4. In some embodiments, each m is 5. In some embodiments, each m is 6. In some embodiments, each m is 7. In some embodiments, each m is 8. In some embodiments, each m is 9. In some embodiments, each m is 10. In some embodiments, each m is 11. In some embodiments, each m is 12.

In some embodiments, each n is independently 0, 1, 2, 3, 4, 5, 6, 7, 8, 9, 10, 11, or 12. In some embodiments, each n is 0. In some embodiments, each n is 1. In some embodiments, each n is 2. In some embodiments, each n is 3. In some embodiments, each n is 4. In some embodiments, each n is 5. In some embodiments, each n is 6. In some embodiments, each n is 7. In some embodiments, each n is 8. In some embodiments, each n is 9. In some embodiments, each n is 10. In some embodiments, each n is 11. In some embodiments, each n is 12.

In some embodiments, each A is independently a $C_3$-$C_8$ cycloalkylenyl. In some embodiments, each A is cyclopropylenyl.

$X^1$

In some embodiments, X1 is optionally substituted C2-C6 alkylenyl. In some embodiments, X1 is optionally substituted C2-C5 alkylenyl. In some embodiments, X1 is optionally substituted C2-C4 alkylenyl. In some embodiments, X1 is optionally substituted C2-C3 alkylenyl. In some embodiments, X1 is optionally substituted C2 alkylenyl. In some embodiments, X1 is optionally substituted C3 alkylenyl. In some embodiments, X1 is optionally substituted C4 alkylenyl. In some embodiments, X1 is optionally substituted C5 alkylenyl. In some embodiments, X1 is optionally substituted C6 alkylenyl. In some embodiments, X1 is optionally substituted —(CH2)2-. In some embodiments, X1 is optionally substituted —(CH2)3-. In some embodiments, X1 is optionally substituted —(CH2)4-. In some embodiments, X1 is optionally substituted —(CH2)5-. In some embodiments, X1 is optionally substituted —$(CH_2)_6$—.

$X^2$

In some embodiments, X2 is selected from the group consisting of a bond, —CH2- and —CH2CH2-. In some embodiments, X2 is a bond. In some embodiments, X2 is —CH2-. In some embodiments, X2 is —CH2CH2-.

$X^{2'}$

In some embodiments, X2' is selected from the group consisting of a bond, —CH2- and —CH2CH2-. In some embodiments, $X^{2'}$ is a bond. In some embodiments, $X^{2'}$ is —$CH_2$—. In some embodiments, $X^{2'}$ is —$CH_2CH_2$—.

$X^3$

In some embodiments, $X^3$ is selected from the group consisting of a bond, —$CH_2$— and —$CH_2CH_2$—. In some embodiments, $X^3$ is a bond. In some embodiments, $X^3$ is —$CH_2$—. In some embodiments, $X^3$ is —$CH_2CH_2$—.

$X^{3'}$

In some embodiments, $X^{3'}$ is selected from the group consisting of a bond, —$CH_2$— and —$CH_2CH_2$—. In some embodiments, $X^{3'}$ is a bond. In some embodiments, $X^{3'}$ is —$CH_2$—. In some embodiments, $X^{3'}$ is —$CH_2CH_2$—.

$X^4$

In some embodiments, $X^4$ is selected from the group consisting of optionally substituted C2-C14 alkylenyl and optionally substituted $C_2$-$C_{14}$ alkenylenyl. In some embodiments, $X^4$ is optionally substituted $C_2$-$C_{14}$ alkylenyl. In some embodiments, $X^4$ is optionally substituted $C_2$-$C_{10}$ alkylenyl. In some embodiments, $X^4$ is optionally substituted $C_2$-$C_8$ alkylenyl. In some embodiments, $X^4$ is optionally substituted $C_2$-$C_6$ alkylenyl. In some embodiments, $X^4$ is optionally substituted $C_3$-$C_6$ alkylenyl. In some embodiments, $X^4$ is optionally substituted $C_3$ alkylenyl. In some embodiments, $X^4$ is optionally substituted $C_4$ alkylenyl. In some embodiments, $X^4$ is optionally substituted $C_5$ alkylenyl. In some embodiments, $X^4$ is optionally substituted $C_6$ alkylenyl. In some embodiments, $X^4$ is optionally substituted —$(CH_2)_2$—. In some embodiments, $X^4$ is optionally substituted —$(CH_2)_3$—. In some embodiments, $X^4$ is optionally substituted —$(CH_2)_4$—. In some embodiments, $X^4$ is optionally substituted —$(CH_2)_5$—. In some embodiments, $X^4$ is optionally substituted —$(CH_2)_6$—.

$X^5$

In some embodiments, $X^5$ is selected from the group consisting of optionally substituted $C_2$-$C_{14}$ alkylenyl and optionally substituted $C_2$-$C_{14}$ alkenylenyl. In some embodiments, $X^5$ is optionally substituted $C_2$-$C_{14}$ alkylenyl. In some embodiments, $X^5$ is optionally substituted $C_2$-$C_{10}$ alkylenyl. In some embodiments, $X^5$ is optionally substituted $C_2$-$C_8$ alkylenyl. In some embodiments, $X^5$ is optionally substituted $C_2$-$C_6$ alkylenyl. In some embodiments, $X^5$ is optionally substituted $C_3$-$C_6$ alkylenyl. In some embodiments, $X^5$ is optionally substituted $C_3$ alkylenyl. In some embodiments, $X^5$ is optionally substituted $C_4$ alkylenyl. In some embodiments, $X^5$ is optionally substituted $C_5$ alkylenyl. In some embodiments, $X^5$ is optionally substituted $C_6$ alkylenyl. In some embodiments, $X^5$ is optionally substituted —$(CH_2)_2$—. In some embodiments, $X^5$ is optionally substituted —$(CH_2)_3$-. In some embodiments, $X^5$ is optionally substituted —$(CH_2)_4$—. In some embodiments, $X^5$ is optionally substituted —$(CH_2)_5$—. In some embodiments, $X^5$ is optionally substituted —$(CH_2)_6$—.

$Y^1$

In some embodiments, $Y^1$ is selected from the group consisting of

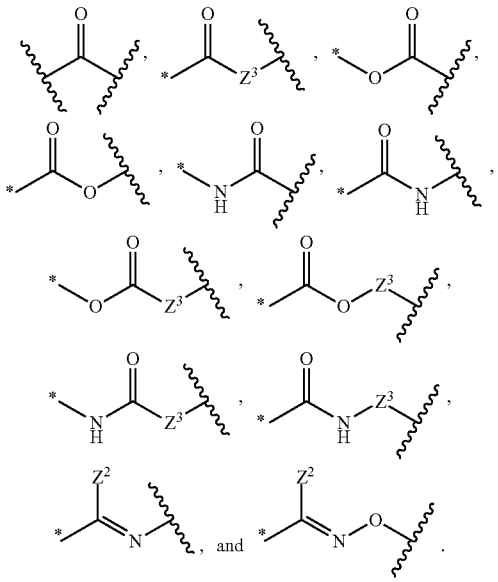

In some embodiments, Y¹ is
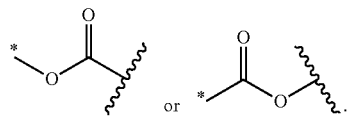
Y²
In some embodiments, Y² is selected from the group consisting of
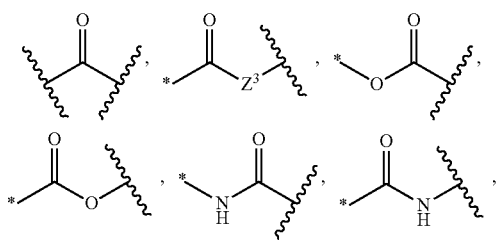
-continued
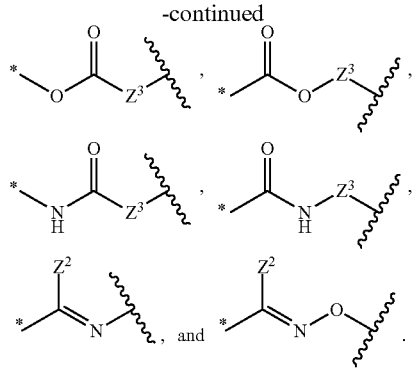
In some embodiments, Y² is
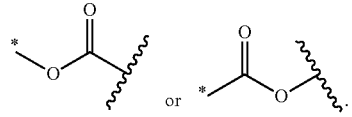
TABLE (II)
Non-Limiting Examples of Ionizable Lipids with a Cyclic Core
| Structure | Compound No. |
|---|---|
| 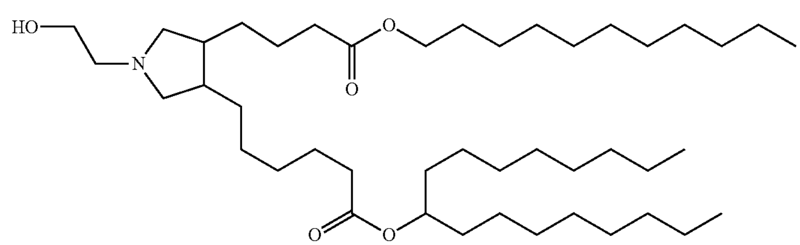 [SMILES: CCCCCCCCCCCOC(=O)CCCC1CN(CCO)CC1CCCCCC(=O)OC(CCCCCCCC)CCCCCCCC] | CY1 |
| 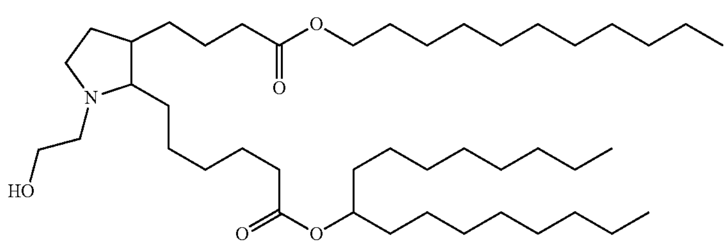 [SMILES: CCCCCCCCCCCOC(=O)CCCC1CCN(CCO)C1CCCCCC(=O)OC(CCCCCCCC)CCCCCCCC] | CY2 |
| 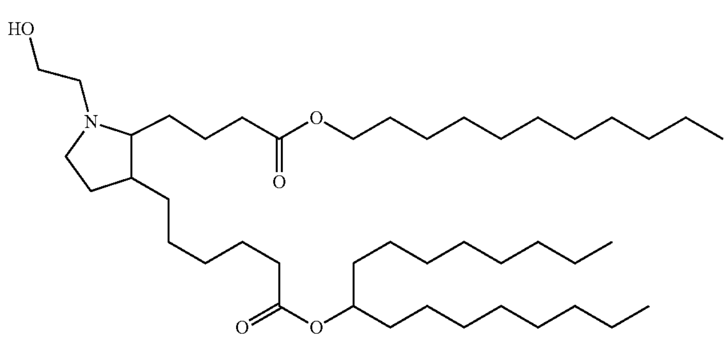 [SMILES: CCCCCCCCCCCOC(=O)CCCC1C(CCCCCC(=O)OC(CCCCCCCC)CCCCCCCC)CCN1CCO] | CY3 |

TABLE (II)-continued

Non-Limiting Examples of Ionizable Lipids with a Cyclic Core

| Structure | Compound No. |
|---|---|
| 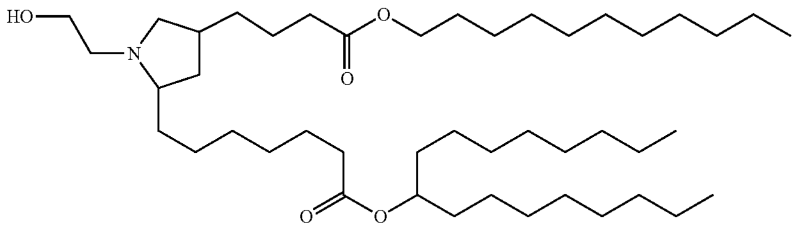 [SMILES: CCCCCCCCCCCOC(=O)CCCC1CC(CCCCCCC(=O)OC(CCCCCCCC)CCCCCCCC)N(CCO)C1] | CY4 |
| 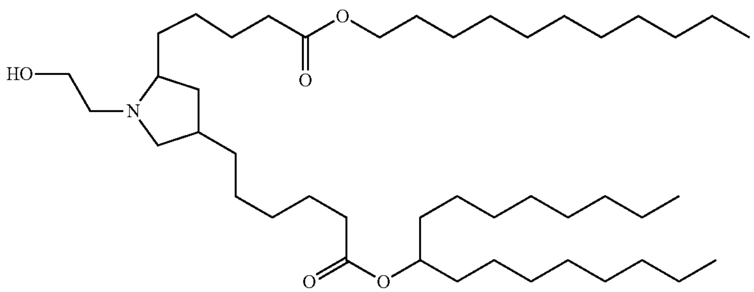 [SMILES: CCCCCCCCCCCOC(=O)CCCCC1CC(CCCCCC(=O)OC(CCCCCCCC)CCCCCCCC)CN1CCO] | CY5 |
| 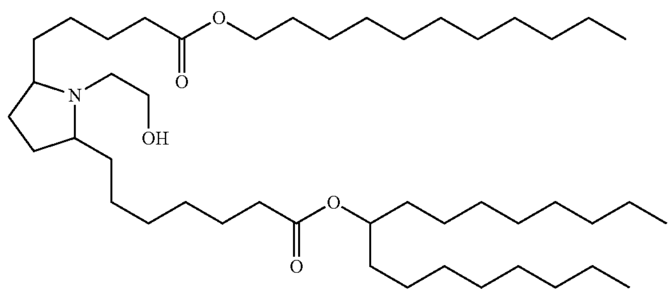 [SMILES: CCCCCCCCCCCOC(=O)CCCCC1CCC(CCCCCCC(=O)OC(CCCCCCCC)CCCCCCCC)N1CCO] | CY6 |
| 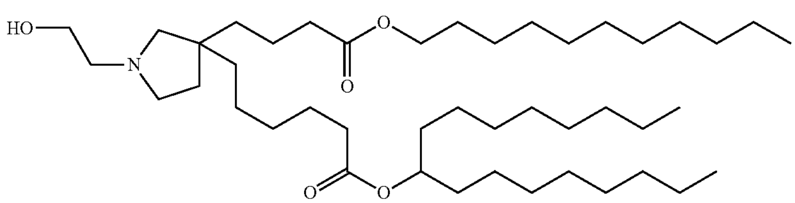 [SMILES: CCCCCCCCCCCOC(=O)CCCC1(CCCCCC(=O)OC(CCCCCCCC)CCCCCCCC)CCN(CCO)C1] | CY7 |
| 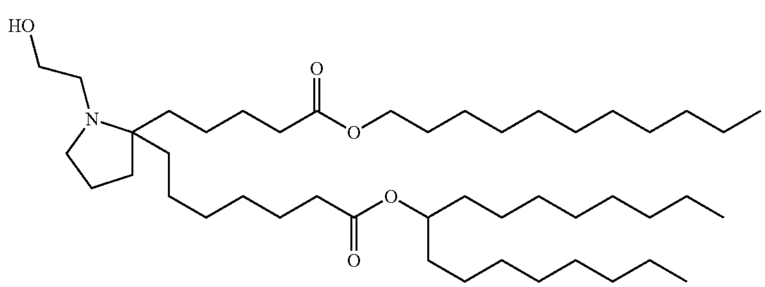 [SMILES: CCCCCCCCCCCOC(=O)CCCCC1(CCCCCCC(=O)OC(CCCCCCCC)CCCCCCCC)CCCN1CCO] | CY8 |
| 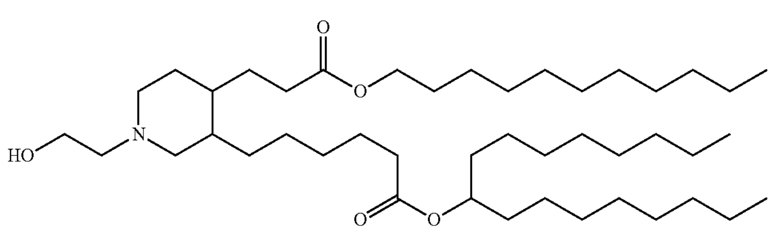 [SMILES: CCCCCCCCCCCOC(=O)CCC1CCN(CCO)CC1CCCCCC(=O)OC(CCCCCCCC)CCCCCCCC] | CY9 |

TABLE (II)-continued

Non-Limiting Examples of Ionizable Lipids with a Cyclic Core

| Structure | Compound No. |
|---|---|
| 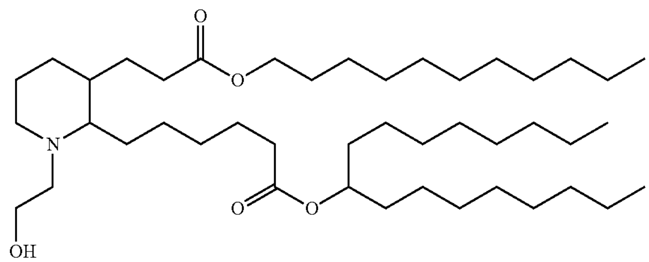 [SMILES: CCCCCCCCCCCOC(=O)CCC1CCCN(CCO)C1CCCCCC(=O)OC(CCCCCCCC)CCCCCCCC] | CY10 |
| 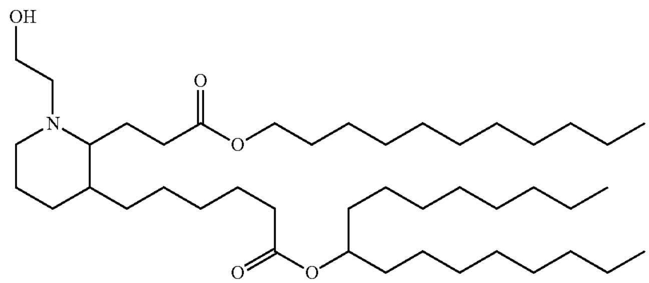 [SMILES: CCCCCCCCCCCOC(=O)CCC1C(CCCCCC(=O)OC(CCCCCCCC)CCCCCCCC)CCCN1CCO] | CY11 |
| 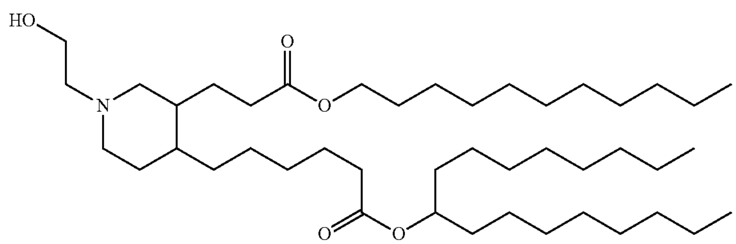 [SMILES: CCCCCCCCCCCOC(=O)CCC1CN(CCO)CCC1CCCCCC(=O)OC(CCCCCCCC)CCCCCCCC] | CY12 |
| 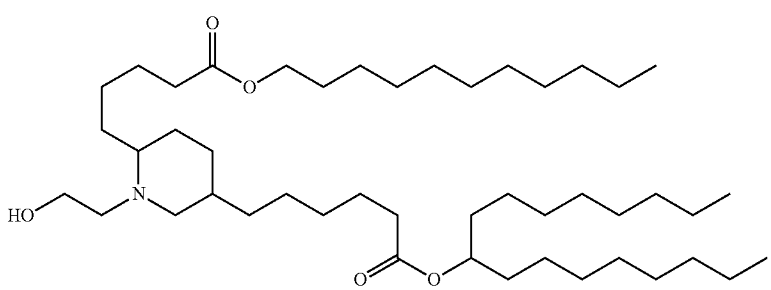 [SMILES: CCCCCCCCCCCOC(=O)CCCCC1CCC(CCCCCC(=O)OC(CCCCCCCC)CCCCCCCC)CN1CCO] | CY13 |
| 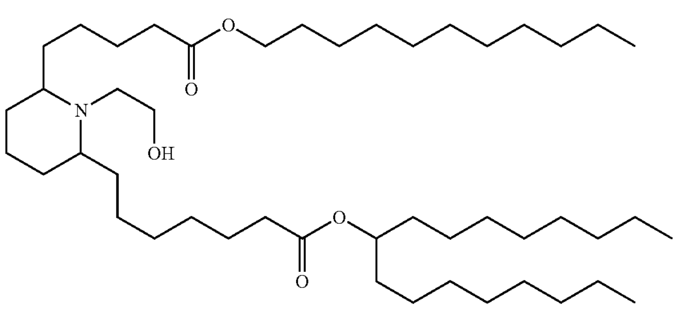 [SMILES: CCCCCCCCCCCOC(=O)CCCCC1CCCC(CCCCCCC(=O)OC(CCCCCCCC)CCCCCCCC)N1CCO] | CY14 |

TABLE (II)-continued

Non-Limiting Examples of Ionizable Lipids with a Cyclic Core

| Structure | Compound No. |
|---|---|
| 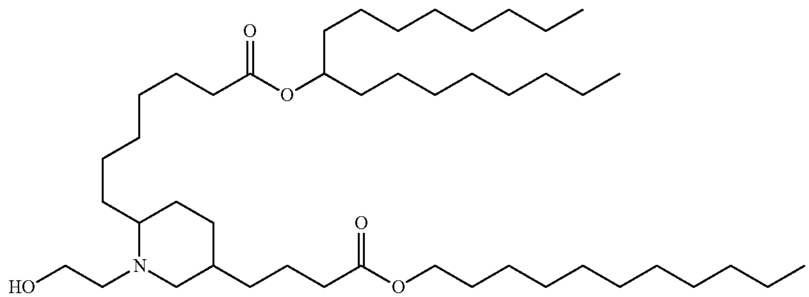 [SMILES: CCCCCCCCCCCOC(=O)CCCC1CCC(CCCCCCC(=O)OC(CCCCCCCC)CCCCCCCC)N(CCO)C1] | CY15 |
| 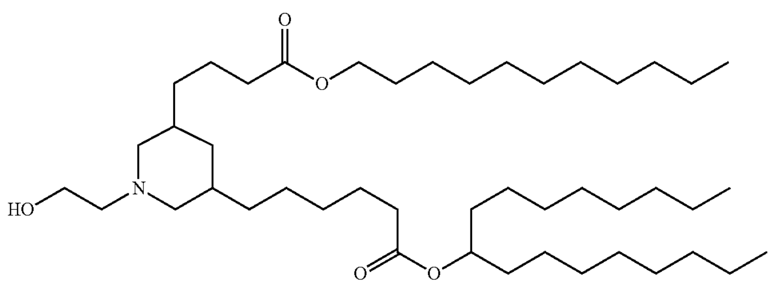 [SMILES: CCCCCCCCCCCOC(=O)CCCC1CC(CCCCCC(=O)OC(CCCCCCCC)CCCCCCCC)CN(CCO)C1] | CY16 |
| 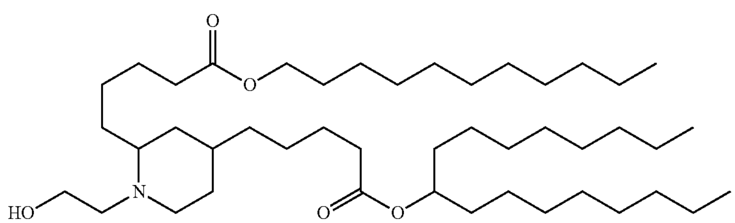 [SMILES: CCCCCCCCCCCOC(=O)CCCCC1CC(CCCCC(=O)OC(CCCCCCCC)CCCCCCCC)CCN1CCO] | CY18 |
| 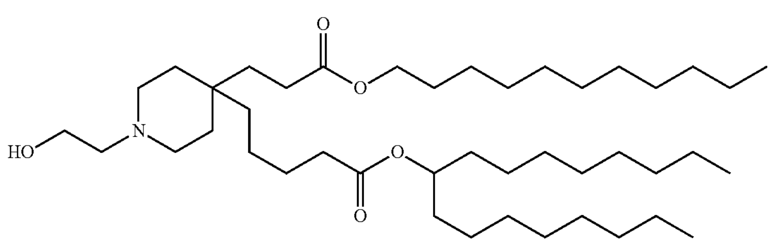 [SMILES: CCCCCCCCCCCOC(=O)CCC1(CCCCC(=O)OC(CCCCCCCC)CCCCCCCC)CCN(CCO)CC1] | CY19 |
| 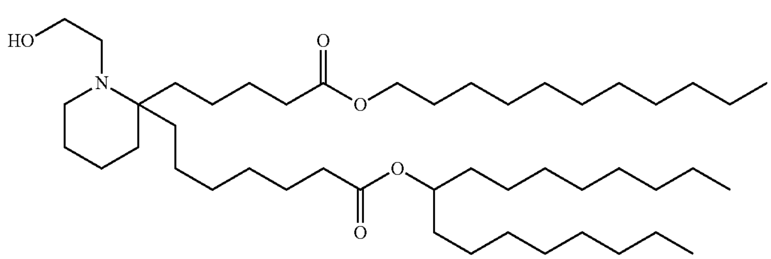 [SMILES: CCCCCCCCCCCOC(=O)CCCCC1(CCCCCCC(=O)OC(CCCCCCCC)CCCCCCCC)CCCCN1CCO] | CY20 |
| 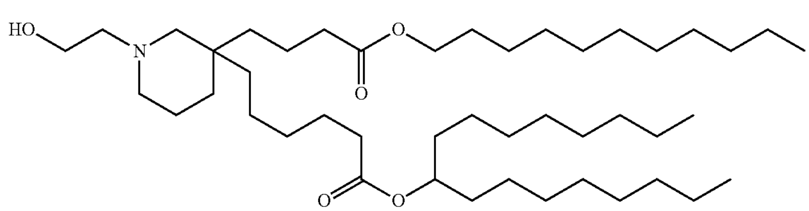 [SMILES: CCCCCCCCCCCOC(=O)CCCC1(CCCCCC(=O)OC(CCCCCCCC)CCCCCCCC)CCCN(CCO)C1] | CY21 |

TABLE (II)-continued

Non-Limiting Examples of Ionizable Lipids with a Cyclic Core

| Structure | Compound No. |
|---|---|
| 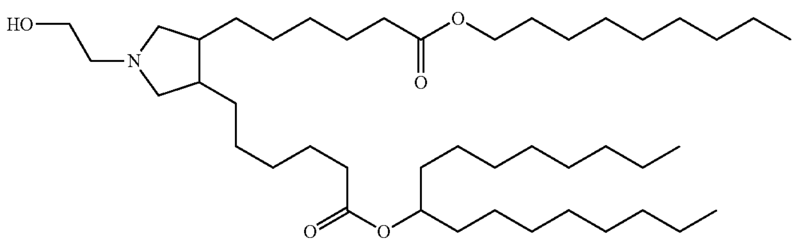 [SMILES: CCCCCCCCCOC(=O)CCCCCC1CN(CCO)CC1CCCCCC(=O)OC(CCCCCCCC)CCCCCCCC] | CY22 |
| 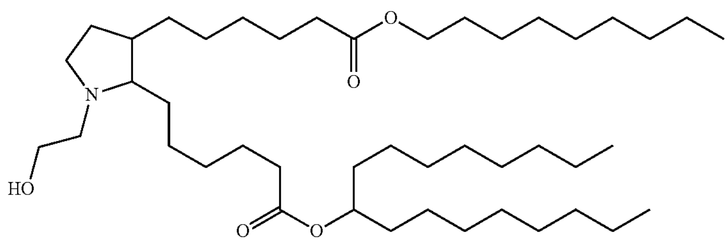 [SMILES: CCCCCCCCCOC(=O)CCCCCC1CCN(CCO)C1CCCCCC(=O)OC(CCCCCCCC)CCCCCCCC] | CY23 |
| 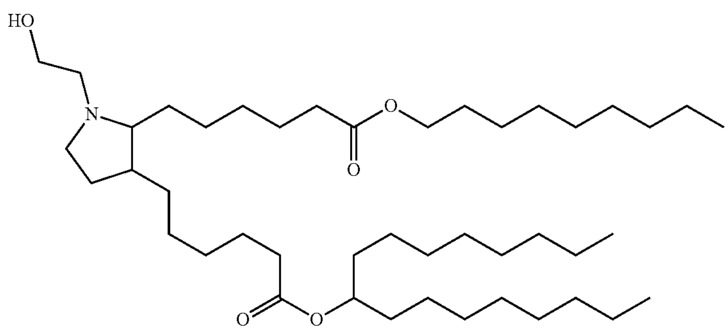 [SMILES: CCCCCCCCCOC(=O)CCCCCC1C(CCCCCC(=O)OC(CCCCCCCC)CCCCCCCC)CCN1CCO] | CY24 |
| 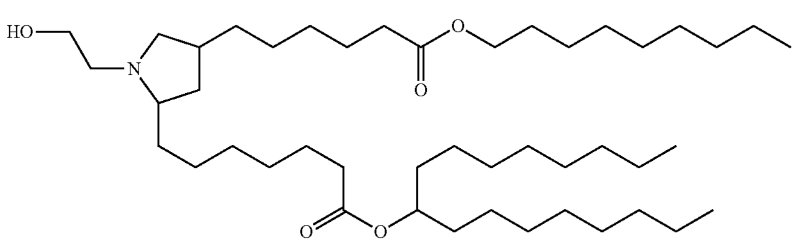 [SMILES: CCCCCCCCCOC(=O)CCCCCC1CC(CCCCCCC(=O)OC(CCCCCCCC)CCCCCCCC)N(CCO)C1] | CY25 |
| 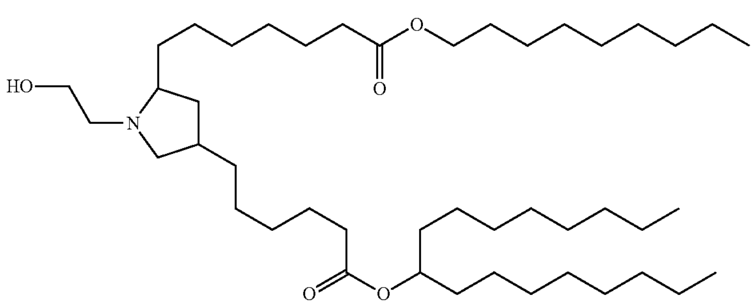 [SMILES: CCCCCCCCCOC(=O)CCCCCCC1CC(CCCCCC(=O)OC(CCCCCCCC)CCCCCCCC)CN1CCO] | CY26 |

TABLE (II)-continued

Non-Limiting Examples of Ionizable Lipids with a Cyclic Core

| Structure | Compound No. |
|---|---|
| 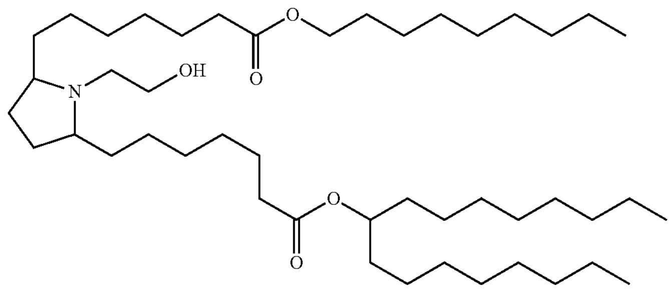 [SMILES: CCCCCCCCCOC(=O)CCCCCCC1CCC(CCCCCCC(=O)OC(CCCCCCCC)CCCCCCCC)N1CCO] | CY27 |
| 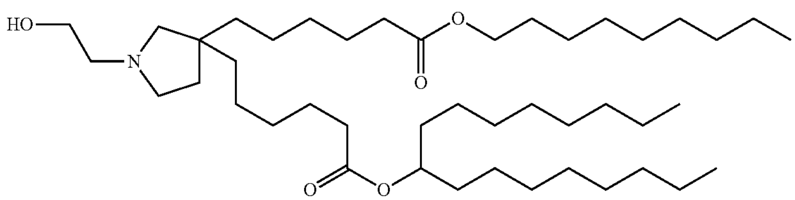 [SMILES: CCCCCCCCCOC(=O)CCCCCC1(CCCCCC(=O)OC(CCCCCCCC)CCCCCCCC)CCN(CCO)C1] | CY28 |
| 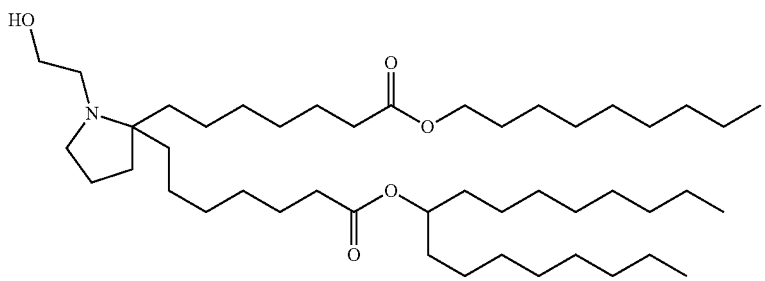 [SMILES: CCCCCCCCCOC(=O)CCCCCCC1(CCCCCCC(=O)OC(CCCCCCCC)CCCCCCCC)CCCN1CCO] | CY29 |
| 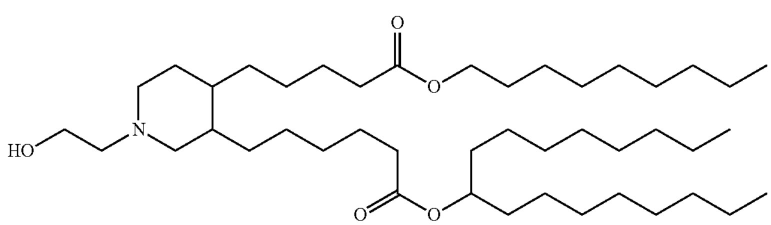 [SMILES: CCCCCCCCCOC(=O)CCCCC1CCN(CCO)CC1CCCCCC(=O)OC(CCCCCCCC)CCCCCCCC] | CY30 |
| 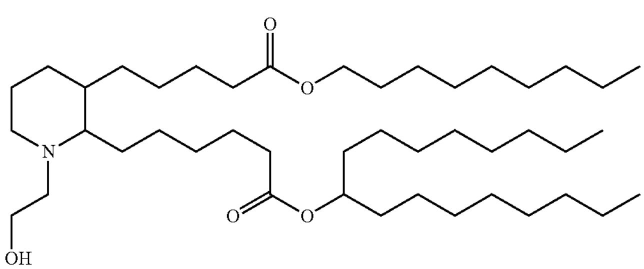 [SMILES: CCCCCCCCCOC(=O)CCCCC1CCCN(CCO)C1CCCCCC(=O)OC(CCCCCCCC)CCCCCCCC] | CY31 |
| 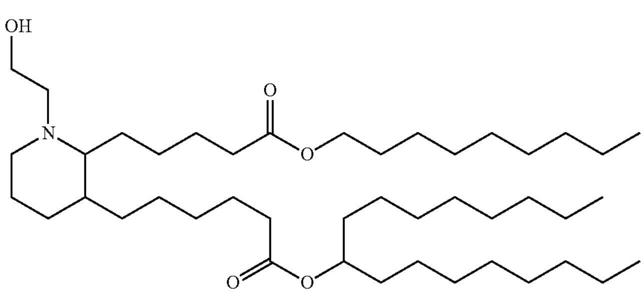 [SMILES: CCCCCCCCCOC(=O)CCCCC1C(CCCCCC(=O)OC(CCCCCCCC)CCCCCCCC)CCCN1CCO] | CY32 |

TABLE (II)-continued

Non-Limiting Examples of Ionizable Lipids with a Cyclic Core

| Structure | Compound No. |
|---|---|
| 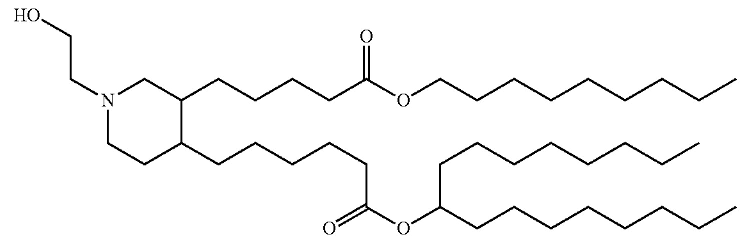 [SMILES: CCCCCCCCCOC(=O)CCCCC1CN(CCO)CCC1CCCCCC(=O)OC(CCCCCCCC)CCCCCCCC] | CY33 |
| 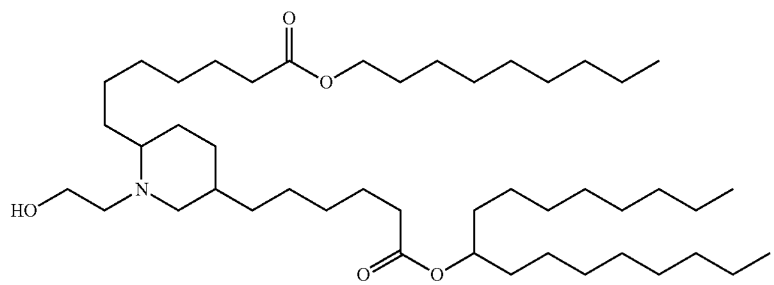 [SMILES: CCCCCCCCCOC(=O)CCCCCCC1CCC(CCCCCC(=O)OC(CCCCCCCC)CCCCCCCC)CN1CCO] | CY34 |
| 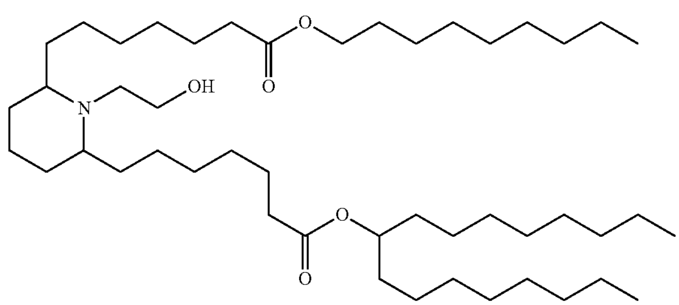 [SMILES: CCCCCCCCCOC(=O)CCCCCCC1CCCC(CCCCCCC(=O)OC(CCCCCCCC)CCCCCCCC)N1CCO] | CY35 |
| 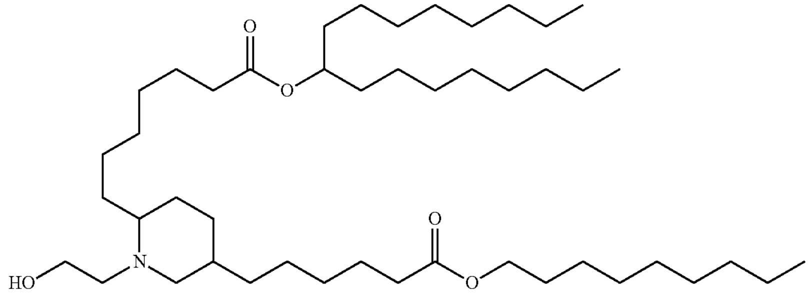 [SMILES: CCCCCCCCCOC(=O)CCCCCC1CCC(CCCCCCC(=O)OC(CCCCCCCC)CCCCCCCC)N(CCO)C1] | CY36 |
| 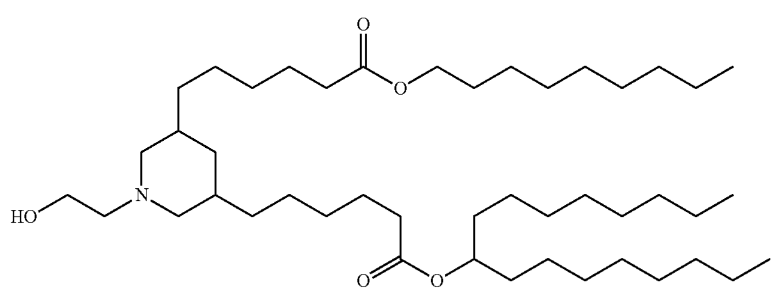 [SMILES: CCCCCCCCCOC(=O)CCCCCC1CC(CCCCCC(=O)OC(CCCCCCCC)CCCCCCCC)CN(CCO)C1] | CY37 |

TABLE (II)-continued

Non-Limiting Examples of Ionizable Lipids with a Cyclic Core

| Structure | Compound No. |
|---|---|
| 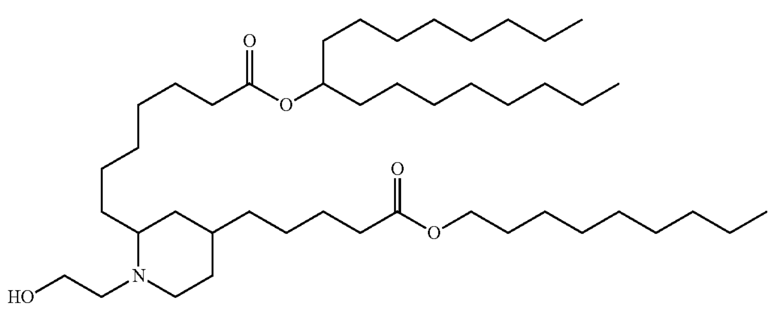 [SMILES: CCCCCCCCCOC(=O)CCCCC1CCN(CCO)C(CCCCCCC(=O)OC(CCCCCCCC)CCCCCCCC)C1] | CY38 |
| 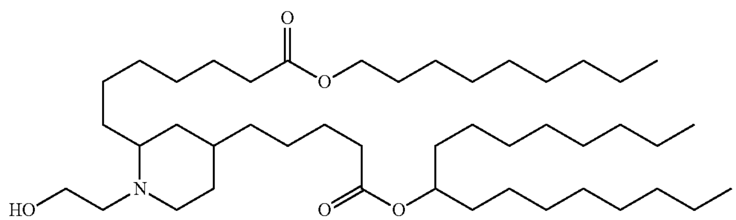 [SMILES: CCCCCCCCCOC(=O)CCCCCCC1CC(CCCCC(=O)OC(CCCCCCCC)CCCCCCCC)CCN1CCO] | CY39 |
| 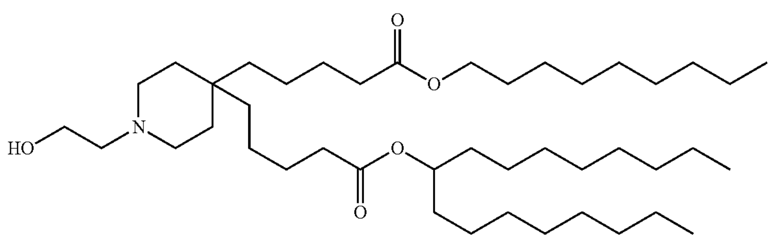 [SMILES: CCCCCCCCCOC(=O)CCCCC1(CCCCC(=O)OC(CCCCCCCC)CCCCCCCC)CCN(CCO)CC1] | CY40 |
| 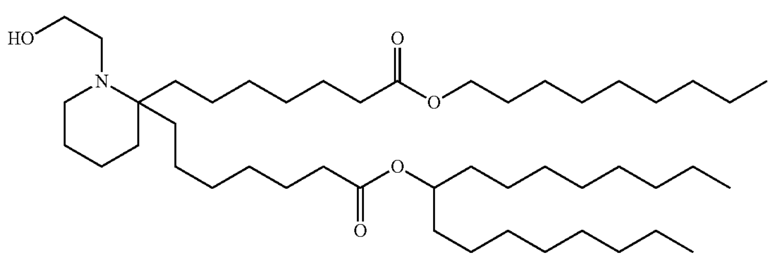 [SMILES: CCCCCCCCCOC(=O)CCCCCCC1(CCCCCCC(=O)OC(CCCCCCCC)CCCCCCCC)CCCCN1CCO] | CY41 |
| 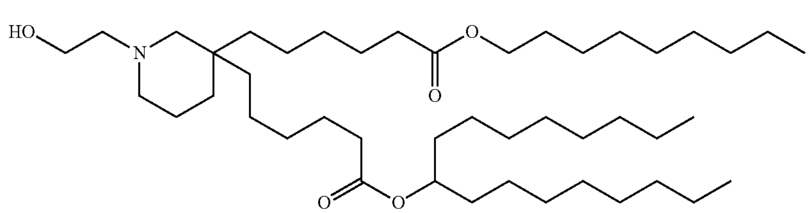 [SMILES: CCCCCCCCCOC(=O)CCCCCC1(CCCCCC(=O)OC(CCCCCCCC)CCCCCCCC)CCCN(CCO)C1] | CY42 |

TABLE (II)-continued

Non-Limiting Examples of Ionizable Lipids with a Cyclic Core

| Structure | Compound No. |
|---|---|
| 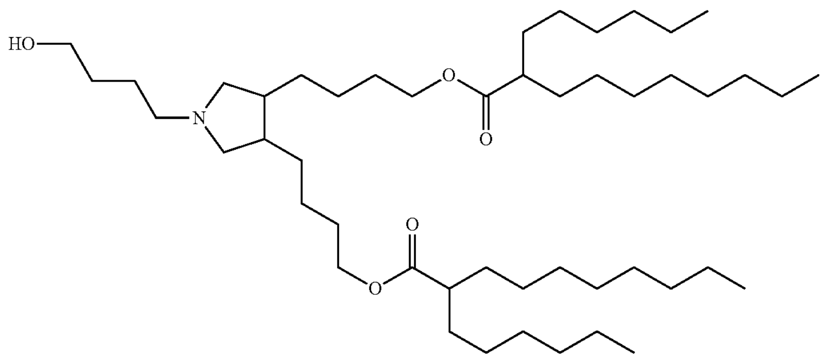 [SMILES: CCCCCCCCC(CCCCCC)C(=O)OCCCCC1CN(CCCCO)CC1CCCCOC(=O)C(CCCCCC)CCCCCCCC] | CY43 |
| 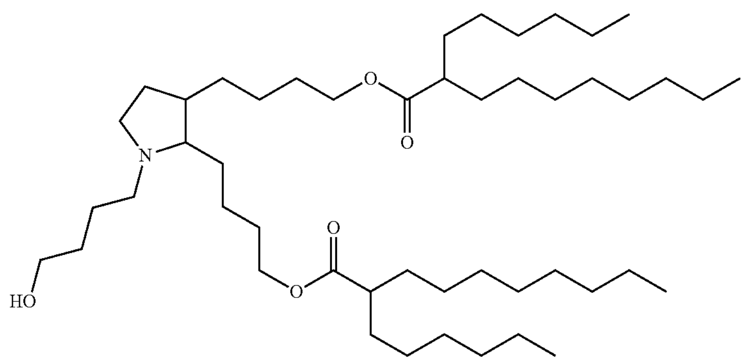 [SMILES: CCCCCCCCC(CCCCCC)C(=O)OCCCCC1CCN(CCCCO)C1CCCCOC(=O)C(CCCCCC)CCCCCCCC] | CY44 |
| 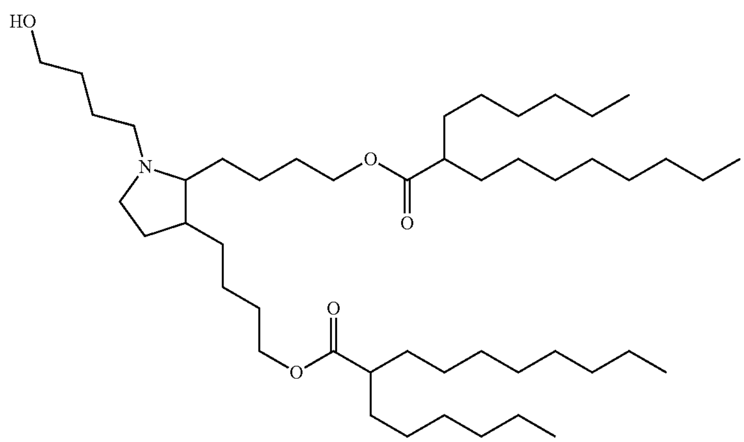 [SMILES: CCCCCCCCC(CCCCCC)C(=O)OCCCCC1CCN(CCCCO)C1CCCCOC(=O)C(CCCCCC)CCCCCCCC] | CY45 |
| 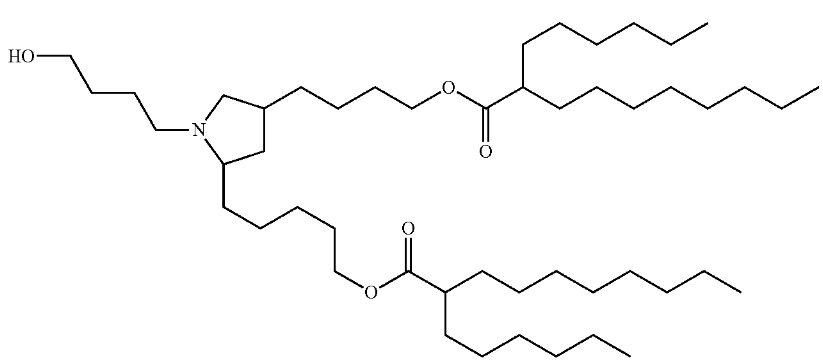 [SMILES: CCCCCCCCC(CCCCCC)C(=O)OCCCCCC1CC(CCCCOC(=O)C(CCCCCC)CCCCCCCC)CN1CCCCO] | CY46 |

TABLE (II)-continued

Non-Limiting Examples of Ionizable Lipids with a Cyclic Core

| Structure | Compound No. |
|---|---|
| 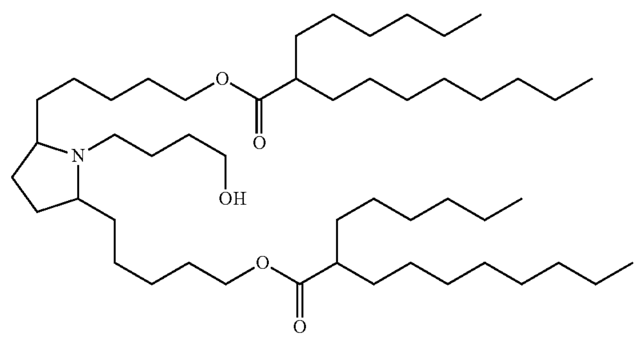 [SMILES: CCCCCCCCC(CCCCCC)C(=O)OCCCCCC1CCC(CCCCCOC(=O)C(CCCCCC)CCCCCCCC)N1CCCCO] | CY47 |
| 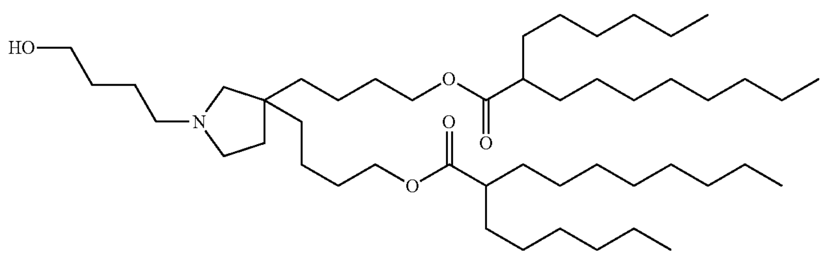 [SMILES: CCCCCCCCC(CCCCCC)C(=O)OCCCCC1(CCCCOC(=O)C(CCCCCC)CCCCCCCC)CCN(CCCCO)C1] | CY48 |
| 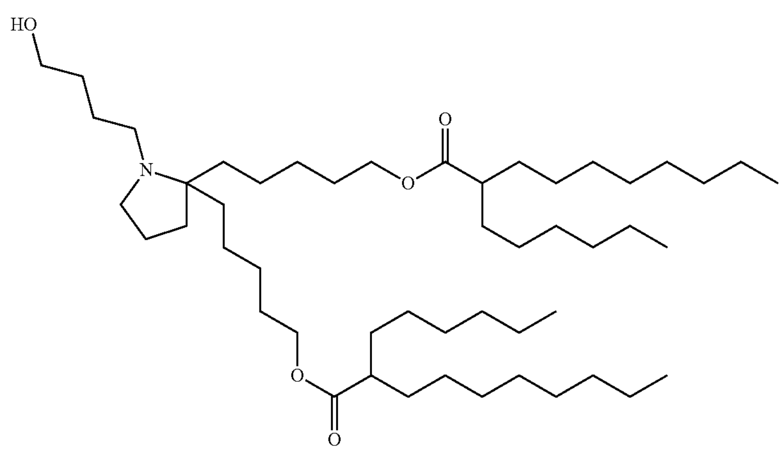 [SMILES: CCCCCCCCC(CCCCCC)C(=O)OCCCCCC1(CCCCCOC(=O)C(CCCCCC)CCCCCCCC)CCCN1CCCCO] | CY49 |
| 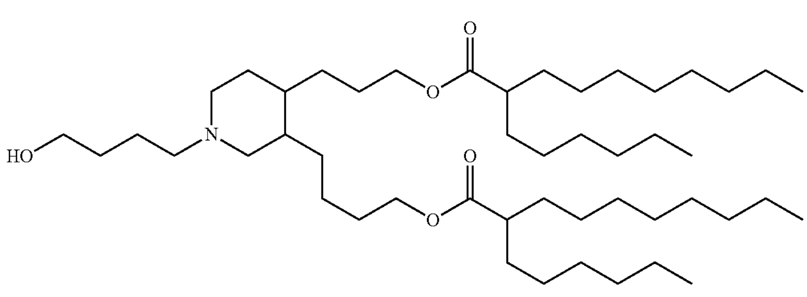 [SMILES: CCCCCCCCC(CCCCCC)C(=O)OCCCCC1CN(CCCCO)CCC1CCCOC(=O)C(CCCCCC)CCCCCCCC] | CY50 |

TABLE (II)-continued

Non-Limiting Examples of Ionizable Lipids with a Cyclic Core

| Structure | Compound No. |
|---|---|
| 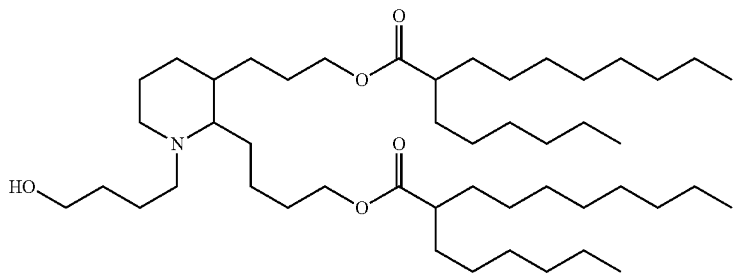 [SMILES: CCCCCCCCC(CCCCCC)C(=O)OCCCCC1C(CCCOC(=O)C(CCCCCC)CCCCCCCC)CCCN1CCCCO] | CY51 |
| 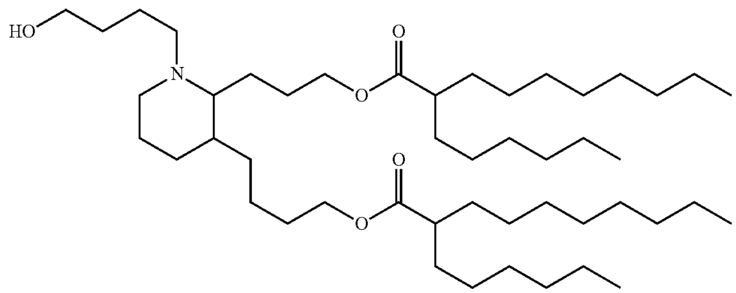 [SMILES: CCCCCCCCC(CCCCCC)C(=O)OCCCCC1CCCN(CCCCO)C1CCCOC(=O)C(CCCCCC)CCCCCCCC] | CY52 |
| 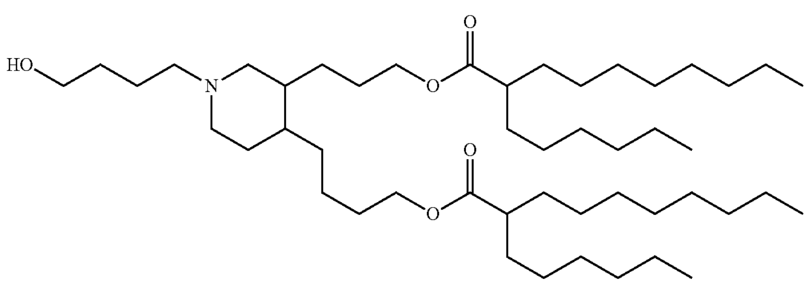 [SMILES: CCCCCCCCC(CCCCCC)C(=O)OCCCCC1CCN(CCCCO)CC1CCCOC(=O)C(CCCCCC)CCCCCCCC] | CY53 |
| 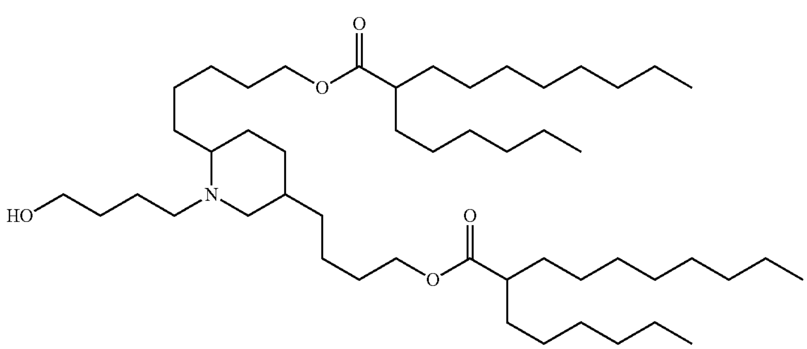 [SMILES: CCCCCCCCC(CCCCCC)C(=O)OCCCCCC1CCC(CCCCOC(=O)C(CCCCCC)CCCCCCCC)CN1CCCCO] | CY54 |
| 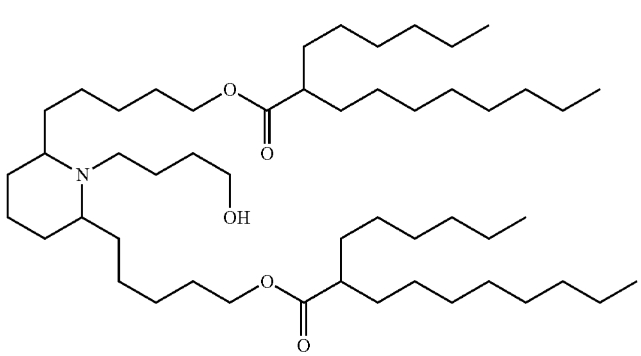 [SMILES: CCCCCCCCC(CCCCCC)C(=O)OCCCCCC1CCCC(CCCCCOC(=O)C(CCCCCC)CCCCCCCC)N1CCCCO] | CY55 |

TABLE (II)-continued

Non-Limiting Examples of Ionizable Lipids with a Cyclic Core

| Structure | Compound No. |
|---|---|
| 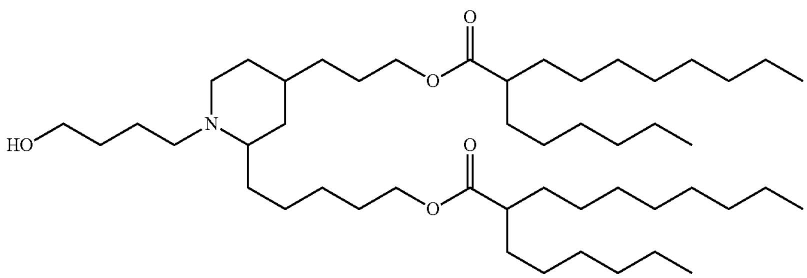 [SMILES: CCCCCCCCC(CCCCCC)C(=O)OCCCCCC1CC(CCCOC(=O)C(CCCCCC)CCCCCCCC)CCN1CCCCO] | CY56 |
| 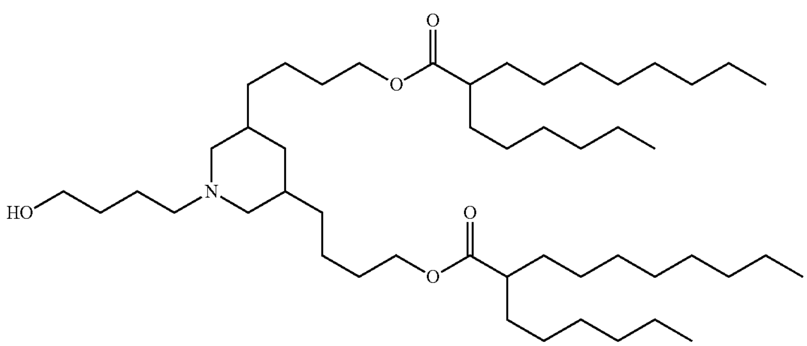 [SMILES: CCCCCCCCC(CCCCCC)C(=O)OCCCCC1CC(CCCCOC(=O)C(CCCCCC)CCCCCCCC)CN(CCCCO)C1] | CY57 |
| 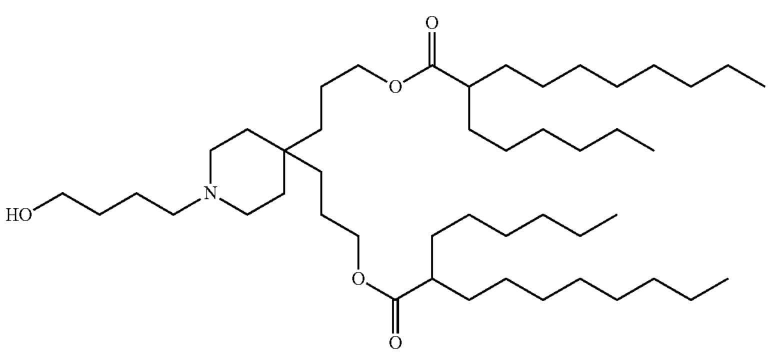 [SMILES: CCCCCCCCC(CCCCCC)C(=O)OCCCC1(CCCOC(=O)C(CCCCCC)CCCCCCCC)CCN(CCCCO)CC1] | CY58 |
| 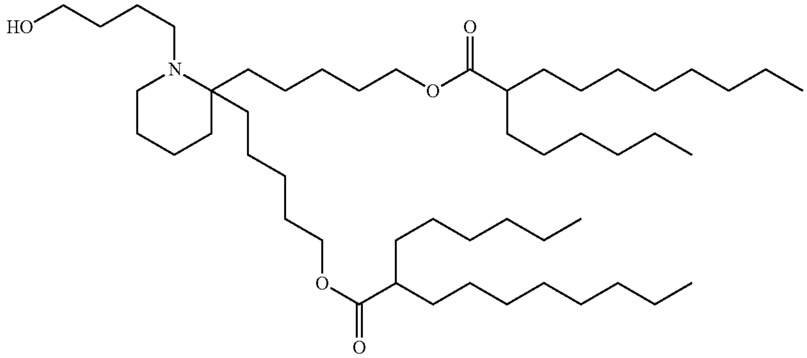 [SMILES: CCCCCCCCC(CCCCCC)C(=O)OCCCCCC1(CCCCCOC(=O)C(CCCCCC)CCCCCCCC)CCCCN1CCCCO] | CY59 |

TABLE (II)-continued
Non-Limiting Examples of Ionizable Lipids with a Cyclic Core
| Structure | Compound No. |
|---|---|
| 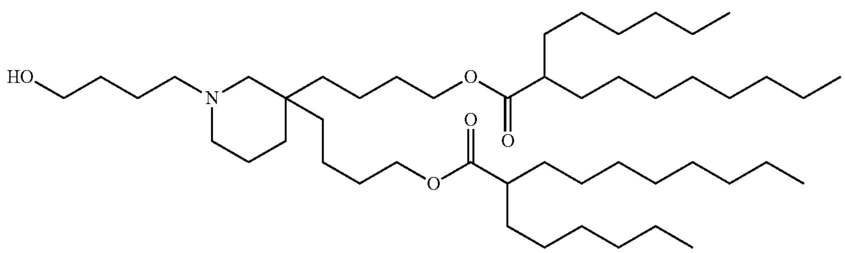 [SMILES: CCCCCCCCC(CCCCCC)C(=O)OCCCCC1(CCCCOC(=O)C(CCCCCC)CCCCCCCC)CCCN(CCCCO)C1] | CY60 |
| 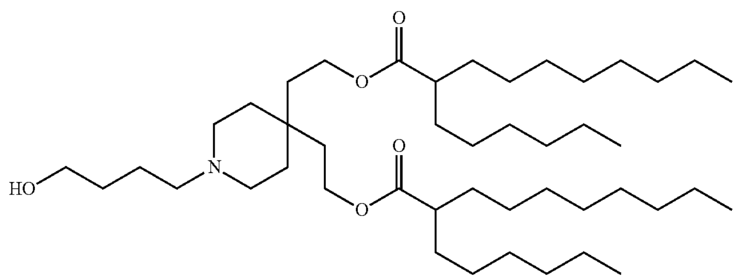 [SMILES: CCCCCCCCC(CCCCCC)C(=O)OCCC1(CCOC(=O)C(CCCCCC)CCCCCCCC)CCN(CCCCO)CC1] | CY61 |
| 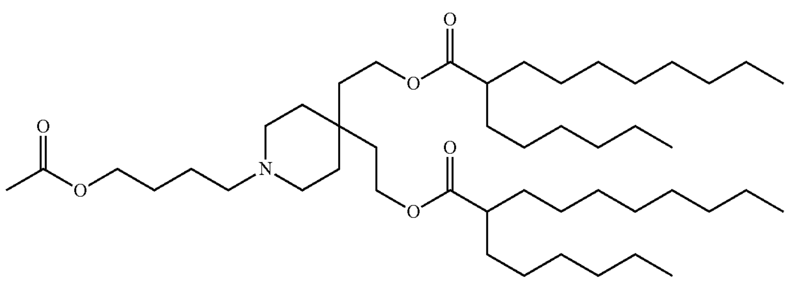 [SMILES: CCCCCCCCC(CCCCCC)C(=O)OCCC1(CCOC(=O)C(CCCCCC)CCCCCCCC)CCN(CCCCOC(C)=O)CC1] | CY62 |
| 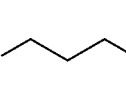 | CY63 |
| 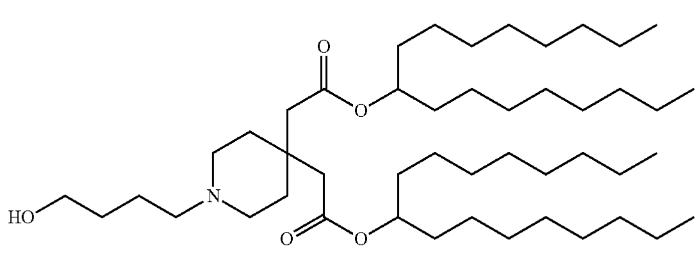 [SMILES: CCCCCCCCC(CCCCCCCC)OC(=O)CC1(CC(=O)OC(CCCCCCCC)CCCCCCCC)CCN(CCCCO)CC1] | CY64 |

TABLE (II)-continued

Non-Limiting Examples of Ionizable Lipids with a Cyclic Core

| Structure | Compound No. |
|---|---|
| 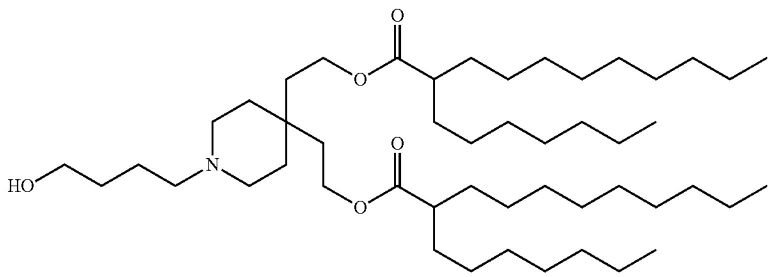 [SMILES: CCCCCCCCCC(CCCCCCC)C(=O)OCCC1(CCOC(=O)C(CCCCCCC)CCCCCCCCC)CCN(CCCCO)CC1] | CY65 |
| 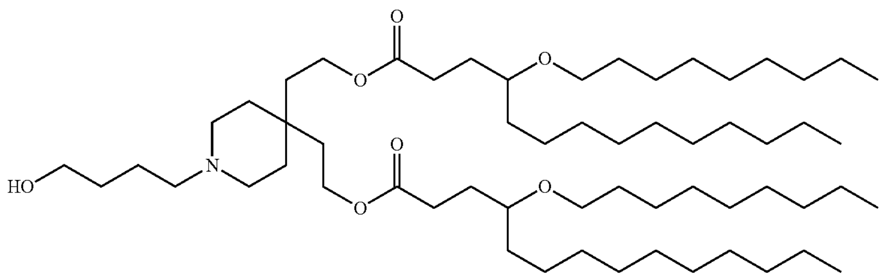 [SMILES: CCCCCCCCCCC(CCC(=O)OCCC1(CCOC(=O)CCC(CCCCCCCCCC)OCCCCCCCCC)CCN(CCCCO)CC1)OCCCCCCCCC] | CY66 |
| 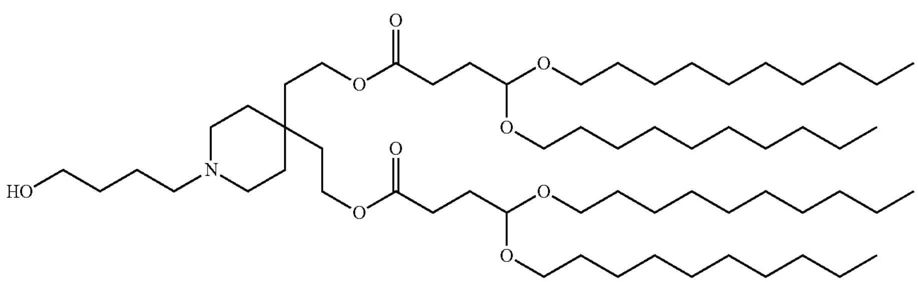 [SMILES: CCCCCCCCCCOC(CCC(=O)OCCC1(CCOC(=O)CCC(OCCCCCCCCCC)OCCCCCCCCCC)CCN(CCCCO)CC1)OCCCCCCCCCC] | CY67 |
| 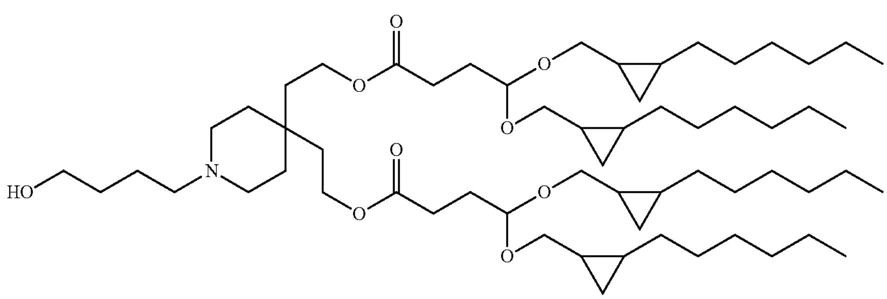 [SMILES: CCCCCCC1CC1COC(CCC(=O)OCCC1(CCOC(=O)CCC(OCC2CC2CCCCCC)OCC2CC2CCCCCC)CCN(CCCCO)CC1)OCC1CC1CCCCCC] | CY68 |
| 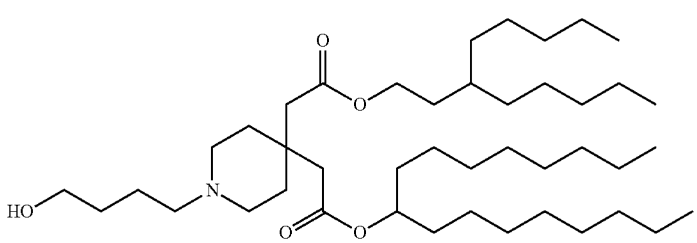 [SMILES: CCCCCCCCC(CCCCCCCC)OC(=O)CC1(CC(=O)OCCC(CCCCC)CCCCC)CCN(CCCCO)CC1] | CY69 |

TABLE (II)-continued

Non-Limiting Examples of Ionizable Lipids with a Cyclic Core

| Structure | Compound No. |
|---|---|
| 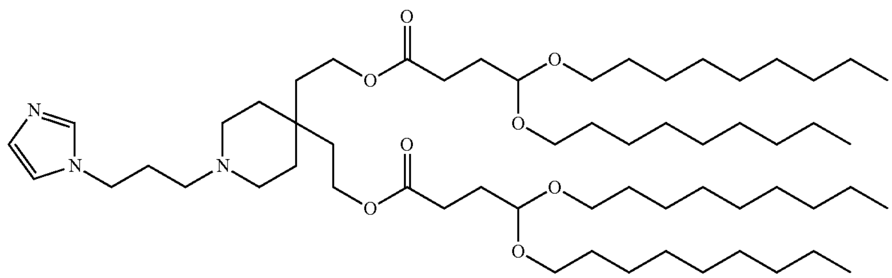 [SMILES: CCCCCCCCCOC(CCC(=O)OCCC1(CCOC(=O)CCC(OCCCCCCCCC)OCCCCCCCCC)CCN(CCCn2ccnc2)CC1)OCCCCCCCCC] | CY70 |
| 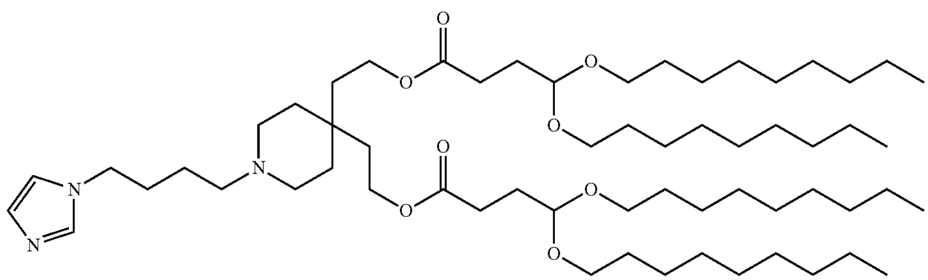 [SMILES: CCCCCCCCCOC(CCC(=O)OCCC1(CCOC(=O)CCC(OCCCCCCCCC)OCCCCCCCCC)CCN(CCCCn2ccnc2)CC1)OCCCCCCCCC] | CY71 |

In some embodiments, an LNP of the present disclosure comprises an ionizable lipid disclosed in PCT Application PCT/US2022/082276, which is incorporated by reference herein, in its entirety.

In one embodiment, the disclosure provides a compound of Formula IA:

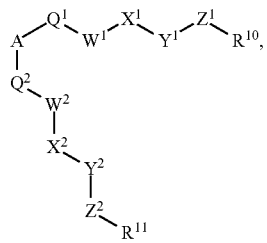

IA or a pharmaceutically acceptable salt or solvate thereof, wherein:

A is selected from the group consisting of —N($R^{1a}$)— and —C(R')—OC(=O)($R^{8a}$)—;

$R^{1a}$ is -$L^1$-$R^1$;

$L^1$ is $C_2$-$C_6$ alkylenyl or —(CH$_2$)$_{2-6}$—OC(=O)—;

$R^1$ is selected from the group consisting of —OH,

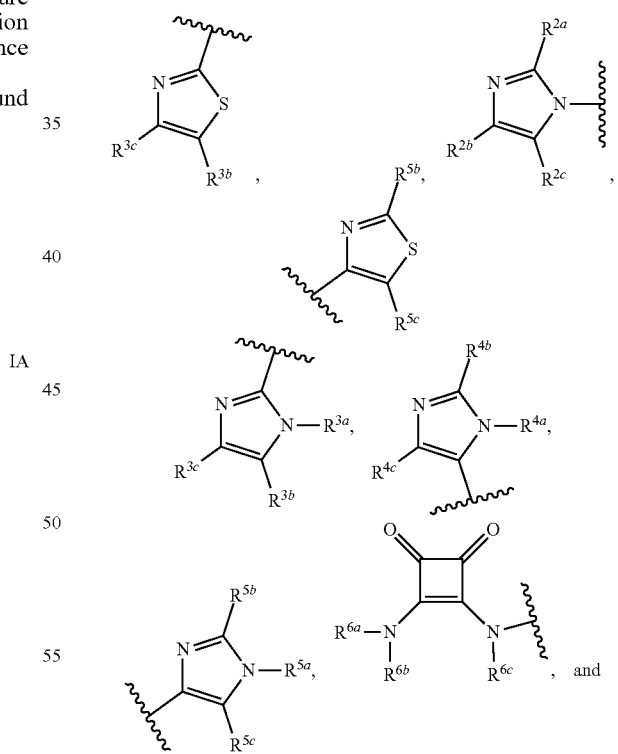

$R^{2a}$, $R^{2b}$, and $R^{2c}$ are independently selected from the group consisting of hydrogen and $C_1$-$C_6$ alkyl;

$R^{3a}$, $R^{3b}$, and $R^{3c}$ are independently selected from the group consisting of hydrogen and $C_1$-$C_6$ alkyl;

$R^{4a}$, $R^{4b}$, and $R^{4c}$ are independently selected from the group consisting of hydrogen and $C_1$-$C_6$ alkyl;

$R^{5a}$, $R^{5b}$, and $R^{5c}$ are independently selected from the group consisting of hydrogen and $C_1$-$C_6$ alkyl;

$R^{6a}$, $R^{6b}$, and $R^{6c}$ are independently selected from the group consisting of hydrogen and $C_1$-$C_6$ alkyl; or $R^{6a}$ and $R^{6b}$ taken together with the nitrogen atom to which they are attached form a 4- to 8-membered heterocyclo; and $R^{6c}$ is selected from the group consisting of hydrogen and $C_1$-$C_6$ alkyl;

$R^{7a}$, $R^{7b}$, and $R^{7c}$ are independently selected from the group consisting of hydrogen and $C_1$-$C_6$ alkyl; or $R^{7a}$ and $R^{7b}$ taken together with the nitrogen atom to which they are attached form a 4- to 8-membered heterocyclo; and $R^{7c}$ is selected from the group consisting of hydrogen and $C_1$-$C_6$ alkyl;

R' is selected from the group consisting of hydrogen and $C_1$-$C_6$ alkyl;

$R^{8a}$ is -$L^2$-$R^8$;

$L^2$ is $C_2$-$C_6$ alkylenyl;

$R^8$ is selected from the group consisting of —$NR^{9a}R^{9b}$,

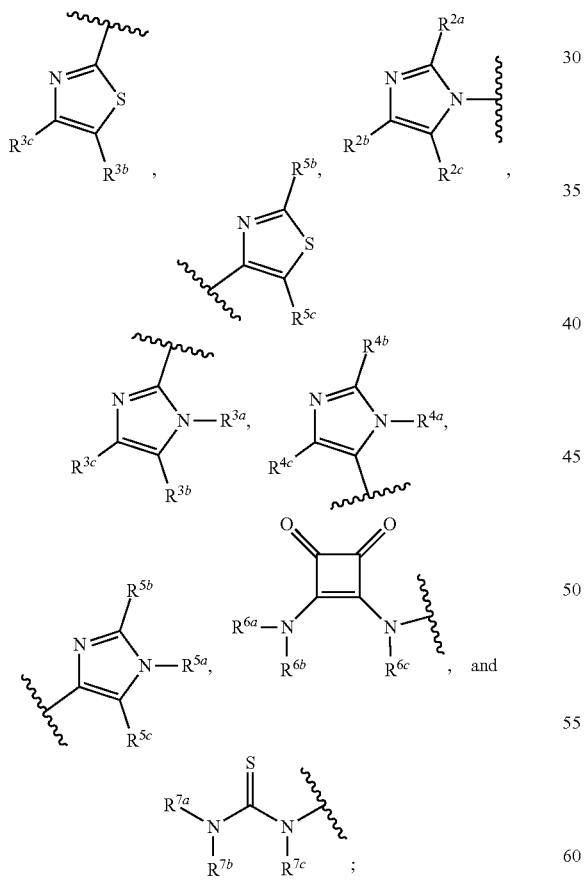

$R^{9a}$ and $R^{9b}$ are independently selected from the group consisting of hydrogen and $C_1$-$C_6$ alkyl; or $R^{9a}$ and $R^{9b}$ taken together with the nitrogen atom to which they are attached form a 4- to 8-membered heterocyclo;

$Q^1$ is $C_1$-$C_{20}$ alkylenyl;

$W^1$ is selected from the group consisting of —C(=O)O—, —OC(=O)—, —C(=O)N($R^{12a}$)—, —N($R^{12a}$)C(=O)—, —OC(=O)N($R^{12a}$)—, —N($R^{12a}$)C(=O)O—, and —OC(=O)O—;

$R^{12a}$ is selected from the group consisting of hydrogen and $C_1$-$C_6$ alkyl;

$X^1$ is optionally substituted $C_1$-$C_{15}$ alkylenyl; or $X^1$ is a bond;

$Y^1$ is selected from the group consisting of —(CH$_2$)$_m$—, —O—, —S—, and —S—S—;

n is 0, 1, 2, 3, 4, 5, or 6;

$Z^1$ is selected from the group consisting of optionally substituted $C_4$-$C_{12}$ cycloalkylenyl,

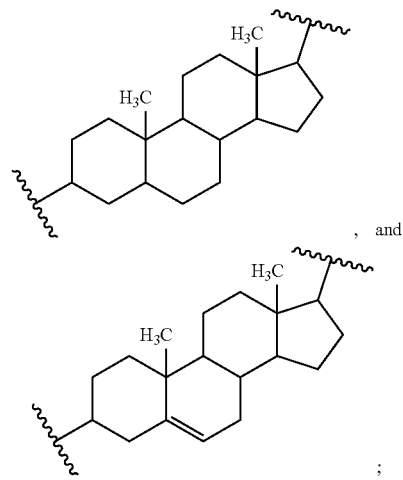

$R^{10}$ is selected from the group consisting of hydrogen, $C_1$-$C_2$, alkyl, and $C_2$-$C_{20}$ alkenyl;

$Q^2$ is $C_1$-$C_{20}$ alkylenyl;

$W^2$ is selected from the group consisting of —C(=O)O—, —C(=O)N($R^{12b}$)—, —OC(=O)N($R^{12b}$)—, and —OC(=O)O—;

$R^{12b}$ is selected from the group consisting of hydrogen and $C_1$-$C_6$ alkyl;

$X^2$ is optionally substituted $C_1$-$C_{15}$ alkylenyl; or $X^2$ is a bond;

$Y^2$ is selected from the group consisting of —(CH$_2$)$_n$—, —O—, —S—, and —S—S—;

n is 0, 1, 2, 3, 4, 5, or 6;

$Z^2$ is selected from the group consisting of —(CH$_2$)$_p$— optionally substituted $C_4$-$C_{12}$ cycloalkylenyl,

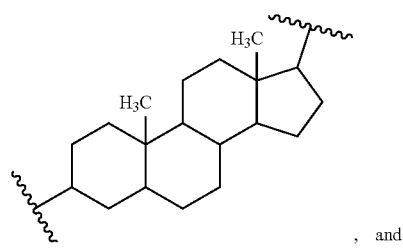

-continued

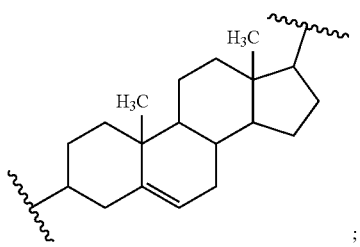

;

p is 0 or 1; and $R^{11}$ is selected from the group consisting of hydrogen, $C_1$-$C_{10}$ alkyl, and $C_2$-$C_{10}$ alkenyl; wherein one or more methylene linkages of $X^1$, $X^2$, $Y^1$, $Y^2$, $Z^1$, $Z^2$, $R^{10}$, and $R^{11}$, are optionally and independently replaced with a group selected from —O—, —CH=CH—, —S— and $C_3$-$C_6$ cycloalkylenyl.

In one embodiment, the disclosure provides a compound of Formula IB:

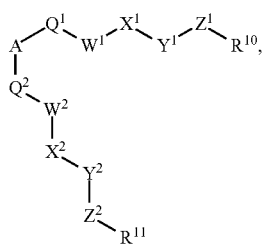

IB or a pharmaceutically acceptable salt or solvate thereof, wherein:

A is selected from the group consisting of —N($R^{1a}$)— and —C(R')—OC(=O)($R^{8a}$)—;

$R^{1a}$ is -$L^1$-$R^1$;

$L^1$ is $C_2$-$C_6$ alkylenyl or —(CH$_2$)$_{2-6}$—OC(=O)—;

$R^1$ is selected from the group consisting of —OH,

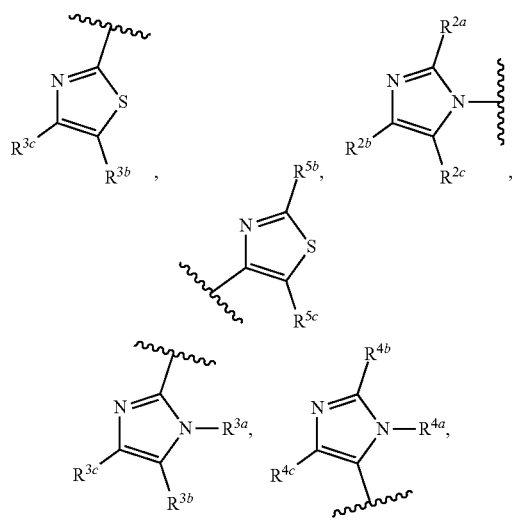

-continued

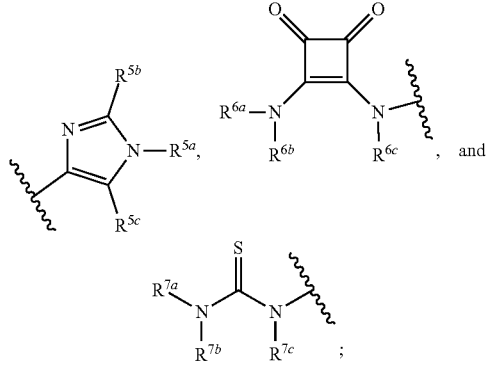

, and $R^{2a}$, $R^{2b}$, and $R^{2c}$ are independently selected from the group consisting of hydrogen and $C_1$-$C_6$ alkyl;

$R^{3a}$, $R^{3b}$, and $R^{3c}$ are independently selected from the group consisting of hydrogen and $C_1$-$C_6$ alkyl;

$R^{4a}$, $R^{4b}$, and $R^{4c}$ are independently selected from the group consisting of hydrogen and $C_1$-$C_6$ alkyl;

$R^{5a}$, $R^5$, and $R^{5c}$ are independently selected from the group consisting of hydrogen and $C_1$-$C_6$ alkyl;

$R^{6a}$, $R^{6b}$, and $R^{6c}$ are independently selected from the group consisting of hydrogen and $C_1$-$C_6$ alkyl;

or $R^{6a}$ and $R^{6b}$ taken together with the nitrogen atom to which they are attached form a 4- to 8-membered heterocyclo; and $R^{6c}$ is selected from the group consisting of hydrogen and $C_1$-$C_6$ alkyl;

$R^{7a}$, $R^{7b}$, and $R^{7c}$ are independently selected from the group consisting of hydrogen and $C_1$-$C_6$ alkyl;

or $R^{7a}$ and $R^{7b}$ taken together with the nitrogen atom to which they are attached form a 4- to 8-membered heterocyclo; and $R^{7c}$ is selected from the group consisting of hydrogen and $C_1$-$C_6$ alkyl;

R' is selected from the group consisting of hydrogen and $C_1$-$C_6$ alkyl;

$R^{8a}$ is -$L^2$-$R^8$;

$L^2$ is $C_2$-$C_6$ alkylenyl;

$R^8$ is selected from the group consisting of —NR$^{9a}$R$^{9b}$,

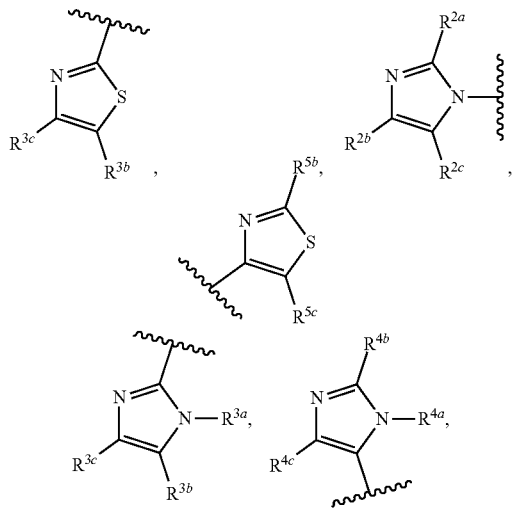

267

-continued

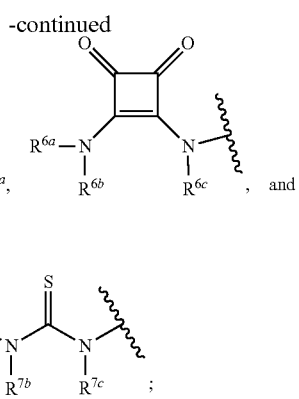

$R^{9a}$ and $R^{9b}$ are independently selected from the group consisting of hydrogen and $C_1$-$C_6$ alkyl; or $R^{9a}$ and $R^{9b}$ taken together with the nitrogen atom to which they are attached form a 4- to 8-membered heterocyclo;

$Q^1$ is $C_1$-$C_{20}$ alkylenyl;

$W^1$ is selected from the group consisting of —C(=O)O—, —OC(=O)—, —C(=O)N($R^{12a}$)—, —N($R^{12a}$)C(=O)—, —OC(=O)N($R^{12a}$)—, —N($R^{12a}$)C(=O)O—, and —OC(=O)O—;

$R^{12a}$ is selected from the group consisting of hydrogen and $C_1$-$C_6$ alkyl;

$X^1$ is optionally substituted $C_1$-$C_{15}$ alkylenyl; or $X^1$ is a bond;

$Y^1$ is selected from the group consisting of —(CH$_2$)$_m$—, —O—, —S—, and —S—S—;

m is 0, 1, 2, 3, 4, 5, or 6;

$Z^1$ is selected from the group consisting of optionally substituted $C_5$-$C_{12}$ bridged cycloalkylenyl,

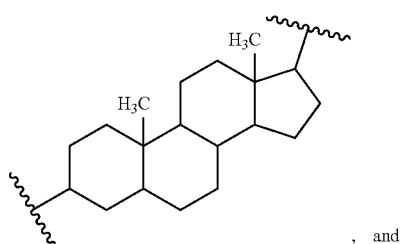

, and

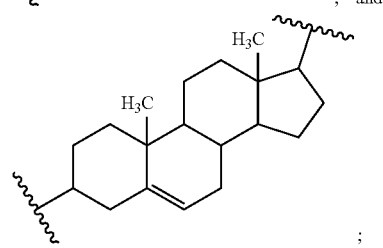

;

$R^{10}$ is selected from the group consisting of hydrogen, $C_1$-$C_{20}$ alkyl, and $C_2$-$C_{20}$ alkenyl;

$Q^2$ is $C_1$-$C_2$, alkylenyl;

$W^2$ is selected from the group consisting of —C(=O)O—, —C(=O)N($R^{12b}$)—, —OC(=O)N($R^{12b}$)—, and —OC(=O)O—;

$R^{12b}$ is selected from the group consisting of hydrogen and $C_1$-$C_6$ alkyl;

$X^2$ is optionally substituted $C_1$-$C_{15}$ alkylenyl; or $X^2$ is a bond;

268

$Y^2$ is selected from the group consisting of —(CH$_2$)$_n$—, —O—, —S—, and —S—S—;

n is 0, 1, 2, 3, 4, 5, or 6;

$Z^2$ is selected from the group consisting of —(CH$_2$)$_p$—, optionally substituted $C_4$-$C_{12}$ cycloalkylenyl,

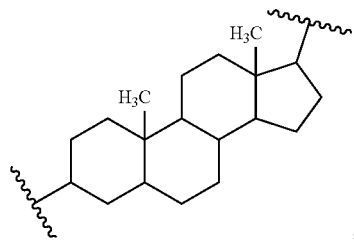

, and

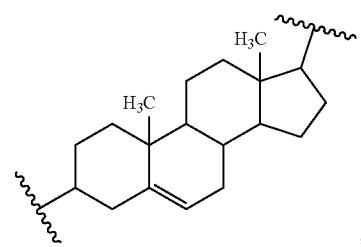

;

p is 0 or 1; and $R^{11}$ is selected from the group consisting of hydrogen, $C_1$-$C_{10}$ alkyl, and $C_2$-$C_{10}$ alkenyl; wherein one or more methylene linkages of $X^1$, $X^2$, $Y^1$, $Y^2$, $Z^1$, $Z^2$, $R^{10}$, and $R^{11}$, are optionally and independently replaced with a group selected from —O—, —CH=CH—, —S— and $C_3$-$C_6$ cycloalkylenyl.

In one embodiment, the disclosure provides a compound of Formula IC:

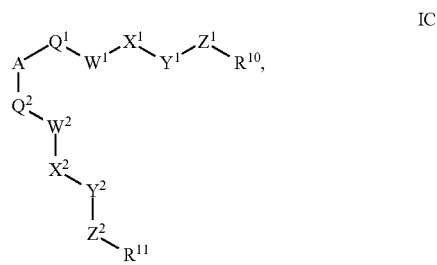

IC or a pharmaceutically acceptable salt or solvate thereof, wherein:

A is selected from the group consisting of —N($R^{1a}$)— and —C(R')—OC(=O)($R^{8a}$)—;

$R^{1a}$ is -$L^1$-$R^1$;

$L^1$ is $C_2$-$C_6$ alkylenyl or —(CH$_2$)$_{2-6}$—OC(=O)—;

$R^1$ is selected from the group consisting of —OH,

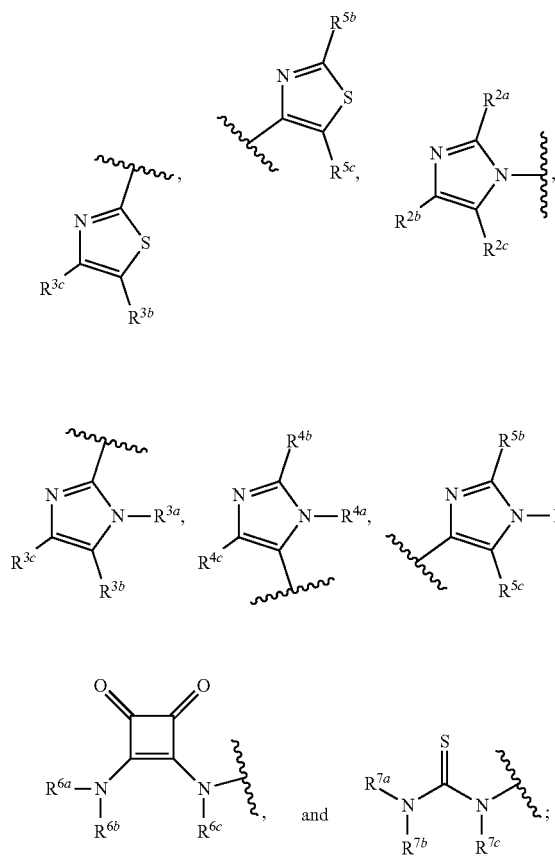

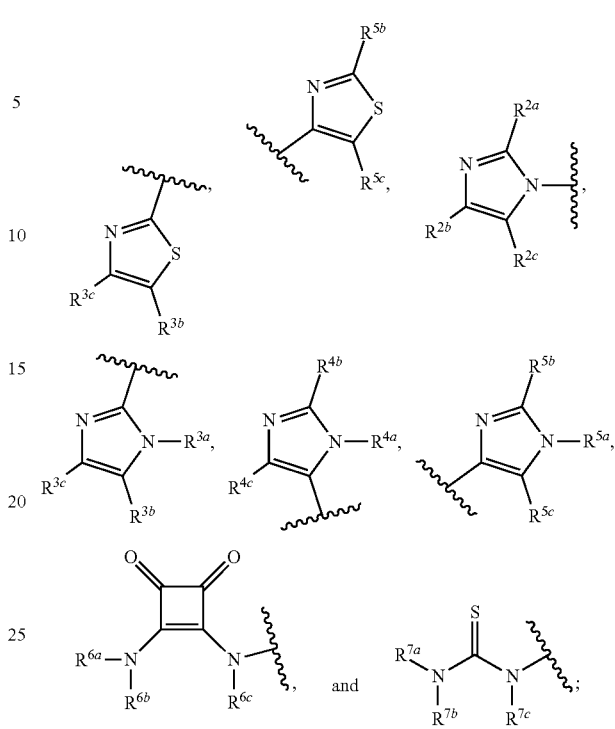

$R^{2a}$, $R^{2b}$, and $R^{2c}$ are independently selected from the group consisting of hydrogen and $C_1$-$C_6$ alkyl;

$R^{3a}$, $R^{3b}$, and $R^{3c}$ are independently selected from the group consisting of hydrogen and $C_1$-$C_6$ alkyl;

$R^{4a}$, $R^{4b}$, and $R^{4c}$ are independently selected from the group consisting of hydrogen and $C_1$-$C_6$ alkyl;

$R^{5a}$, $R^{5b}$, and $R^{5c}$ are independently selected from the group consisting of hydrogen and $C_1$-$C_6$ alkyl;

$R^{6a}$, $R^{6b}$, and $R^{6c}$ are independently selected from the group consisting of hydrogen and $C_1$-$C_6$ alkyl;

or $R^{6a}$ and $R^{6b}$ taken together with the nitrogen atom to which they are attached form a 4- to 8-membered heterocyclo; and $R^{6c}$ is selected from the group consisting of hydrogen and $C_1$-$C_6$ alkyl;

$R^{7a}$, $R^{7b}$, and $R^{7c}$ are independently selected from the group consisting of hydrogen and $C_1$-$C_6$ alkyl;

or $R^{7a}$ and $R^{7b}$ taken together with the nitrogen atom to which they are attached form a 4- to 8-membered heterocyclo; and $R^{7c}$ is selected from the group consisting of hydrogen and $C_1$-$C_6$ alkyl;

R' is selected from the group consisting of hydrogen and $C_1$-$C_6$ alkyl;

$R^{8a}$ is -$L^2$-$R^8$;

$L^2$ is $C_2$-$C_6$ alkylenyl;

$R^8$ is selected from the group consisting of —$NR^{9a}R^{9b}$, $R^{9a}$ and $R^{9b}$ are independently selected from the group consisting of hydrogen and $C_1$-$C_6$ alkyl; or $R^{9a}$ and $R^{9b}$ taken together with the nitrogen atom to which they are attached form a 4- to 8-membered heterocyclo;

$Q^1$ is $C_1$-$C_{20}$ alkylenyl;

$W^1$ is selected from the group consisting of —C(=O)O—, —OC(=O)—, —C(=O)N($R^{12a}$)—, —N($R^{12a}$)C(=O)—, —OC(=O)N($R^{12a}$)—, —N($R^{12a}$)C(=O)O—, and —OC(=O)O—;

$R^{12a}$ is selected from the group consisting of hydrogen and $C_1$-$C_6$ alkyl;

$X^1$ is optionally substituted branched $C_1$-$C_{15}$ alkylenyl; or $X^1$ is a bond;

$Y^1$ is selected from the group consisting of —(CH$_2$)$_m$—, —O—, —S—, and —S—S—;

m is 0, 1, 2, 3, 4, 5, or 6;

$Z^1$ is selected from the group consisting of optionally substituted $C_4$-$C_{12}$ cycloalkylenyl,

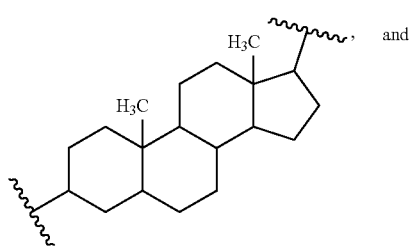

-continued

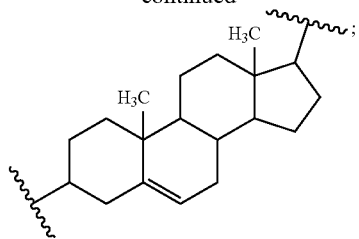

R$^{10}$ is selected from the group consisting of hydrogen, C$_1$-C$_{20}$ alkyl, and C$_2$-C$_{20}$ alkenyl;

Q$^2$ is C$_1$-C$_{20}$ alkylenyl;

W$^2$ is selected from the group consisting of —C(=O)O—, —C(=O)N(R$^{12b}$)—, —OC(=O)N(R$^{12b}$)—, and —OC(=O)O—;

R$^{12b}$ is selected from the group consisting of hydrogen and C$_1$-C$_6$ alkyl;

X$^2$ is optionally substituted C$_1$-C$_{15}$ alkylenyl; or

Y$^2$ is selected from the group consisting of —(CH$_2$)$_n$—, —O—, —S—, and —S—S—;

n is 0, 1, 2, 3, 4, 5, or 6;

Z$^2$ is of —(CH$_2$)$_p$—;

p is 0 or 1; and

R$^{11}$ is C$_1$-C$_{20}$ branched alkyl;

wherein one or more methylene linkages of X$^1$, X$^2$, Y$^1$, Y$^2$, Z$^1$, Z$^2$, R$^{10}$, and R$^{11}$, are optionally and independently replaced with a group selected from —O—, —CH=CH—, —S— and C$_3$-C$_6$ cycloalkylenyl. In some embodiments, the disclosure provides a compound of any one of Formulae IA, IB, IC, or a pharmaceutically acceptable salt or solvate thereof, wherein Z$^1$ is optionally substituted C$_5$-C$_{12}$ bridged cycloalkylenyl.

In some embodiments, the disclosure provides a compound of any one of Formulae IA, IB, IC, or a pharmaceutically acceptable salt or solvate thereof, wherein Z$^1$ is not adamantyl.

In one embodiment, the disclosure provides a compound of Formula ID:

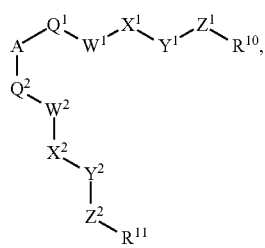

ID or a pharmaceutically acceptable salt or solvate thereof, wherein:

A is selected from the group consisting of —N(R$^{1a}$)- and —C(R')—OC(=O)(R$^{8a}$);

R$^{1a}$ is -L$^1$-R$^1$;

L$^1$ is C$_2$-C$_6$ alkylenyl or —(CH$_2$)$_{2-6}$—OC(=O)—;

R$^1$ is selected from the group consisting of —OH,

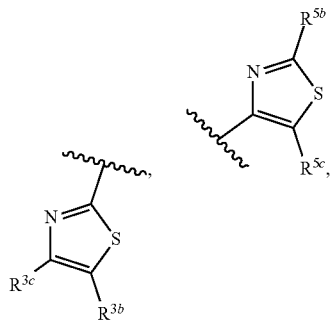

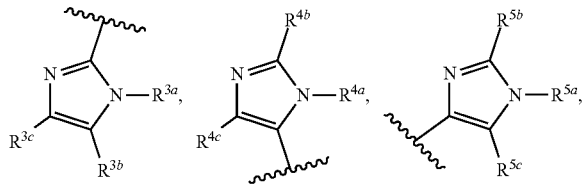

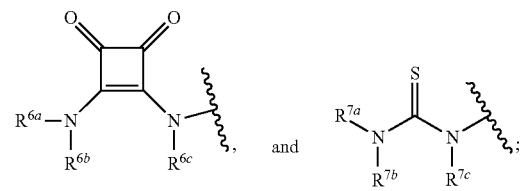

R$^{2a}$, R$^{2b}$, and R$^{2c}$ are independently selected from the group consisting of hydrogen and C$_1$-C$_6$ alkyl;

R$^{3a}$, R$^{3b}$, and R$^{3c}$ are independently selected from the group consisting of hydrogen and C$_1$-C$_6$ alkyl;

R$^{4a}$, R$^{4b}$, and R$^{4c}$ are independently selected from the group consisting of hydrogen and C$_1$-C$_6$ alkyl;

R$^{5a}$, R$^{5b}$, and R$^{5c}$ are independently selected from the group consisting of hydrogen and C$_1$-C$_6$ alkyl;

R$^{6a}$, R$^{6b}$ and R$^{6c}$ are independently selected from the group consisting of hydrogen and C$_1$-C$_6$ alkyl;

or

R$^{6a}$ and R$^{6b}$ taken together with the nitrogen atom to which they are attached form a 4- to 8-membered heterocyclo; and R$^{6c}$ is selected from the group consisting of hydrogen and C$_1$-C$_6$ alkyl;

R$^{7a}$, R$^{7b}$, and R$^{7c}$ are independently selected from the group consisting of hydrogen and C$_1$-C$_6$ alkyl;

or

R$^{7a}$ and R$^{7b}$ taken together with the nitrogen atom to which they are attached form a 4- to 8-membered heterocyclo; and R$^{7c}$ is selected from the group consisting of hydrogen and C$_1$-C$_6$ alkyl;

R' is selected from the group consisting of hydrogen and C$_1$-C$_6$ alkyl;

R$^{8a}$ is -L$^2$-R$^8$;

L$^2$ is C$_2$-C$_6$ alkylenyl;

R$^8$ is selected from the group consisting of —NR$^{9a}$R$^{9b}$,

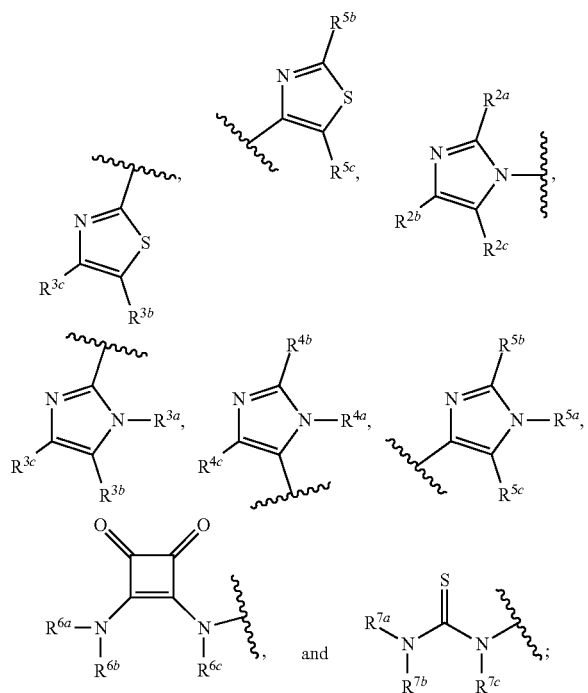

R$^{9a}$ and R$^{9b}$ are independently selected from the group consisting of hydrogen and C$_1$-C$_6$ alkyl; or R$^{9a}$ and R$^{9b}$ taken together with the nitrogen atom to which they are attached form a 4- to 8-membered heterocyclo;

Q$^1$ is C$_1$-C$_{20}$ alkylenyl;

W$^1$ is selected from the group consisting of —C(=O)O—, —OC(=O)—, —C(=O)N(R$^{12a}$)—, —N(R$^{12a}$)C(=O)—, —OC(=O)N(R$^{12a}$)—, —N(R$^{12a}$)C(=O)O—, and —OC(=O)O—;

R$^{12a}$ is selected from the group consisting of hydrogen and C$_1$-C$_6$ alkyl;

X$^1$ is optionally substituted branched C$_1$-C$_{15}$ alkylenyl; or

X$^1$ is a bond;

Y$^1$ is selected from the group consisting of —(CH$_2$)$_m$—, —O—, —S—, and —S—S—;

m is 0, 1, 2, 3, 4, 5, or 6;

R$^1$ is optionally substituted C$_5$-C$_{12}$ bridged cycloalkylenyl;

R$^{10}$ is selected from the group consisting of hydrogen, C$_1$-C$_2$) alkyl, and C$_2$-C$_{20}$ alkenyl;

Q$^2$ is C$_1$-C$_{20}$ alkylenyl;

W$^2$ is selected from the group consisting of —C(=O)O—, —C(=O)N(R$^{12b}$)—, —OC(=O)N(R$^{12b}$)—, and —OC(=O)O—;

R$^{12b}$ is selected from the group consisting of hydrogen and C$_1$-C$_6$ alkyl;

X$^2$ is optionally substituted C$_1$-C$_{15}$ alkylenyl; or

Y$^2$ is —(CH$_2$)$_n$—;

n is 0, 1, 2, 3, 4, 5, or 6;

Z$^2$ is of —(CH$_2$)$_p$—;

p is 0 or 1; and

R$^{11}$ is C$_1$-C$_{20}$ branched alkyl.

In some embodiments, the disclosure provides a compound of Formula ID or a pharmaceutically acceptable salt or solvate thereof, wherein Z$^1$ is not adamantyl.

In one embodiment, the disclosure provides a compound of Formula I:

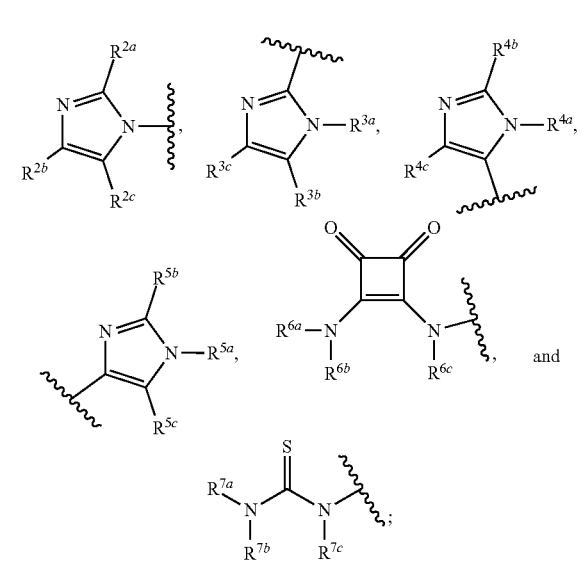

or a pharmaceutically acceptable salt or solvate thereof, wherein:

A is selected from the group consisting of —N(R$^{1a}$)— and —C(R')—OC(=O)(R$^{8a}$)—;

R$^{1a}$ is -L$^1$-R$^1$;

L$^1$ is C$_2$-C$_6$ alkylenyl;

R$^1$ is selected from the group consisting of —OH,

R$^{2a}$, R$^{2b}$, and R$^{2c}$ are independently selected from the group consisting of hydrogen and C$_1$-C$_6$ alkyl;

R$^{3a}$, R$^{3b}$, and R$^{3c}$ are independently selected from the group consisting of hydrogen and C$_1$-C$_6$ alkyl;

R$^{4a}$, R$^{4b}$, and R$^{4c}$ are independently selected from the group consisting of hydrogen and C$_1$-C$_6$ alkyl;

R$^{5a}$, R$^{5b}$, and R$^{5c}$ are independently selected from the group consisting of hydrogen and C$_1$-C$_6$ alkyl;

R$^{6a}$, R$^{6b}$, and R$^{6c}$ are independently selected from the group consisting of hydrogen and C$_1$-C$_0$ alkyl;

or

R$^{6a}$ and R$^{6b}$ taken together with the nitrogen atom to which they are attached form a 4- to 8-membered heterocyclo; and R$^{6c}$ is selected from the group consisting of hydrogen and C$_1$-C$_6$ alkyl;

R$^{7a}$, R$^{7b}$, and R$^{7c}$ are independently selected from the group consisting of hydrogen and C$_1$-C$_6$ alkyl;

or

R$^{7a}$ and R$^{7b}$ taken together with the nitrogen atom to which they are attached form a 4- to 8-membered heterocyclo; and R$^{7c}$ is selected from the group consisting of hydrogen and C$_1$-C$_6$ alkyl;

R' is selected from the group consisting of hydrogen and C$_1$-C$_6$ alkyl;

$R^{8a}$ is -$L^2$-$R^8$;

$L^2$ is $C_2$-$C_6$ alkylenyl;

$R^8$ is —N—$R^{9a}R^{9b}$;

$R^{9a}$ and $R^{9b}$ are independently selected from the group consisting of hydrogen and $C_1$-$C_6$ alkyl; or $R^{9a}$ and $R^{9b}$ taken together with the nitrogen atom to which they are attached form a 4- to 8-membered heterocyclo;

$Q^1$ is $C_1$-$C_{20}$ alkylenyl; $W^1$ is selected from the group consisting of —C(=O)O—, —OC(=O)—, —C(=O)N($R^{12a}$)—, —N($R^{12a}$)C(=O)—, —OC(=O)N($R^{12a}$)—, —N($R^{12a}$)C(=O)O—, and —OC(=O)O—;

$R^{12a}$ is selected from the group consisting of hydrogen and $C_1$-$C_6$ alkyl;

$X^1$ is $C_1$-$C_{15}$ alkylenyl; or $X^1$ is a bond;

$Y^1$ is selected from the group consisting of —(CH$_2$)$_m$—, —O—, —S—, and —S—S—;

m is 0, 1, 2, 3, 4, 5, or 6;

$Z^1$ is selected from the group consisting of $C_4$-$C_{12}$ cycloalkylenyl,

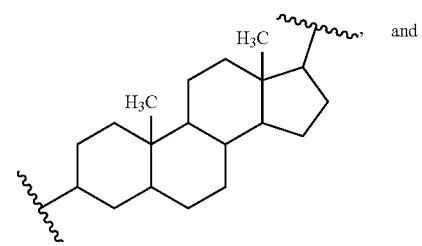

and

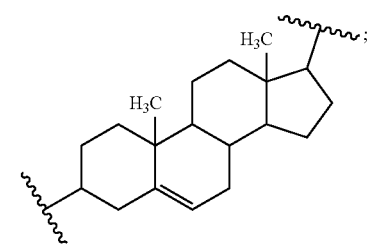

$R^{10}$ is selected from the group consisting of hydrogen, $C_1$-$C_{20}$ alkyl, and $C_2$-$C_{20}$ alkenyl;

$Q^2$ is $C_1$-$C_{20}$ alkylenyl;

$W^2$ is selected from the group consisting of —C(=O)O—, —C(=O)N($R^{12b}$), —OC(=O)N($R^{12b}$)— and —OC(=O)O—;

$R^{12b}$ is selected from the group consisting of hydrogen and $C_1$-$C_6$ alkyl;

$X^2$ is $C_1$-$C_{15}$ alkylenyl; or $X^2$ is a bond;

$Y^2$ is selected from the group consisting of —(CH$_2$)$_n$—, —O—, —S—, and —S—S—;

n is 0, 1, 2, 3, 4, 5, or 6;

$Z^2$ is selected from the group consisting of —(CH$_2$)$_p$—, $C_4$-$C_{12}$ cycloalkylenyl,

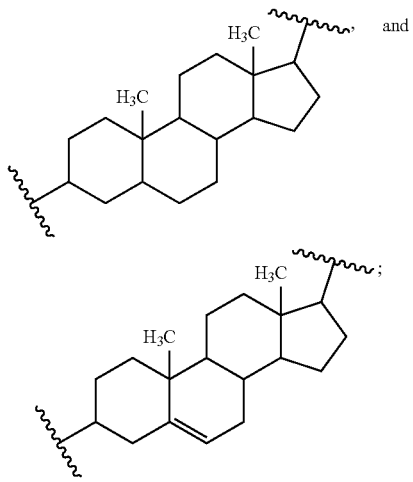

p is 0 or 1; and $R^{11}$ is selected from the group consisting of hydrogen, $C_1$-$C_{10}$ alkyl, and $C_2$-$C_{10}$ alkenyl.

In another embodiment, the disclosure provides a compound of Formula II:

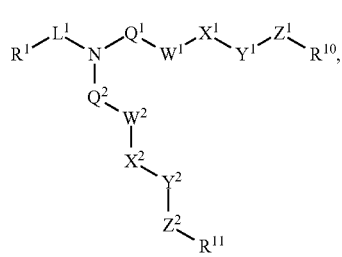

II or a pharmaceutically acceptable salt or solvate thereof, wherein $R^1$, $R^{10}$, $R^{11}$, $Q^1$, $Q^2$, $W^1$, $W^2$, $X^1$, $X^2$, $Y^1$, $Y^2$, $Z^1$, and $Z^2$ are as defined herein in Formula IA, Formula IB, Formula IC, Formula ID, Formula I, or below.

In another embodiment, the disclosure provides a compound of Formula III:

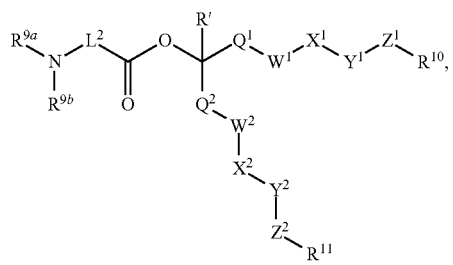

III or a pharmaceutically acceptable salt or solvate thereof, wherein R', $R^{9a}$, $R^{9b}$, $R^{10}$, $R^{11}$, $L^2$, $Q^1$, $Q^2$, $W^1$, $W^2$, $X^1$, $X^2$, $Y^1$, $Y^2$, $Z^1$, and $Z^2$ are as defined herein in Formula IA, Formula IB, Formula IC, Formula ID, Formula I, or below.

In another embodiment, the disclosure provides a compound of Formula IV:

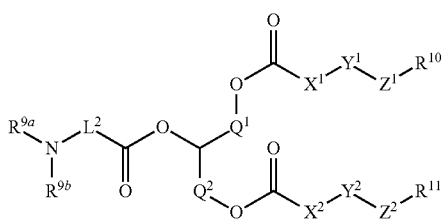
VI or a pharmaceutically acceptable salt or solvate thereof, wherein $R^{9a}$, $R^{9b}$, $L^2$, $Q^1$, $Q^2$, $X^1$, $X^2$, $Y^1$, $Y^2$. $Z^1$, $Z^2$, $R^{10}$, an R are as defined herein in Formula IA, Formula IB, Formula IC, Formula ID, Formula I, or below.

In another embodiment, the disclosure provides a compound of Formula VI':

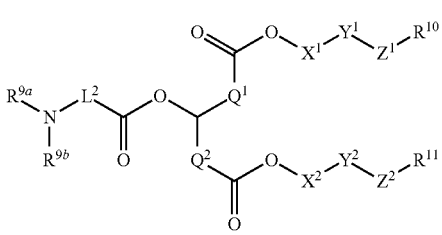
VI' or a pharmaceutically acceptable salt or solvate thereof, wherein $R^{9a}$, $R^{9b}$, $L^2$, $Q^1$, $Q^2$, $X^1$, $X^2$, $Y^1$, $Y^2$, $Z^1$, $Z^2$, $R^{10}$, an R are as defined herein in Formula IA, Formula IB, Formula IC, Formula ID, Formula I, or below.

In another embodiment, the disclosure provides a compound of Formula VI":

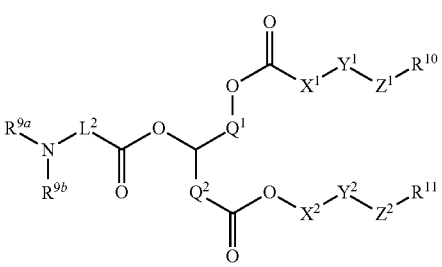
VI"

or a pharmaceutically acceptable salt or solvate thereof, wherein $R^{9a}$, $R^{9b}$, $L^2$, $Q^1$, $Q^2$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In another embodiment, the disclosure provides a compound of Formula VI''':

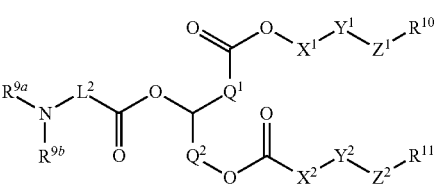
VI''' or a pharmaceutically acceptable salt or solvate thereof, wherein $R^{9a}$, $R^{9b}$, $L^2$, $Q^1$, $Q^2$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In another embodiment, the disclosure provides a compound of Formula VII:

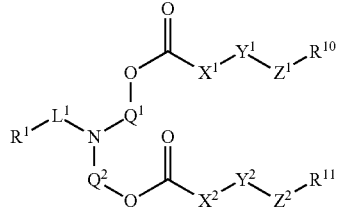
VII or a pharmaceutically acceptable salt or solvate thereof, wherein $R^1$, $L^1$, $Q^1$, $Q^2$, $X^1$, $X^2$, $Y^1$, $Y^2$, $Z^1$, $Z^2$, $R^1$, an $R^{11}$ are as defined herein in Formula IA, Formula IB, Formula IC, Formula ID, Formula I, or below.

In another embodiment, the disclosure provides a compound of Formula VII':

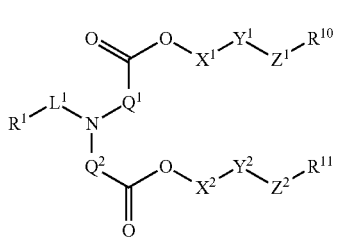
VII' or a pharmaceutically acceptable salt or solvate thereof, wherein $R^1$, $L^1$, $Q^1$, $Q^2$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In another embodiment, the disclosure provides a compound of Formula VII":

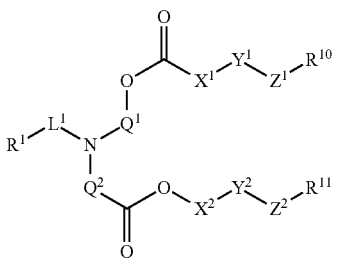
VII"

or a pharmaceutically acceptable salt or solvate thereof, wherein $R^1$, $L^1$, $Q^1$, $Q^2$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In another embodiment, the disclosure provides a compound of Formula VII''':

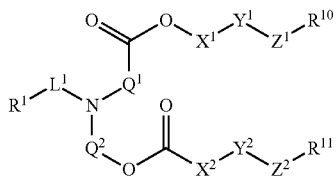

or a pharmaceutically acceptable salt or solvate thereof, wherein $R^1, L^1, Q^1, Q^2, X^1, X^2, Y^1, Y^2, Z^1, Z^2, R^{10}$, an $R^{11}$ are as defined herein in Formula IA, Formula IB, Formula IC, Formula ID, Formula I, or below.

Formula IA, Formula IB, Formula IC, Formula I, In another embodiment, the disclosure provides a compound of Formula VIII:

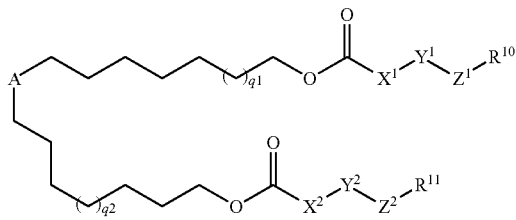

or a pharmaceutically acceptable salt or solvate thereof, wherein
$q^1$ is 0, 1, 2, or 3;
$q^2$ is 0, 1, 2, or 3;
$A, X^1, X^2, Y^1, Y^2, Z^1, Z^2, R^{10}$, an $R^{11}$ are as defined herein in Formula IA, Formula IB, Formula IC, Formula ID, Formula I, or below.

In certain embodiments, the compound is a compound of Formula VIII, wherein $Z^1$ is an optionally substituted $C_5$-$C_{12}$ bridged cycloalkylenyl.

In another embodiment, the disclosure provides a compound of Formula VIII':

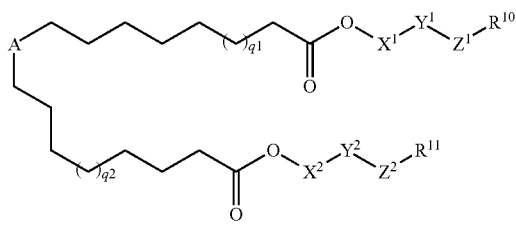

or a pharmaceutically acceptable salt or solvate thereof, wherein
$q^1$ is 0, 1, 2, or 3;
$q^2$ is 0, 1, 2, or 3;
$A, X^1, X^2, Y^1, Y^2, Z^1, Z^2, R^{10}$, an $R^{11}$ are as defined herein in Formula IA, Formula IB, Formula IC, Formula ID, Formula I, or below.

In certain embodiments, the compound is a compound of Formula VIII', wherein $Z^1$ is an optionally substituted $C_5$-$C_{12}$ bridged cycloalkylenyl.

In another embodiment, the disclosure provides a compound of Formula VIII":

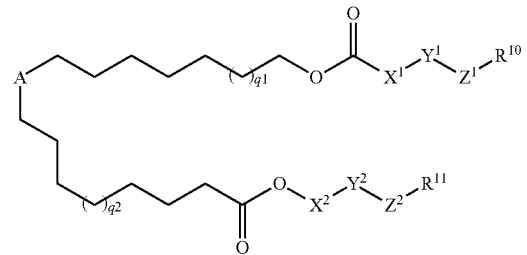

or a pharmaceutically acceptable salt or solvate thereof, wherein
$q^1$ is 0, 1, 2, or 3;
$q^2$ is 0, 1, 2, or 3;
$A, X^1, X^2, Y^1, Y^2, Z^1, Z^2, R^{10}$, an $R^{11}$ are as defined herein in Formula IA, Formula IB, Formula IC, Formula ID, Formula I, or below.

In certain embodiments, the compound is a compound of Formula VIII", wherein $Z^1$ is an optionally substituted $C_5$-$C_{12}$ bridged cycloalkylenyl.

In another embodiment, the disclosure provides a compound of Formula VIII''':

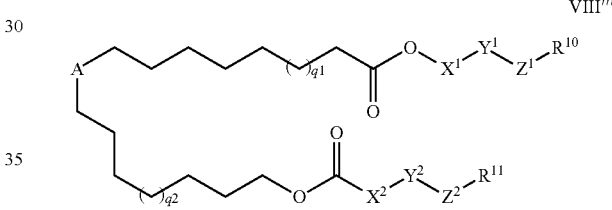

or a pharmaceutically acceptable salt or solvate thereof, wherein
$q^1$ is 0, 1, 2, or 3;
$q^2$ is 0, 1, 2, or 3;
$A, X^1, X^2, Y^1, Y^2, Z^1, Z^2, R^{10}$, an $R^{11}$ are as defined herein in Formula IA, Formula IB, Formula IC, Formula ID, Formula I, or below.

In certain embodiments, the compound is a compound of Formula VIII''', wherein $Z^1$ is an optionally substituted $C_5$-$C_{12}$ bridged cycloalkylenyl.

In another embodiment, the disclosure provides a compound of Formula IX:

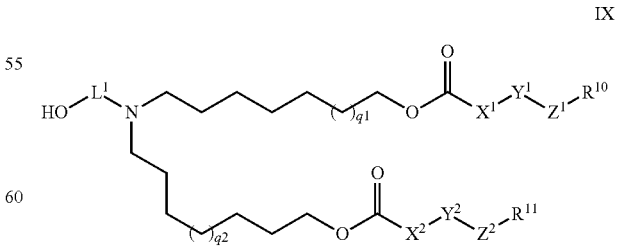

or a pharmaceutically acceptable salt or solvate thereof, wherein
$q^1$ is 0, 1, 2, or 3;
$q^2$ is 0, 1, 2, or 3;

$L^1$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In certain embodiments, the compound is a compound of Formula IX, wherein $Z^1$ is an optionally substituted $C_5$-$C_{12}$ bridged cycloalkylenyl.

In another embodiment, the disclosure provides a compound of Formula IX':

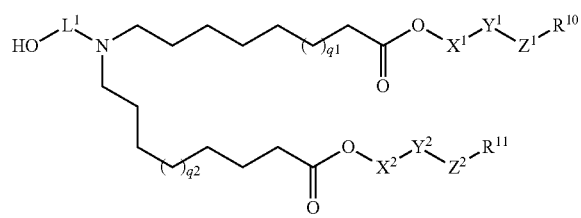

IX' or a pharmaceutically acceptable salt or solvate thereof, wherein $q^1$ is 0, 1, 2, or 3;

$q^2$ is 0, 1, 2, or 3, $L^1$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In certain embodiments, the compound is a compound of Formula IX', wherein $Z^1$ is an optionally substituted $C_5$-$C_{12}$ bridged cycloalkylenyl.

In another embodiment, the disclosure provides a compound of Formula IX":

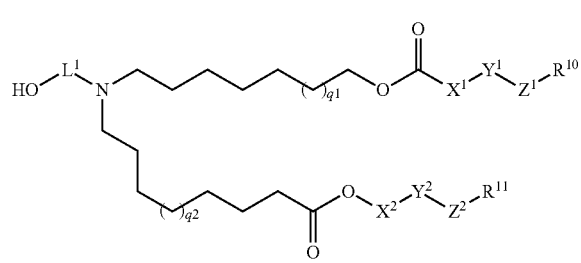

IX"

or a pharmaceutically acceptable salt or solvate thereof, wherein $q^1$ is 0, 1, 2, or 3;

$q^2$ is 0, 1, 2, or 3, $L^1$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In certain embodiments, the compound is a compound of Formula IX", wherein $Z^1$ is an optionally substituted $C_5$-$C_{12}$ bridged cycloalkylenyl.

In another embodiment, the disclosure provides a compound of Formula IX''':

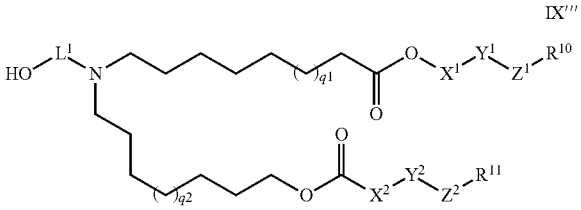

IX''' or a pharmaceutically acceptable salt or solvate thereof, wherein $q^1$ is 0, 1, 2, or 3;

$q^2$ is 0, 1, 2, or 3, $L^1$, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In certain embodiments, the compound is a compound of Formula IX''', wherein $Z^1$ is an optionally substituted $C_5$-$C_{12}$ bridged cycloalkylenyl.

In another embodiment, the disclosure provides a compound of Formula X:

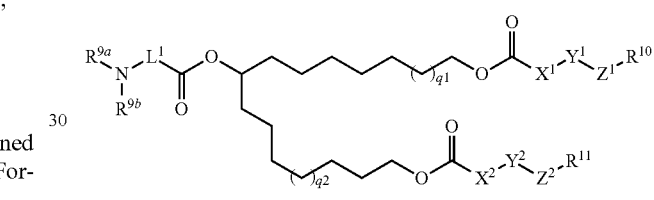

X or a pharmaceutically acceptable salt or solvate thereof, wherein $q^1$ is 0, 1, 2, or 3;

$q^2$ is 0, 1, 2, or 3;

$L^1$, $X^1$, $X^2$, $Y^1$, $Y^2$, $Z^1$, $Z^2$, $R^{9a}$, $R^{9b}$, $R^{10}$, an $R^{11}$ are as defined herein in Formula IA, Formula IB, Formula IC, Formula ID, Formula I or below.

In certain embodiments, the compound is a compound of Formula X, wherein $Z^1$ is an optionally substituted $C_5$-$C_{12}$ bridged cycloalkylenyl.

In another embodiment, the disclosure provides a compound of Formula X':

X' or a pharmaceutically acceptable salt or solvate thereof, wherein $q^1$ is 0, 1, 2, or 3;

$q^2$ is 0, 1, 2, or 3;

$L^1$, $X^1$, $X^2$, $Y^1$, $Y^2$, $Z^1$, $Z^2$, $R^{9a}$, $R^{9b}$, $R^{10}$, an $R^{11}$ are as defined herein in Formula IA, Formula IB, Formula IC, Formula ID, Formula I or below.

In certain embodiments, the compound is a compound of Formula X', wherein $Z^1$ is an optionally substituted $C_5$-$C_{12}$ bridged cycloalkylenyl.

In another embodiment, the disclosure provides a compound of Formula X":

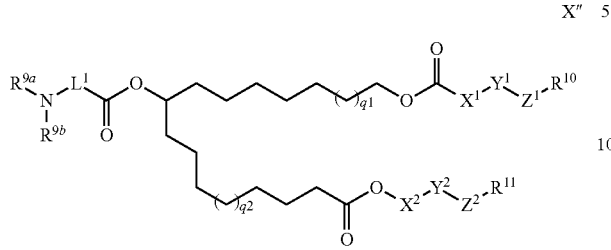

X"

or a pharmaceutically acceptable salt or solvate thereof, wherein
$q^1$ is 0, 1, 2, or 3;
$q^2$ is 0, 1, 2, or 3;
$L^1$, $X^1$, $X^2$, $Y^1$, $Y^2$, $Z^1$, $Z^2$, $R^{9a}$, $R^{9b}$, $R^{10}$, an $R^{11}$ are as defined herein in Formula IA Formula IB, Formula IC, Formula ID, Formula I or below.

In certain embodiments, the compound is a compound of Formula X", wherein $Z^1$ is an optionally substituted $C_5$-$C_{12}$ bridged cycloalkylenyl.

In another embodiment, the disclosure provides a compound of Formula X'":

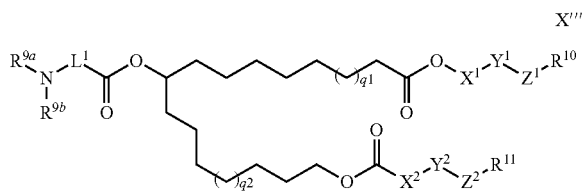

X'"

or a pharmaceutically acceptable salt or solvate thereof, wherein
$q^1$ is 0, 1, 2, or 3;
$q^2$ is 0, 1, 2, or 3;
$L^1$, $X^1$, $X^2$, $Y^1$, $Y^2$, $Z^1$, $Z^2$, $R^{9a}$, $R^{9b}$, $R^{10}$, an $R^{11}$ are as defined herein in Formula IA, Formula IB, Formula IC, Formula ID, Formula I or below.

In certain embodiments, the compound is a compound of Formula X'", wherein $Z^1$ is an optionally substituted $C_5$-$C_{12}$ bridged cycloalkylenyl.

In another embodiment, the disclosure provides a compound of Formula XI:

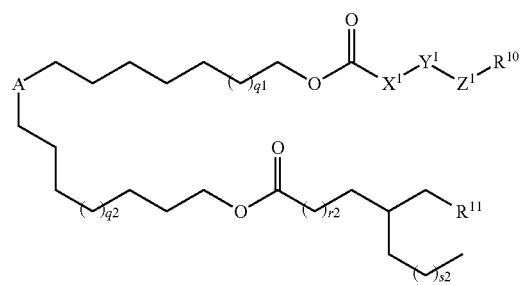

XI or a pharmaceutically acceptable salt or solvate thereof, wherein
$q^1$ is 0, 1, 2, or 3;
$q^2$ is 0, 1, 2, or 3;
$r^2$ is 0, 1, or 2;
$s^2$ is 0, 1, 2, 3, 4, 5, 6; and
A, $X^1$, $Y^1$, $Z^1$, $R^{10}$, and $R^{11}$ are as defined herein in Formula IA, Formula IB, Formula IC, Formula ID, Formula I, or below.

In certain embodiments, the compound is a compound of Formula XI, wherein $Z^1$ is an optionally substituted $C_5$-$C_{12}$ bridged cycloalkylenyl.

In another embodiment, the disclosure provides a compound of Formula XI':

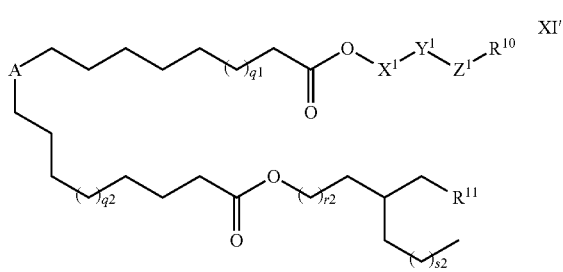

XI' or a pharmaceutically acceptable salt or solvate thereof, wherein
$q^1$ is 0, 1, 2, or 3;
$q^2$ is 0, 1, 2, or 3;
$r^2$ is 0, 1, or 2;
$s^2$ is 0, 1, 2, 3, 4, 5, 6; and
A, $X^1$, $Y^1$, $Z^1$, $R^{10}$, and $R^{11}$ are as defined herein in Formula IA, Formula IB, Formula IC, Formula ID, Formula I, or below.

In certain embodiments, the compound is a compound of Formula XI', wherein $Z^1$ is an optionally substituted $C_5$-$C_{12}$ bridged cycloalkylenyl.

In another embodiment, the disclosure provides a compound of Formula XI":

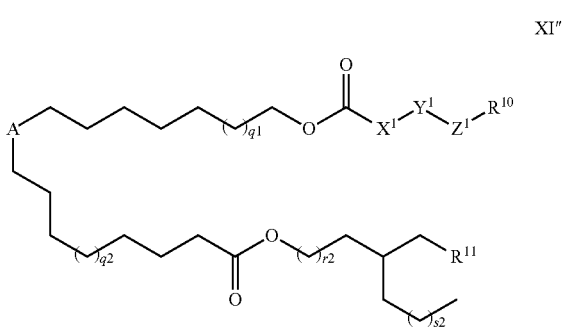

XI"

or a pharmaceutically acceptable salt or solvate thereof, wherein
$q^1$ is 0, 1, 2, or 3;
$q^2$ is 0, 1, 2, or 3,
$r^2$ is 0, 1, or 2;
$s^2$ is 0, 1, 2, 3, 4, 5, 6; and
A, $X^1$, $Y^1$, $Z^1$, $R^{10}$, and $R^{11}$ are as defined herein in Formula IA, Formula IB, Formula IC, Formula ID, Formula I, or below.

In certain embodiments, the compound is a compound of Formula XI", wherein $Z^1$ is an optionally substituted $C_5$-$C_{12}$ bridged cycloalkylenyl.

In another embodiment, the disclosure provides a compound of Formula XI''':

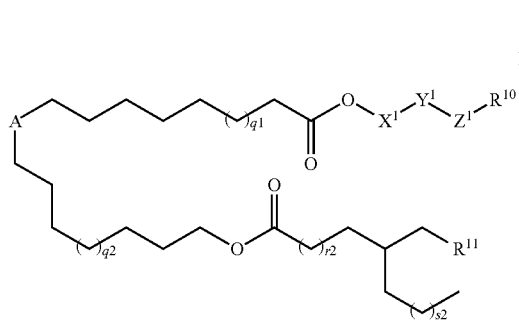

or a pharmaceutically acceptable salt or solvate thereof, wherein $q^1$ is 0, 1, 2, or 3;
$q^2$ is 0, 1, 2, or 3;
$r^2$ is 0, 1, or 2;
$s^2$ is 0, 1, 2, 3, 4, 5, 6; and
A, $X^1$, $Y^1$, $Z^1$, $R^{10}$, and $R^{11}$ are as defined herein in Formula IA, Formula IB, Formula IC, Formula ID, Formula I, or below.

In certain embodiments, the compound is a compound of Formula XI''', wherein $Z^1$ is an optionally substituted $C_5$-$C_{12}$ bridged cycloalkylenyl.

In another embodiment, the disclosure provides a compound of Formula XII:

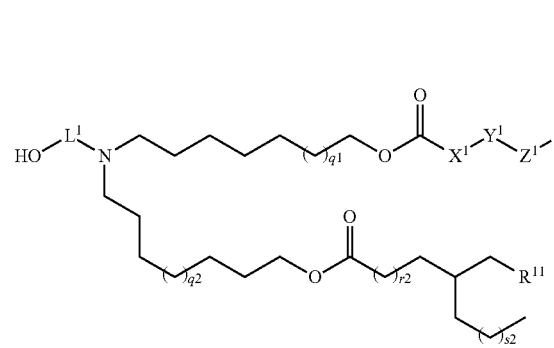

or a pharmaceutically acceptable salt or solvate thereof, wherein $q^1$ is 0, 1, 2, or 3;
$q^2$ is 0, 1, 2, or 3;
$r^2$ is 01, or 2;
$s^2$ is 0, 1, 2, 3, 4, 5, 6; and
$L^1$, $X^1$, $Y^1$, $Z^1$, $R^{10}$ and $R^{11}$ are as defined herein in Formula IA, Formula IB, Formula IC, Formula ID, Formula I, or below.

In certain embodiments, the compound is a compound of Formula XII, wherein $Z^1$ is an optionally substituted $C_5$-$C_{12}$ bridged cycloalkylenyl.

In another embodiment, the disclosure provides a compound of Formula XII':

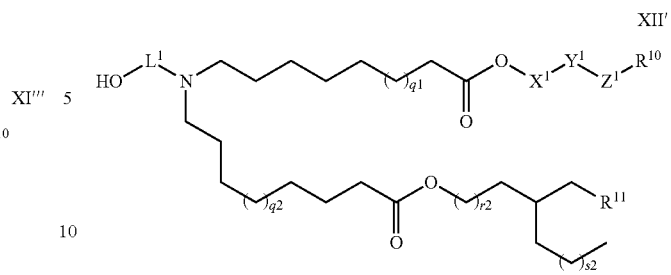

or a pharmaceutically acceptable salt or solvate thereof, wherein $q^1$ is 0, 1, 2, or 3;
$q^2$ is 0, 1, 2, or 3;
$r^2$ is 0, 1, or 2;
$s^2$ is 0, 1, 2, 3, 4, 5, 6; and
$L^1$, $X^1$, $Y^1$, $Z^1$, $R^{10}$ and $R^{11}$ are as defined herein in Formula IA, Formula IB, Formula IC, Formula ID, Formula I, or below.

In certain embodiments, the compound is a compound of Formula XII', wherein $Z^1$ is an optionally substituted $C_5$-$C_{12}$ bridged cycloalkylenyl.

In another embodiment, the disclosure provides a compound of Formula XII'':

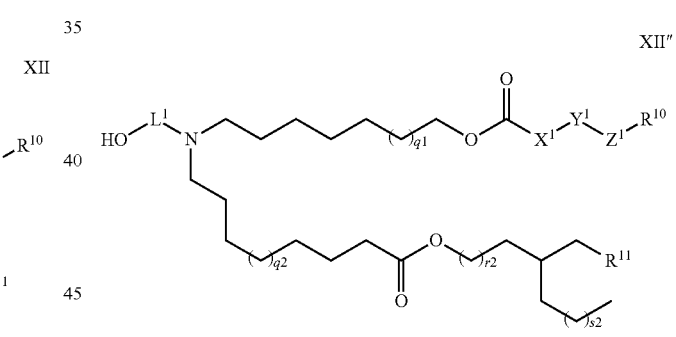

or a pharmaceutically acceptable salt or solvate thereof, wherein $q^1$ is 0, 1, 2, or 3;
$q^2$ is 0, 1, 2, or 3;
$r^2$ is 0, 1, or 2;
$s^2$ is 0, 1, 2, 3, 4, 5, 6; and
$L^1$, $X^1$, $Y^1$, $Z^1$, $R^{10}$ and $R^{11}$ are as defined herein in Formula IA, Formula IB, Formula IC, Formula ID, Formula I or below.

In certain embodiments, the compound is a compound of Formula XII'', wherein $Z^1$ is an optionally substituted $C_5$-$C_{12}$ bridged cycloalkylenyl.

In another embodiment, the disclosure provides a compound of Formula XII''':

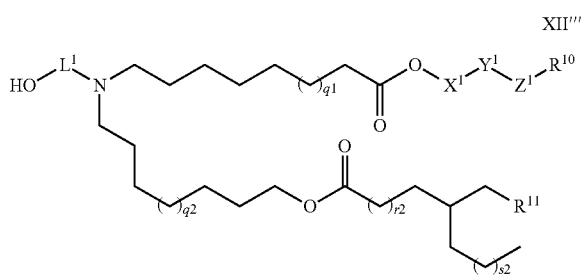

or a pharmaceutically acceptable salt or solvate thereof, wherein
- $q^1$ is 0, 1, 2, or 3;
- $q^2$ is 0, 1, 2, or 3;
- $r^2$ is 0, 1, or 2;
- $s^2$ is 0, 1, 2, 3, 4, 5, 6; and
- $L^1$, $X^1$, $Y^1$, $Z^1$, $R^{10}$ and $R^{11}$ are as defined herein in Formula IA, Formula IB, Formula IC, Formula ID, Formula I or below.

In certain embodiments, the compound is a compound of Formula XII''', wherein $Z^1$ is an optionally substituted $C_5$-$C_{12}$ bridged cycloalkylenyl.

In another embodiment, the disclosure provides a compound of Formula XIII:

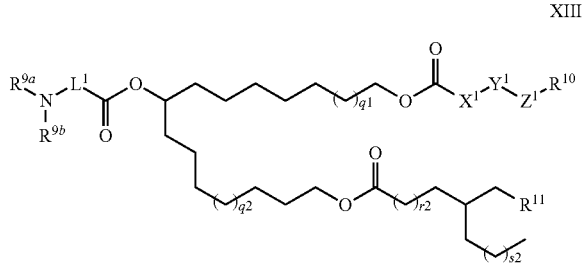

or a pharmaceutically acceptable salt or solvate thereof, wherein
- $q^1$ is 0, 1, 2, or 3;
- $q^2$ is 0, 1, 2, or 3;
- $r^2$ is 0, 1, or 2;
- $s^2$ is 0, 1, 2, 3, 4, 5, 6; and
- $L^1$, $X^1$, $Y^1$, $Z^1$, $R^{9a}$, $R^{9b}$, $R^{10}$ and $R^{11}$ are as defined herein in Formula IA, Formula IB, Formula IC, Formula I or below.

In certain embodiments, the compound is a compound of Formula XIII, wherein $Z^1$ is an optionally substituted $C_5$-$C_{12}$ bridged cycloalkylenyl.

In another embodiment, the disclosure provides a compound of Formula XIII':

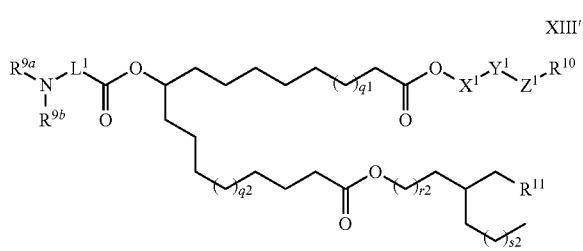

or a pharmaceutically acceptable salt or solvate thereof, wherein
- $q^1$ is 0, 1, 2, or 3;
- $q^2$ is 0, 1, 2, or 3;
- $r^2$ is 0, 1, or 2;
- $s^2$ is 0, 1, 2, 3, 4, 5, 6; and
- $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I, or below.

In certain embodiments, the compound is a compound of Formula XIII', wherein $Z^1$ is an optionally substituted $C_5$-$C_{12}$ bridged cycloalkylenyl.

In another embodiment, the disclosure provides a compound of Formula XIII'':

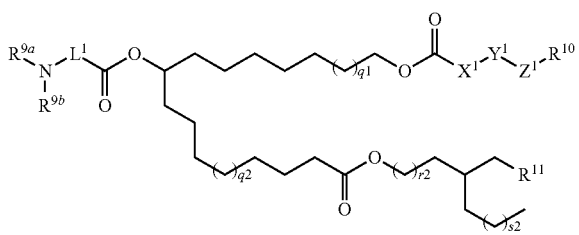

or a pharmaceutically acceptable salt or solvate thereof, wherein
- $q^1$ is 0, 1, 2, or 3;
- $q^2$ is 0, 1, 2, or 3;
- $r^2$ is 0, 1, or 2;
- $s^2$ is 0, 1, 2, 3, 4, 5, 6; and
- $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I, or below.

In certain embodiments, the compound is a compound of Formula XIII'', wherein $Z^1$ is an optionally substituted $C_5$-$C_{12}$ bridged cycloalkylenyl.

In another embodiment, the disclosure provides a compound of Formula XIII'''.

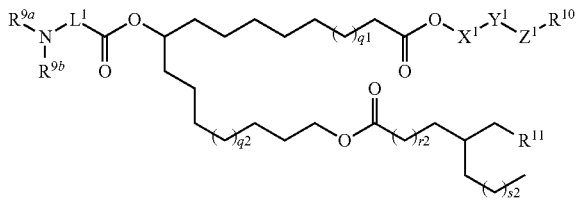

or a pharmaceutically acceptable salt or solvate thereof, wherein
- $q^1$ is 0, 1, 2, or 3;
- $q^2$ is 0, 1, 2, or 3;
- $r^2$ is 0, 1, or 2;
- $s^2$ is 0, 1, 2, 3, 4, 5, 6; and
- $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I or below.

In certain embodiments, the compound is a compound of Formula XIII''', wherein $Z^1$ is an optionally substituted $C_5$-$C_{12}$ bridged cycloalkylenyl.

In another embodiment, the disclosure provides a compound of Formula XIV:

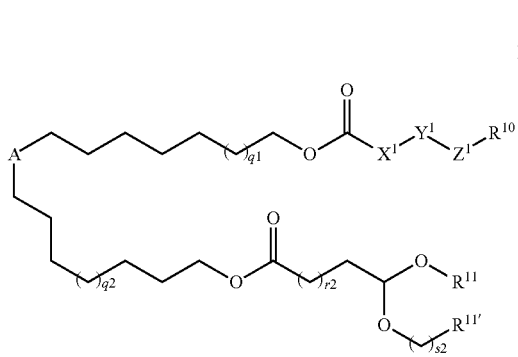

XIV or a pharmaceutically acceptable salt or solvate thereof, wherein
  $R^{11'}$ is selected from the group consisting of hydrogen, $C_1$-$C_{10}$ alkyl, and $C_2$-$C_{10}$ alkenyl;
  $q^1$ is 0, 1, 2, or 3;
  $q^2$ is 0, 1, 2, or 3,
  $r^2$ is 0, 1, or 2;
  $s^2$ is 0, 1, 2, 3, 4, 5, 6; and
  A, $X^1$, $Y^1$, $Z^1$, $R^{10}$, and $R^{11}$ are as defined herein in Formula IA, Formula IB, Formula IC, Formula ID, Formula I, or below.

In certain embodiments, the compound is a compound of Formula XIV, wherein $Z^1$ is an optionally substituted $C_5$-$C_{12}$ bridged cycloalkylenyl. In certain embodiments, $Z^1$ is not adamantyl.

In another embodiment, the disclosure provides a compound of Formula XIV':

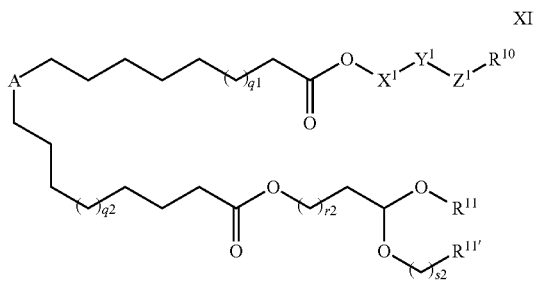

XIV' or a pharmaceutically acceptable salt or solvate thereof, wherein
  $R^{11'}$ is selected from the group consisting of hydrogen, $C_1$-$C_{10}$ alkyl, and $C_2$-$C_{10}$ alkenyl;
  $q^1$ is 0, 1, 2, or 3;
  $q^2$ is 0, 1, 2, or 3;
  $r^2$ is 0, 1, or 2;
  $s^2$ is 0, 1, 2, 3, 4, 5, 6; and
  A, $X^1$, $Y^1$, $Z^1$, $R^{10}$, and $R^{11}$ are as defined herein in Formula IA, Formula IB, Formula IC, Formula ID, Formula I, or below.

In certain embodiments, the compound is a compound of Formula XIV', wherein $Z^1$ is an optionally substituted $C_5$-$C_{12}$ bridged cycloalkylenyl. In certain embodiments, $Z^1$ is not adamantyl.

In another embodiment, the disclosure provides a compound of Formula XIV":

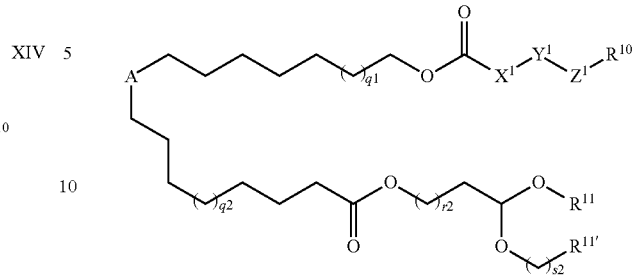

XIV"

or a pharmaceutically acceptable salt or solvate thereof, wherein
  $R^{11'}$ is selected from the group consisting of hydrogen, $C_1$-$C_{10}$ alkyl, and $C_2$-$C_{10}$ alkenyl;
  q is 0, 1, 2, or 3;
  $q^2$ is 0, 1, 2, or 3;
  $r^2$ is 0, 1, or 2;
  is 0, 1, 2, 3, 4, 5, 6; and
  A, $X^1$, $Y^1$, $Z^1$, $R^{10}$, and $R^{11}$ are as defined herein in Formula IA, Formula IB, Formula IC, Formula ID, Formula I or below.

In certain embodiments, the compound is a compound of Formula XIV"', wherein $Z^1$ is an optionally substituted $C_5$-$C_{12}$ bridged cycloalkylenyl. In certain embodiments, $Z^1$ is not adamantyl.

In another embodiment, the disclosure provides a compound of Formula XIV''':

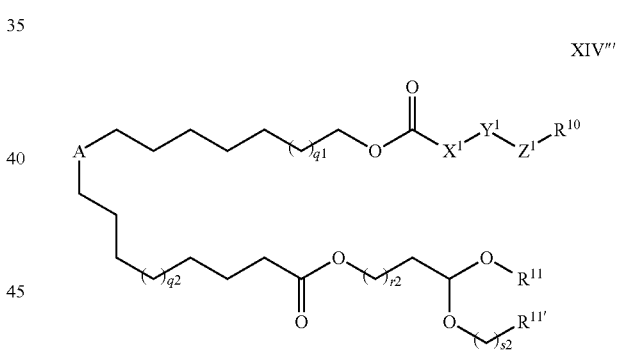

XIV''' or a pharmaceutically acceptable salt or solvate thereof, wherein
  $R^{11'}$ is selected from the group consisting of hydrogen, $C_1$-$C_{10}$ alkyl, and C2-$C_{10}$ alkenyl;
  q is 0, 1, 2, or 3;
  $q^2$ is 0, 1, 2, or 3;
  $r^2$ is 0, 1, or 2;
  $s^2$ is 0, 1, 2, 3, 4, 5, 6; and
  A, $X^1$, $Y^1$, $Z^1$, $R^{10}$, and $R^{11}$ are as defined herein in Formula IA, Formula IB, Formula IC, Formula ID, Formula I or below.

In certain embodiments, the compound is a compound of Formula XIV''', wherein $Z^1$ is an optionally substituted $C_5$-$C_{12}$ bridged cycloalkylenyl. In certain embodiments, $Z^1$ is not adamantyl.

In another embodiment, the disclosure provides a compound of Formula XV:

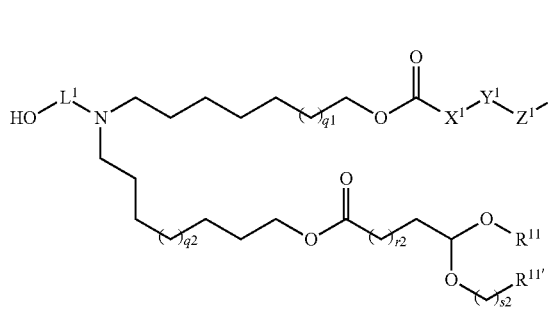

XV or a pharmaceutically acceptable salt or solvate thereof,
wherein
  $R^{11'}$ is selected from the group consisting of hydrogen, $C_1$-$C_{10}$ alkyl, and $C_2$-$C_{10}$ alkenyl,
  $q^1$ is 0, 1, 2, or 3;
  $q^2$ is 0, 1, 2, or 3,
  $r^2$ is 0, 1, or 2;
  $s^2$ is 0, 1, 2, 3, 4, 5, 6; and
  $L^1$, $X^1$, $Y^1$, $Z^1$, $R^{10}$ and $R^{11}$ are as defined herein in Formula IA, Formula IB, Formula, IC, Formula I or below; wherein $Z^1$ is not adamantyl.

In another embodiment, the disclosure provides a compound of Formula XV':

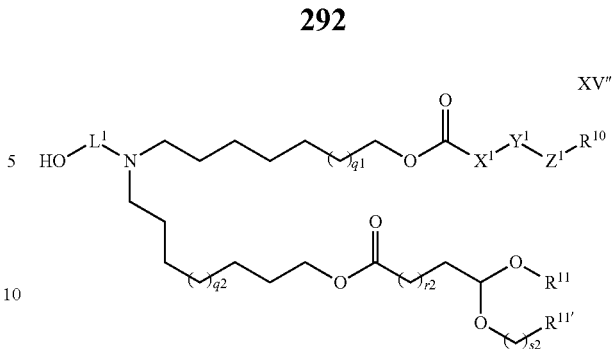

XV″ or a pharmaceutically acceptable salt or solvate thereof,
wherein
  $R^1$ is selected from the group consisting of hydrogen, $C_1$-$C_{10}$ alkyl, and $C_2$-$C_{10}$ alkenyl;
  $q^1$ is 0, 1, 2, or 3;
  $q^2$ is 0, 1, 2, or 3;
  $r^2$ is 0, 1, or 2;
  $s^2$ is 0, 1, 2, 3, 4, 5, 6; and
  $L^1$, $X^1$, $Y^1$, $Z^1$, $R^{10}$ and $R^{11}$ are as defined herein in Formula IA, Formula IB, Formula, IC, Formula I or below;
wherein $Z^1$ is not adamantyl.

In another embodiment, the disclosure provides a compound of Formula XV‴:

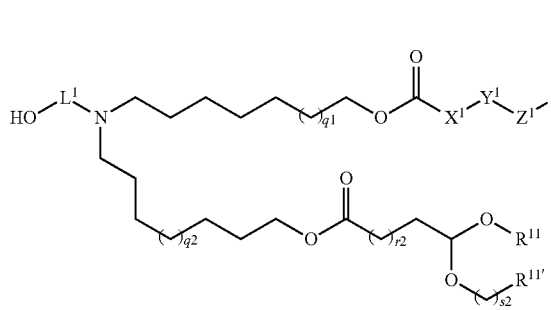

XV' or a pharmaceutically acceptable salt or solvate thereof,
wherein
  $R^{11'}$ is selected from the group consisting of hydrogen, $C_1$-$C_{10}$ alkyl, and $C_2$-$C_{10}$ alkenyl;
  $q^1$ is 0, 1, 2, or 3;
  $q^2$ is 0, 1, 2, or 3;
  $r^2$ is 0, 1, or 2;
  $s^2$ is 0, 1, 2, 3, 4, 5, 6; and
  $L^1$, $X^1$, $Y^1$, $Z^1$, $R^{10}$ and $R^{11}$ are as defined herein in Formula IA, Formula IB, Formula, IC, Formula I or below;
wherein $Z^1$ is not adamantyl.

In another embodiment, the disclosure provides a compound of Formula XV″:

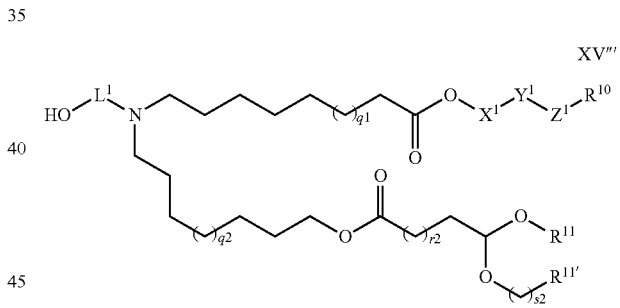

XV‴ or a pharmaceutically acceptable salt or solvate thereof,
wherein
  $R^{11'}$ is selected from the group consisting of hydrogen, $C_1$-$C_{10}$ alkyl, and $C_2$-$C_{10}$ alkenyl;
  $q^1$ is 0, 1, 2, or 3;
  $q^2$ is 0, 1, 2, or 3;
  $r^2$ is 0, 1, or 2;
  $s^2$ is 0, 1, 2, 3, 4, 5, 6; and
  $L$, $X^1$, $Y^1$, $Z^1$, $R^{10}$ and $R^{11}$ are as defined herein in Formula IA, Formula IB, Formula, IC, Formula I or below;
wherein $Z^1$ is not adamantyl.

In another embodiment, the disclosure provides a compound of Formula XVI:

XVI

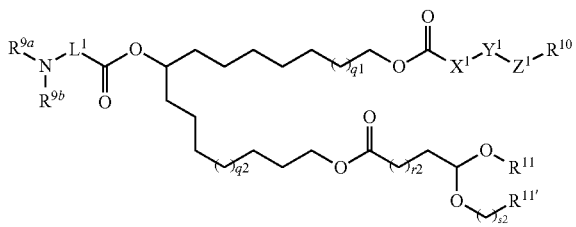

or a pharmaceutically acceptable salt or solvate thereof, wherein $R^{11'}$ is selected from the group consisting of hydrogen, $C_1$-$C_{10}$ alkyl, and $C_2$-$C_{10}$ alkenyl;

$q^1$ is 0, 1, 2, or 3;

$q^2$ is 0, 1, 2, or 3;

$r^2$ is 0, 1, or 2;

$s^2$ is 0, 1, 2, 3, 4, 5, 6; and $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I, or below.

In another embodiment, the disclosure provides a compound of Formula XVI':

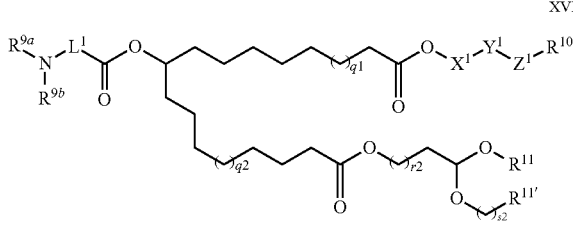

or a pharmaceutically acceptable salt or solvate thereof, wherein $R^{11'}$ is selected from the group consisting of hydrogen, $C_1$-$C_{10}$ alkyl, and $C_2$-$C_{10}$ alkenyl;

$q^1$ is 0, 1, 2, or 3;

$q^2$ is 0, 1, 2, or 3;

$r^2$ is 0, 1, or 2;

$s^2$ is 0, 1, 2, 3, 4, 5, 6; and $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I, or below.

In another embodiment, the disclosure provides a compound of Formula XVI":

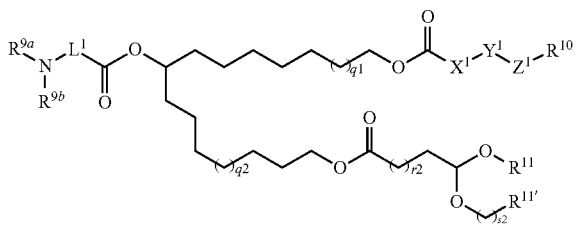

or a pharmaceutically acceptable salt or solvate thereof, wherein $R^{11'}$ is selected from the group consisting of hydrogen, $C_1$-$C_{10}$ alkyl, and $C_2$-$C_{10}$ alkenyl;

$q^1$ is 0, 1, 2, or 3;

$q^2$ is 0, 1, 2, or 3;

$r^2$ is 0, 1, or 2;

$s^2$ is 0, 1, 2, 3, 4, 5, 6; and $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I, or below.

In another embodiment, the disclosure provides a compound of Formula XVI''':

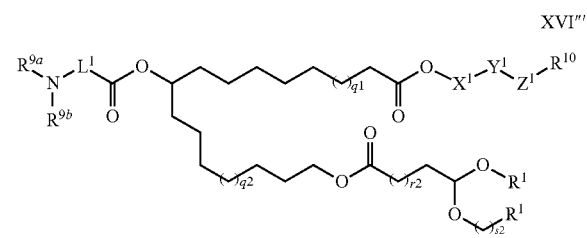

or a pharmaceutically acceptable salt or solvate thereof, wherein $R^{11'}$ is selected from the group consisting of hydrogen, $C_1$-$C_{10}$ alkyl, and $C_2$-$C_{10}$ alkenyl;

$q^1$ is 0, 1, 2, or 3;

$q^2$ is 0, 1, 2, or 3;

$r^2$ is 0, 1, or 2;

$s^2$ is 0, 1, 2, 3, 4, 5, 6; and $L^1$, $X^1$, $Y^1$, $Z^1$, $R^{9a}$, $R^{9b}$, $R^{10}$ and $R^{11}$ are as defined herein in Formula IA, Formula IB, Formula IC, Formula ID, Formula I, or below.

In another embodiment, the disclosure provides a compound of Formula XVII:

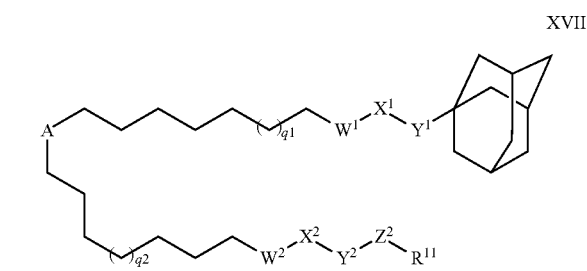

or a pharmaceutically acceptable salt or solvate thereof, wherein $q^1$ is 0, 1, 2, or 3;

$q^2$ is 0, 1, 2, or 3;

A, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In certain embodiments, the compound is a compound of Formula XVII, wherein one or more methylene linkages of $X^2$, $Y^2$, $Z^2$, and $R^{11}$, are not replaced with a group selected from —O—, —CH=CH—, —S— and $C_3$-$C_6$ cycloalkylenyl.

In another embodiment, the disclosure provides a compound of Formula XVIII:

XVIII

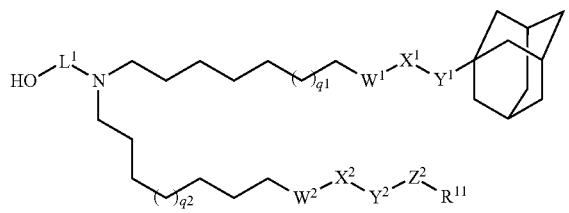

or a pharmaceutically acceptable salt or solvate thereof, wherein
$q^1$ is 0, 1, 2, or 3;
$q^2$ is 0, 1, 2, or 3;
$L^1$, $X^1$, $X^2$, $Y^1$, $Y^2$, $Z^2$, an $R^{11}$ are as defined herein in Formula IA, Formula IB, Formula IC, Formula ID, Formula I, or below.

In certain embodiments, the compound is a compound of Formula XVIII, wherein one or more methylene linkages of $X^2$, $Y^2$, $Z^2$, and $R^{11}$, are not replaced with a group selected from —O—, —CH=CH—, —S— and $C_3$-$C_6$ cycloalkylenyl.

In another embodiment, the disclosure provides a compound of Formula XVIII':

XVIII'

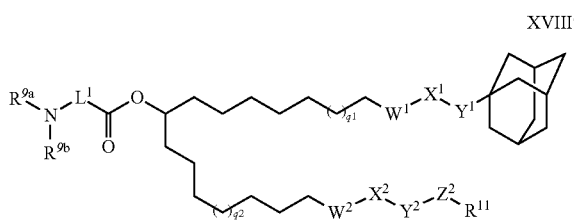

or a pharmaceutically acceptable salt or solvate thereof, wherein
$q^1$ is 0, 1, 2, or 3;
$q^2$ is 0, 1, 2, or 3;
A, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In another embodiment, the disclosure provides a compound of Formula XIX:

XIX

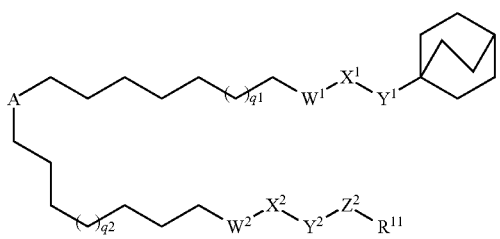

or a pharmaceutically acceptable salt or solvate thereof, wherein
$q^1$ is 0, 1, 2, or 3;
$q^2$ is 0, 1, 2, or 3,
A, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

In another embodiment, the disclosure provides a compound of Formula XX:

XX

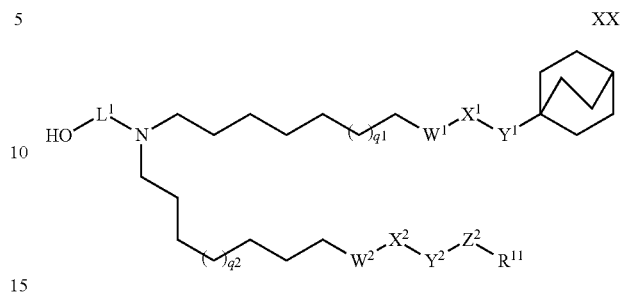

or a pharmaceutically acceptable salt or solvate thereof, wherein
$q^1$ is 0, 1, 2, or 3;
$q^2$ is 0, 1, 2, or 3;
$L^1$, $X^1$, $X^2$, $Y^1$, $Y^2$, $Z^2$, an $R^{11}$ are as defined herein in Formula IA, Formula IB, Formula IC, Formula ID, Formula I, or below.

In another embodiment, the disclosure provides a compound of Formula XXI:

XXI

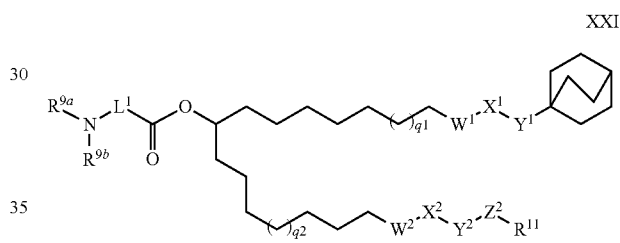

or a pharmaceutically acceptable salt or solvate thereof, wherein
$q^1$ is 0, 1, 2, or 3;
$q^2$ is 0, 1, 2, or 3;
A, $X^1$, $X^2$, $Y^1$, $Y^2$, $Z^1$, $Z^2$, $R^{10}$, an $R^{11}$ are as defined herein in Formula IA, Formula IB, Formula IC, Formula ID, Formula I, or below.

$L^1$

In another embodiment, $L^1$ is selected from the group consisting of —CH$_2$CH$_2$—, —CH$_2$CH$_2$CH$_2$—, and —CH$_2$CH$_2$CH$_2$CH$_2$—. In another embodiment, $L^1$ is —CH$_2$CH$_2$—. In another embodiment, $L^1$ is —CH$_2$CH$_2$CH$_2$—. In another embodiment, $L^1$ is —CH$_2$CH$_2$CH$_2$CH$_2$—. In certain embodiments, $L^1$ is —(CH$_2$)$_{2-6}$-OC(=O)—. In some embodiments, $L^1$ is —(CH$_2$)$_2$—OC(=O)—.

$R^1$

In some embodiments, $R^1$ is

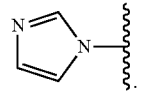

In another embodiment, $R^1$ is —OH. In some embodiments, $R^1$ is —N($R^{9a}$)($R^{9b}$). In some embodiments, $R^1$ is —NMe$_2$. In some embodiments, $R^1$ is -NEt$_2$. In another embodiment, $R^1$ is In another embodiment, $R^1$ is

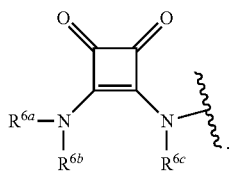

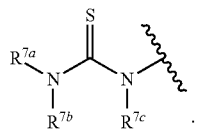

$L^2$

In another embodiment, $L^2$ is selected from the group consisting of —$CH_2CH_2$—, —$CH_2CH_2CH_2$—, and —$CH_2CH_2CH_2CH_2$—. In another embodiment, $L^2$ is —$CH_2CH_2$—. In another embodiment, $L^2$ is —$CH_2CH_2CH_2$—. In another embodiment, $L^2$ is —$CH_2CH_2CH_2CH_2$—.

$R^8$

In some embodiments, $R^8$ is

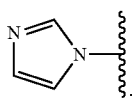 [SMILES: *n1ccnc1]

In another embodiment, $R^8$ is —$NR^{9a}R^{9b}$ In some embodiments, $R^8$ is —$NMe_2$. In some embodiments, $R^8$ is -$NEt_2$. In another embodiment, $R^8$ is —OH.

$R^{9a}, R^{9b}$

In another embodiment, $R^{9a}$ and $R^{9b}$ are independently selected from the group consisting of hydrogen and $C_1$-$C_4$ alkyl. In another embodiment, $R^{9a}$ and $R^{9b}$ are each methyl. In another embodiment, $R^{9a}$ and $R^{9b}$ are each ethyl.

R'

In another embodiment, R' is hydrogen. In some embodiments, R' is $C_1$-$C_6$ alkyl.

$Q^1$

In another embodiment, $Q^1$ is straight chain $C_1$-$C_{20}$ alkylenyl. In another embodiment, $Q^1$ is straight chain $C_1$-$C_{10}$ alkylenyl. In another embodiment, $Q^1$ is $C_1$-$C_{10}$ alkylenyl. In another embodiment, $Q^1$ is $C_2$-$C_5$ alkylenyl. $Q^1$ is $C_6$-$C_9$ alkylenyl. In another embodiment, $Q^1$ is selected from the group consisting of —$CH_2CH_2$—, —$CH_2CH_2CH_2$—, —$CH_2(CH_2)_2CH_2$—, —$CH_2(CH_2)_3CH_2$—, —$CH_2(CH_2)_4CH_2$—, —$CH_2(CH_2)_5CH_2$—, —$CH_2(CH_2)_6CH_2$—, —$CH_2(CH_2)_7CH_2$—, and —$CH_2(CH_2)_8CH_2$—. In another embodiment, $Q^1$ is —$CH_2CH_2$—. In another embodiment, $Q^1$ is —$CH_2CH_2CH_2$—. In another embodiment, $Q^1$ is —$CH_2(CH_2)_2CH_2$—. In another embodiment, $Q^1$ is —$CH_2(CH_2)_3CH_2$—. In another embodiment, $Q^1$ is —$CH_2CH_2$—. In another embodiment, $Q^1$ is —$CH_2(CH_2)_4CH_2$—. In another embodiment, $Q^1$ is —$CH_2(CH_2)_5CH_2$—. In another embodiment, $Q^1$ is —$CH_2(CH_2)_6CH_2$—. In another embodiment, $Q^1$ is —$CH_2(CH_2)_7CH_2$—. In another embodiment, $Q^1$ is —$CH_2(CH_2)_8CH_2$—.

$W^1$

In another embodiment, $W^1$ is selected from the group consisting of —C(=O)O—, —OC(=O)—, —C(=O)N($R^{12a}$)—, —N($R^{12a}$)C(=O)—, —OC(=O)N($R^{12a}$)—, —N($R^{12a}$)C(=O)O—, and —OC(=O)O—. In another embodiment, $W^1$ is —C(=O)O—. In another embodiment, $W^1$ is —OC(=O)—. In another embodiment, $W^1$ is —C(=O)N($R^{12a}$)—. In another embodiment, $W^1$ is —N($R^{12a}$)C(=O)—. In another embodiment, $W^1$ is —OC(=O)N($R^{12a}$)—. In another embodiment, $W^1$ is —N($R^{12a}$)C(=O)O—. In another embodiment, $W^1$ is —OC(=O)O—.

$X^1$

In another embodiment, $X^2$ is optionally substituted $C_1$-$C_{15}$ alkylenyl. In another embodiment, $X^2$ is branched $C_1$-$C_{15}$ alkylenyl. In another embodiment, $X^1$ is a bond or $C_1$-$C_{15}$ alkylenyl. In another embodiment, $X^1$ is a bond. In another embodiment, $X^1$ is $C_2$-$C_5$ alkylenyl. In another embodiment, $X^1$ is $C_6$-$C_9$ alkylenyl. In another embodiment, $X^1$ is —$CH_2$—. In another embodiment, $X^2$ is —$CH_2CH_2$—. In another embodiment, $X^2$ is —$CH_2CH_2CH_2$—. In another embodiment, $X^2$ is —$CH_2CH_2CH_2CH_2$—. In another embodiment, $X^2$ is —$CH_2CH_2CH_2CH_2CH_2$—.

$Y^1$

In another embodiment, $Y^1$ is selected from the group consisting of —$(CH_2)_m$—, —O—, —S—, and —S—S—. In another embodiment, $Y^1$ is —$(CH_2)_m$—. In some embodiments, $Y^1$ is —O—. In some embodiments, $Y^1$ is —S—. In another embodiment, $Y^1$ is —$CH_2$—. In another embodiment, $Y^2$ is —$CH_2CH_2$—.

m

In another embodiment, m is 0. In another embodiment, m is 1. In another embodiment, m is 2. In another embodiment, m is 3. In another embodiment, m is 4. In another embodiment, m is 5. In another embodiment, m is 6.

n

In another embodiment, n is 0. In another embodiment, n is 1. In another embodiment, n is 2. In another embodiment, n is 3. In another embodiment, n is 4. In another embodiment, n is 5. In another embodiment, n is 6.

p

In another embodiment, p is 0. In another embodiment, p is 1.

$Z^1$

In another embodiment, $Z^1$ is selected from the group consisting of $C_4$-$C_{12}$ cycloalkylenyl,

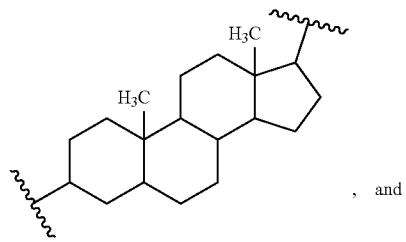

, and

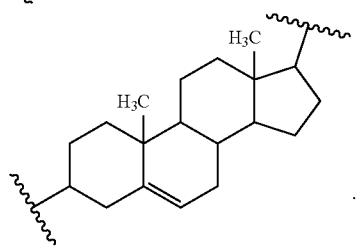

.

In certain embodiments, $Z^1$ is optionally substituted.

In another embodiment, $Z^1$ is

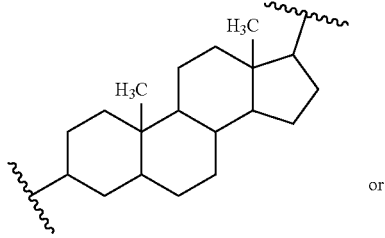

or

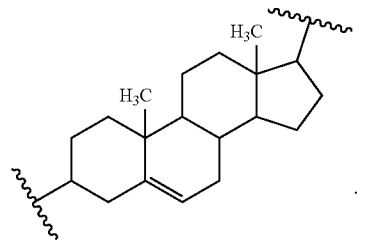

.

In another embodiment, $Z^1$ is $C_4$-$C_{12}$ cycloalkylenyl. In another embodiment, $Z^1$ is a monocyclic $C_4$-$C_8$ cycloalkylenyl. In another embodiment, $Z^1$ is a monocyclic $C_4$-$C_6$ cycloalkylenyl. In another embodiment, $Z^1$ is a monocyclic $C_4$ cycloalkylenyl. In another embodiment, $Z^1$ is a monocyclic $C_5$ cycloalkylenyl. In another embodiment, $Z^1$ is a monocyclic $C_6$ cycloalkylenyl.

In another embodiment, $Z^1$ is an optionally substituted bridged bicyclic or multicyclic cycloalkylenyl. In some embodiments, $Z^1$ is optionally substituted $C_5$-$C_{12}$ bridged cycloalkylenyl. In some embodiments, $Z^1$ is optionally substituted $C_6$-$C_{10}$ bridged cycloalkylenyl. In some embodiments, $Z^1$ is a optionally substituted $C_5$-$C_{10}$ bridged cycloalkylenyl. selected from the group consisting of adamantyl, cubanyl, bicyclo[2.2.1]heptyl, bicyclo[2.2.2]octyl, bicyclo[1.1.1]pentyl, bicyclo[3.2.1]octyl, and bicyclo[3.1.1]heptyl.

In another embodiment, $Z^1$ is selected from the group consisting of:

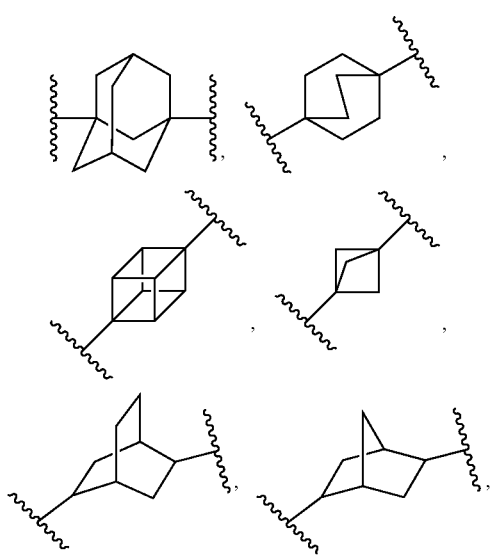

-continued

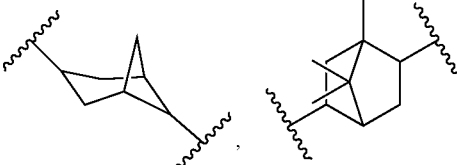

,

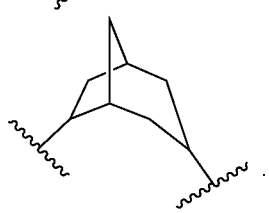

, or

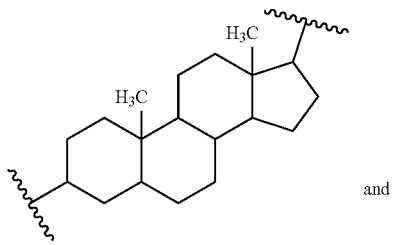

.

In another embodiment, $Z^1$ is selected from the group consisting of:

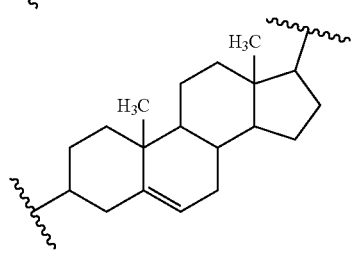

and

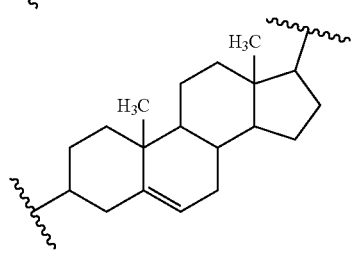

.

$R^{10}$

In another embodiment, $R^{10}$ is hydrogen.
In another embodiment, $R^{10}$ is $C_1$-$C_{10}$ alkyl. In another embodiment, $R^{10}$ is $C_3$-$C_7$ alkyl. In another embodiment, $R^{10}$ is $C_4$-$C_6$ alkyl. In another embodiment, $R^{10}$ is $C_4$. In another embodiment, $R^{10}$ is $C_5$. In another embodiment, $R^{10}$ is $C_6$.

In another embodiment, $R^{10}$ is $C_2$-$C_{12}$ alkenyl. In another embodiment, $R^{10}$ is $C_6$-$C_{12}$ alkenyl. In another embodiment, $R^{10}$ is $C_2$-$C_8$ alkenyl.
$R^{11}$ In another embodiment, $R^{11}$ is $C_1$-$C_{10}$ alkyl. In another embodiment, $R^{11}$ is optionally substituted $C_1$-$C_{20}$ alkyl. In another embodiment, $R^{11}$ is optionally substituted branched $C_1$-$C_{20}$ alkyl. In another embodiment, $R^{11}$ is optionally substituted $C_1$-$C_{15}$ alkyl. In another embodiment, $R^{11}$ is optionally substituted $C_1$-$C_{15}$ branched alkyl. In another embodiment, $R^{11}$ is optionally substituted $C_{10}$-$C_{15}$ alkyl. In another embodiment, $R^{11}$ is optionally substituted $C_{10}$-$C_{15}$ branched alkyl. In another embodiment, $R^{11}$ is selected from the group consisting of —$CH_3$, —$CH_2CH_3$, and —$CH_2CH_2CH_3$. In another embodiment, $R^{11}$ is selected from the group consisting of —$CH_2(CH_2)_2CH_3$, —$CH_2(CH_2)_3CH_3$, —$CH_2(CH_2)_4CH_3$, —$CH_2(CH_2)_5CH_3$, —$CH_2(CH_2)_6CH_3$, —$CH_2(CH_2)_7CH_3$, and —$CH_2(CH_2)_8CH_3$. In another embodiment, $R^{11}$ is —$CH_3$. In another embodiment, $R^{11}$ is —CH₂CH₃. In another embodiment, $R^{11}$ is —CH₂CH₂CH₃. In another embodiment, $R^{11}$ is —CH₂(CH₂)₂CH₃. In another embodiment, $R^{11}$ is —CH₂(CH₂)₃CH₃. In another embodiment, $R^{11}$ is —CH₂(CH₂)₄CH₃. In another embodiment, $R^{11}$ is —CH₂(CH₂)₅CH₃. In another embodiment, $R^{11}$ is CH₂(CH₂)₆CH₃. In another embodiment, $R^{11}$ is —CH₂(CH₂)₇CH₃. In another embodiment, $R^{11}$ is —CH₂(CH₂)₈CH₃.

In another embodiment, $R^{11}$ is $C_2$-$C_{10}$ alkenyl. In another embodiment, $R^{11}$ is $C_2$-$C_{12}$ alkenyl. In another embodiment, $R^{11}$ is $C_6$-$C_{12}$ alkenyl. In another embodiment, $R^{11}$ is $C_2$-$C_8$ alkenyl. In another embodiment, the disclosure provides a compound of any one of Formulae IA, IB, IC, or I-XXI or a pharmaceutically acceptable salt or solvate thereof, wherein $R^{11}$ is hydrogen.

$Q^2$

In another embodiment, $Q^2$ is straight chain $C_1$-$C_{20}$ alkylenyl. In another embodiment, $Q^2$ is straight chain $C_1$-$C_{10}$ alkylenyl. In another embodiment, $Q^2$ is $C_2$-$C_{10}$ alkylenyl. In another embodiment, $Q^2$ is selected from the group consisting of —CH₂CH₂—, —CH₂CH₂CH₂—, —CH₂(CH₂)₂CH₂—, —CH₂(CH₂)₃CH₂—, —CH₂(CH₂)₄CH₂—, —CH₂(CH₂)₅CH₂—, —CH₂(CH₂)₆CH₂—, —CH₂(CH₂)₇CH₂—, and —CH₂(CH₂)₈CH₂—. In another embodiment, $Q^2$ is —CH₂CH₂—. In another embodiment, $Q^2$ is —CH₂CH₂CH₂—. In another embodiment, $Q^2$ is —CH₂(CH₂)₃CH₂—. In another embodiment, $Q^2$ is —CH₂(CH₂)₄CH₂—. In another embodiment, $Q^2$ is —CH₂(CH₂)₅CH₂—. In another embodiment, $Q^2$ is —CH₂(CH₂)₆CH₂—. In another embodiment, $Q^2$ is —CH₂(CH₂)₇CH₂—. In another embodiment, $Q^2$ is —CH₂(CH₂)₈CH₂—.

$W^2$

In another embodiment, $W^2$ is selected from the group consisting of —C(=O)O— and —OC(=O)—. In another embodiment, $W^2$ is —C(=O)O—. In another embodiment, $W^2$ is —OC(=O)—.

$X^2$

In another embodiment, $X^2$ is optionally substituted $C_1$-$C_{15}$ alkylenyl. In another embodiment, $X^2$ is $C_1$-$C_{15}$ branched alkylenyl. In another embodiment, $X^2$ is $C_1$-$C_6$ alkylenyl or a bond. In another embodiment, $X^2$ is $C_2$-$C_4$ alkylenyl. In another embodiment, $X^2$ is $C_3$-$C_5$ alkylenyl. In another embodiment, $X^2$ is selected from the group consisting of —CH₂CH₂—, —CH₂CH₂CH₂—, —CH₂(CH₂)₂CH₂—, —CH₂(CH₂)₃CH₂—, and —CH₂(CH₂)₄CH₂—. In another embodiment, $X^2$ is —CH₂—. In another embodiment, $X^2$ is a bond. In another embodiment, $X^2$ is branched $C_1$-$C_{15}$ alkylenyl, wherein one or more methylene linkages of $X^2$ are optionally and independently replaced with a group selected from —O—, —CH=CH—, —S— and $C_3$-$C_6$ cycloalkylenyl.

$Y^2$

In another embodiment, $Y^2$ is selected from the group consisting of —(CH₂)ₘ— and —S—. In another embodiment, $Y^2$ is —(CH₂)ₘ—. In another embodiment, $Y^2$ is —S—.

$Z^2$

In another embodiment, $Z^2$ is —(CH₂)ₚ—. In another embodiment, $Z^2$ is —CH₂—. In another embodiment, $Z^2$ is —CH₂CH₂—. In another embodiment, $Z^2$ is $C_4$-$C_{12}$ cycloalkylenyl. In another embodiment, $Z^2$ is a monocyclic C4-$C_8$ cycloalkylenyl. In certain embodiments, $Z^2$ is optionally substituted.

In another embodiment, $Z^2$ is an optionally substituted bridged bicyclic or multicyclic cycloalkylenyl. In some embodiments, $Z^2$ is optionally substituted $C_5$-$C_{12}$ bridged cycloalkylenyl. In some embodiments, $Z^2$ is optionally substituted $C_6$-$C_{10}$ bridged cycloalkylenyl. In some embodiments, $Z^2$ is a optionally substituted $C_5$-$C_{10}$ bridged cycloalkylenyl. selected from the group consisting of adamantyl, cubanyl, bicyclo[2.2.1]heptyl, bicyclo[2.2.2]octyl, bicyclo[1.1.1]pentyl, bicyclo[3.2.1]octyl, and bicyclo[3.1.1]heptyl.

In another embodiment, $Z^2$ is selected from the group consisting of:

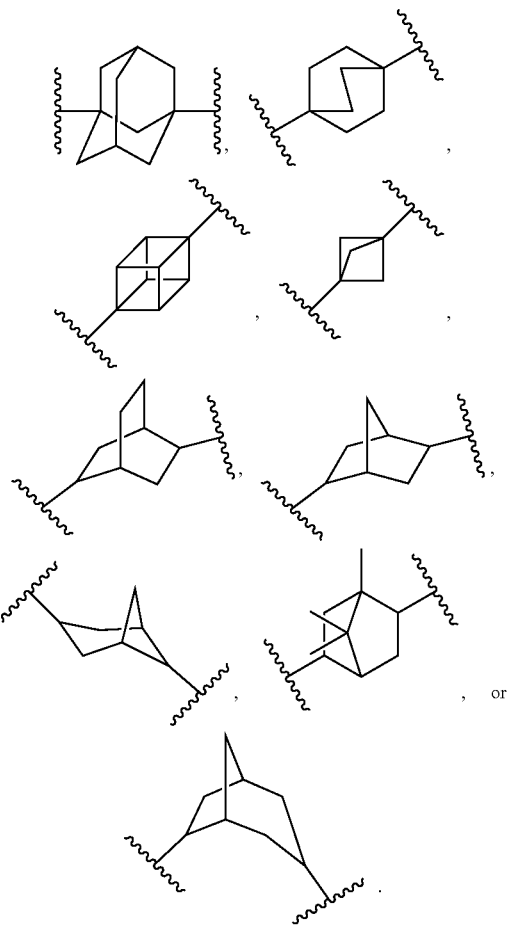

In another embodiment, $Z^2$ is selected from the group consisting of:

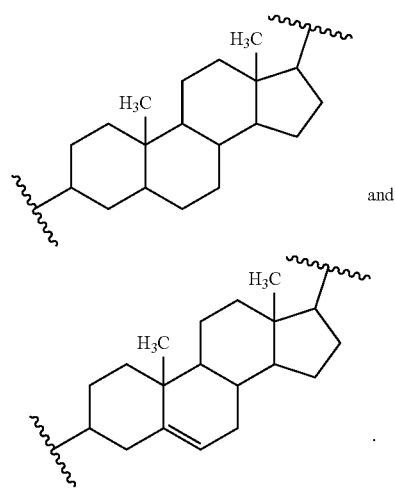

and

In another embodiment, the disclosure provides a compound selected from any one of more of the compounds of Table (III), or a pharmaceutically acceptable salt or solvate thereof.
TABLE (III)
Non-Limiting Examples of Ionizable Lipids with a Constrained Arm
| Compound No. | Structure |
|---|---|
| C1 | 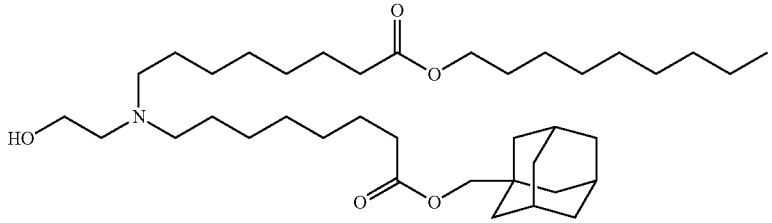 [SMILES: CCCCCCCCCOC(=O)CCCCCCCN(CCO)CCCCCCCC(=O)OCC12CC3CC(CC(C3)C1)C2] |
| C2 | 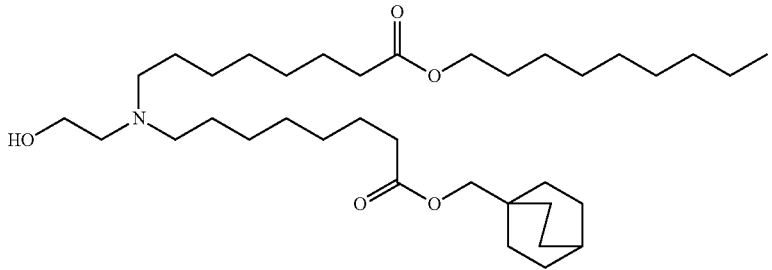 [SMILES: CCCCCCCCCOC(=O)CCCCCCCN(CCO)CCCCCCCC(=O)OCC12CCC(CC1)CC2] |
| C3 | 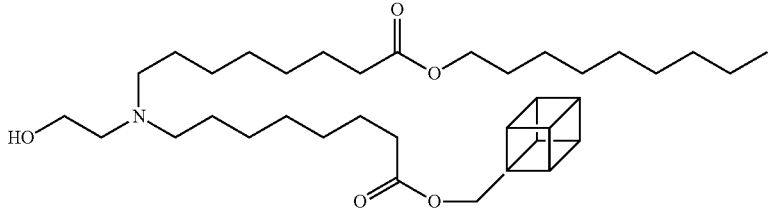 |
| C4 | 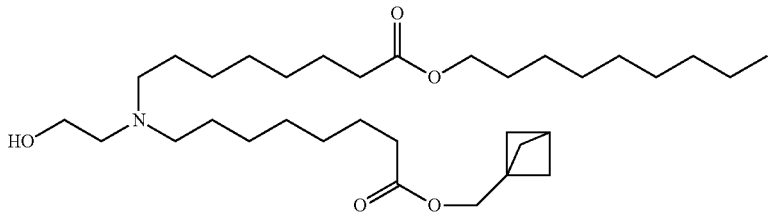 [SMILES: CCCCCCCCCOC(=O)CCCCCCCN(CCO)CCCCCCCC(=O)OCC12CC(C1)C2] |
| C5 | 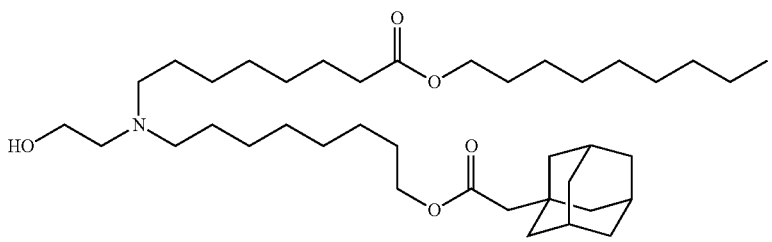 [SMILES: CCCCCCCCCOC(=O)CCCCCCCN(CCO)CCCCCCCCOC(=O)CC12CC3CC(CC(C3)C1)C2] |
| C6 | 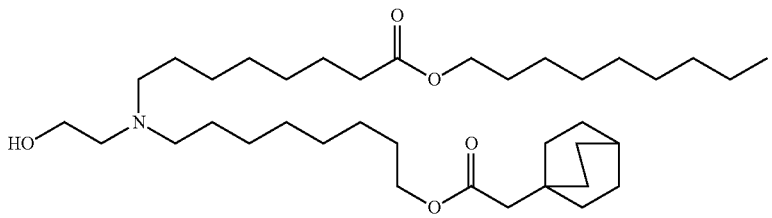 [SMILES: CCCCCCCCCOC(=O)CCCCCCCN(CCO)CCCCCCCCOC(=O)CC12CCC(CC1)CC2] |

TABLE (III)-continued

Non-Limiting Examples of Ionizable Lipids with a Constrained Arm

| Compound No. | Structure |
| --- | --- |
| C7 | 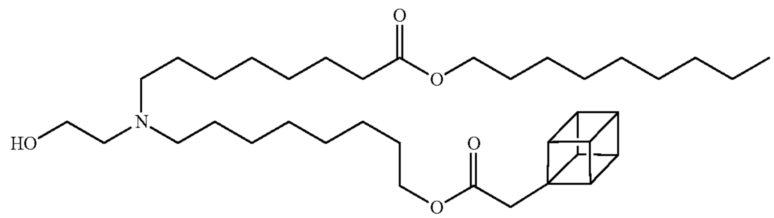 [SMILES: CCCCCCCCCOC(=O)CCCCCCCN(CCO)CCCCCCCCOC(=O)CC12C3C4C5C3C1C5C42] |
| C8 | 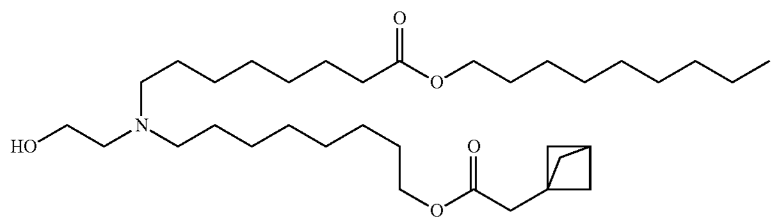 [SMILES: CCCCCCCCCOC(=O)CCCCCCCN(CCO)CCCCCCCCOC(=O)CC12CC(C1)C2] |
| C9 | 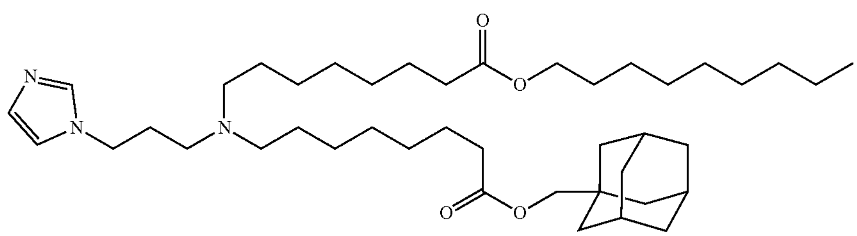 [SMILES: CCCCCCCCCOC(=O)CCCCCCCN(CCCCCCCC(=O)OCC12CC3CC(CC(C3)C1)C2)CCCn1ccnc1] |
| C10 | 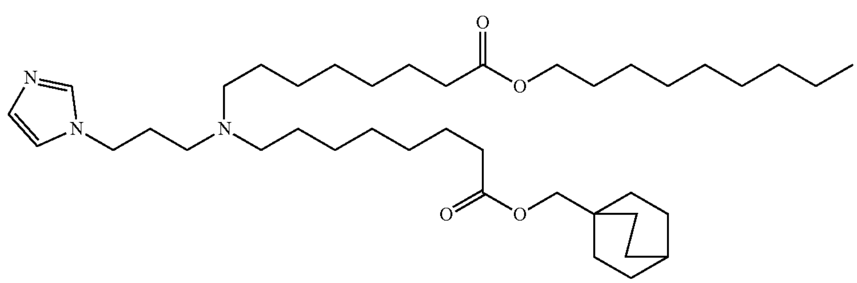 [SMILES: CCCCCCCCCOC(=O)CCCCCCCN(CCCCCCCC(=O)OCC12CCC(CC1)CC2)CCCn1ccnc1] |
| C11 | 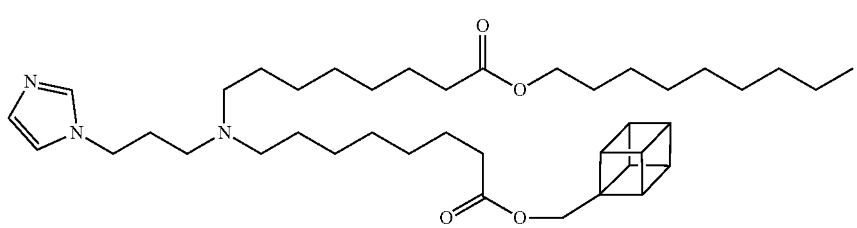 [SMILES: CCCCCCCCCOC(=O)CCCCCCCN(CCCCCCCC(=O)OCC12C3C4C5C3C1C5C42)CCCn1ccnc1] |
| C12 | 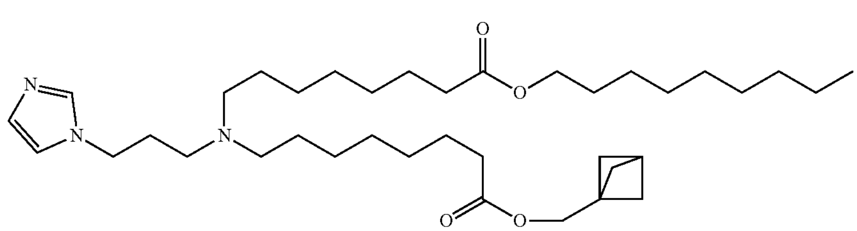 [SMILES: CCCCCCCCCOC(=O)CCCCCCCN(CCCCCCCC(=O)OCC12CC(C1)C2)CCCn1ccnc1] |

TABLE (III)-continued
Non-Limiting Examples of Ionizable Lipids with a Constrained Arm
| Compound No. | Structure |
|---|---|
| C13 | 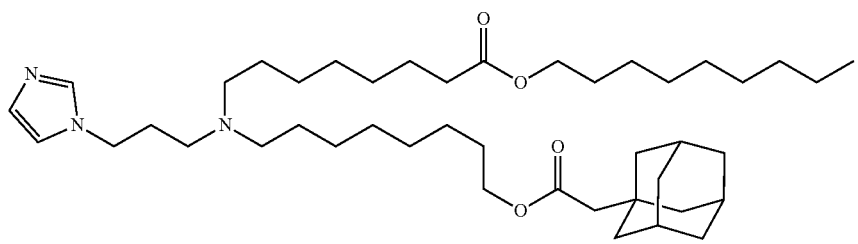 [SMILES: CCCCCCCCCOC(=O)CCCCCCCN(CCCCCCCCOC(=O)CC12CC3CC(CC(C3)C1)C2)CCCn1ccnc1] |
| C14 | 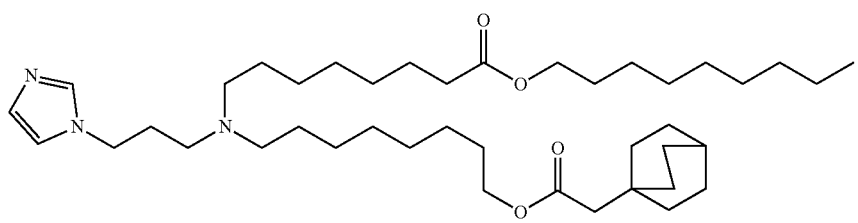 [SMILES: CCCCCCCCCOC(=O)CCCCCCCN(CCCCCCCCOC(=O)CC12CCC(CC1)CC2)CCCn1ccnc1] |
| C15 | 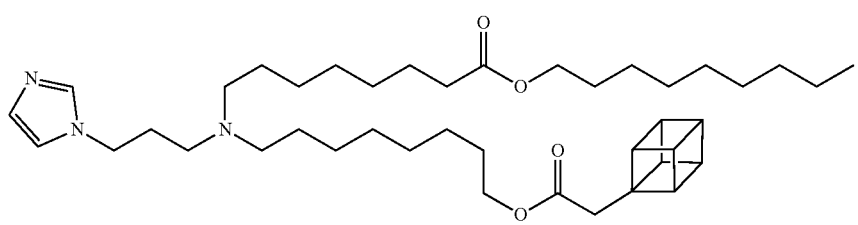 [SMILES: CCCCCCCCCOC(=O)CCCCCCCN(CCCCCCCCOC(=O)CC12C3C4C5C3C1C5C42)CCCn1ccnc1] |
| C16 | 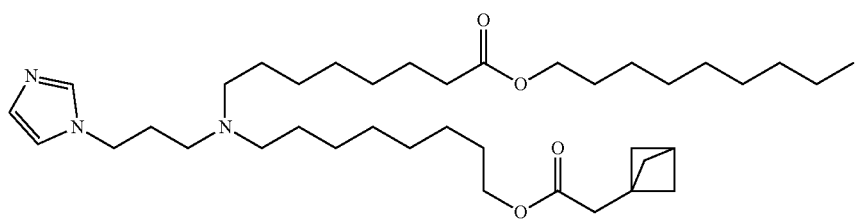 [SMILES: CCCCCCCCCOC(=O)CCCCCCCN(CCCCCCCCOC(=O)CC12CC(C1)C2)CCCn1ccnc1] |
| C17 | 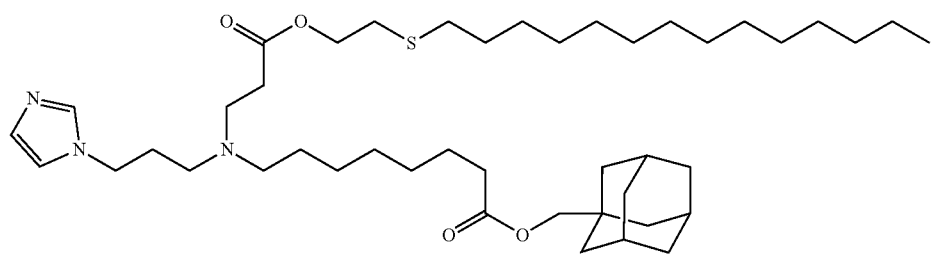 [SMILES: CCCCCCCCCCCCCCSCCOC(=O)CCN(CCCCCCCC(=O)OCC12CC3CC(CC(C3)C1)C2)CCCn1ccnc1] |
| C18 | 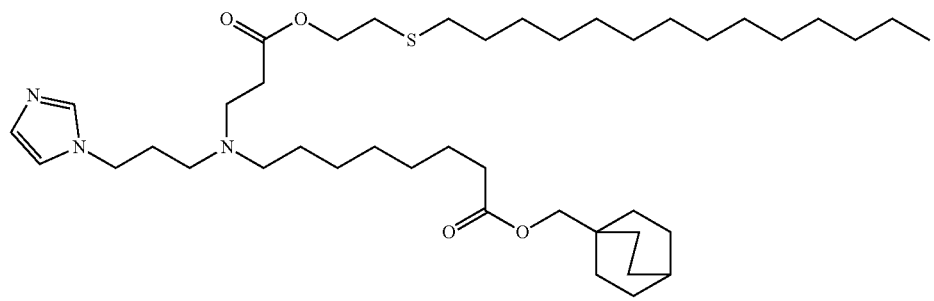 [SMILES: CCCCCCCCCCCCCCSCCOC(=O)CCN(CCCCCCCC(=O)OCC12CCC(CC1)CC2)CCCn1ccnc1] |

TABLE (III)-continued
Non-Limiting Examples of Ionizable Lipids with a Constrained Arm
| Compound No. | Structure |
|---|---|
| C19 | 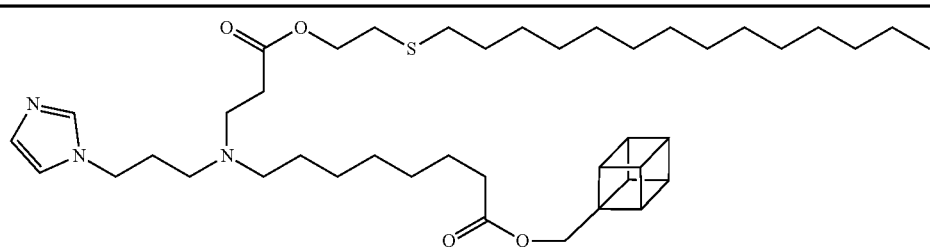 |
| C20 | 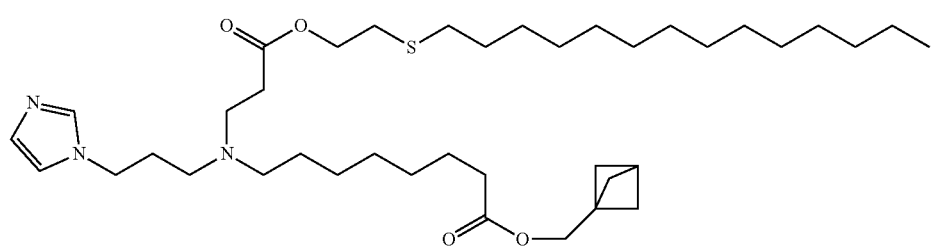 [SMILES: CCCCCCCCCCCCCCSCCOC(=O)CCN(CCCCCCCC(=O)OCC12CC(C1)C2)CCCn1ccnc1] |
| C21 | 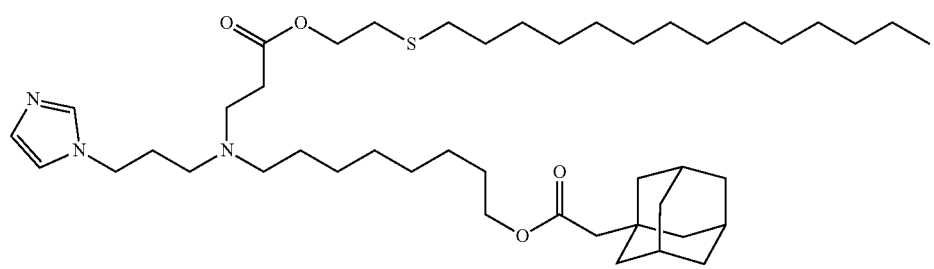 [SMILES: CCCCCCCCCCCCCCSCCOC(=O)CCN(CCCCCCCCOC(=O)CC12CC3CC(CC(C3)C1)C2)CCCn1ccnc1] |
| C22 | 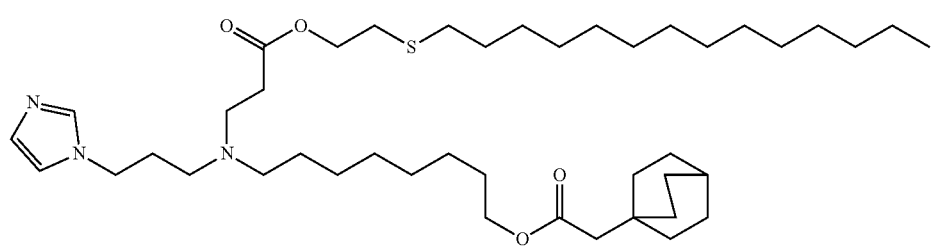 [SMILES: CCCCCCCCCCCCCCSCCOC(=O)CCN(CCCCCCCCOC(=O)CC12CCC(CC1)CC2)CCCn1ccnc1] |
| C23 | 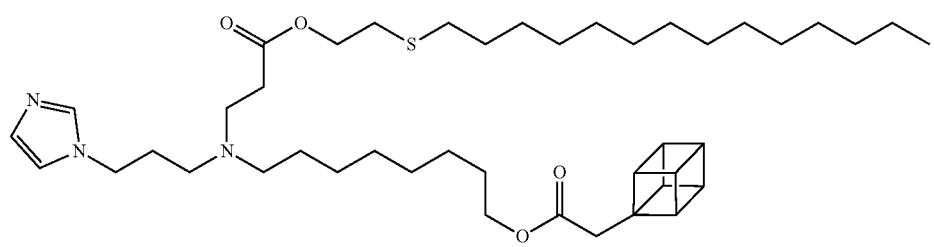 [SMILES: CCCCCCCCCCCCCCSCCOC(=O)CCN(CCCCCCCCOC(=O)CC12C3C4C5C3C1C5C42)CCCn1ccnc1] |
| C24 | 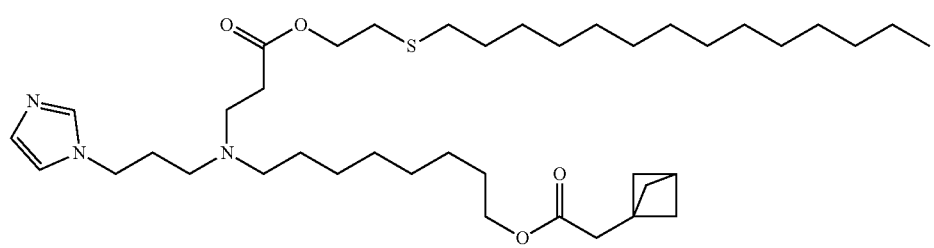 [SMILES: CCCCCCCCCCCCCCSCCOC(=O)CCN(CCCCCCCCOC(=O)CC12CC(C1)C2)CCCn1ccnc1] |

TABLE (III)-continued
Non-Limiting Examples of Ionizable Lipids with a Constrained Arm
| Compound No. | Structure |
|---|---|
| C25 | 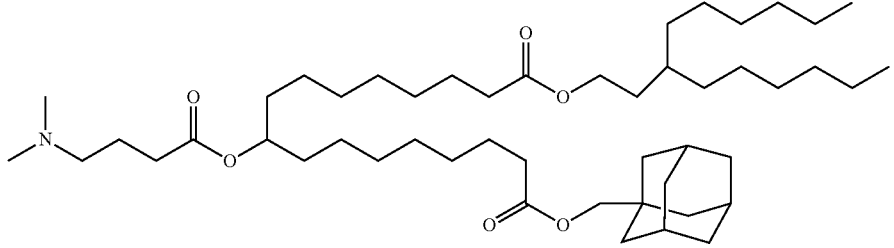 [SMILES: CCCCCCC(CCCCCC)CCOC(=O)CCCCCCCC(CCCCCCCC(=O)OCC12CC3CC(CC(C3)C1)C2)OC(=O)CCCN(C)C] |
| C26 | 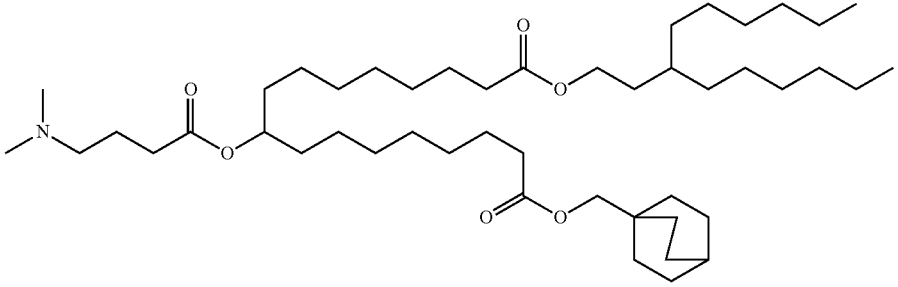 [SMILES: CCCCCCC(CCCCCC)CCOC(=O)CCCCCCCC(CCCCCCCC(=O)OCC12CCC(CC1)CC2)OC(=O)CCCN(C)C] |
| C27 | 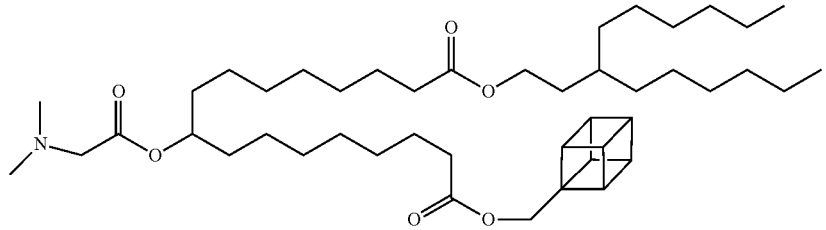 [SMILES: CCCCCCC(CCCCCC)CCOC(=O)CCCCCCCC(CCCCCCCC(=O)OCC12C3C4C5C3C1C5C42)OC(=O)CN(C)C] |
| C28 | 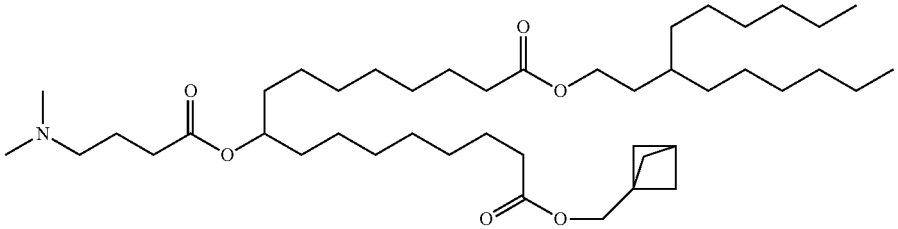 [SMILES: CCCCCCC(CCCCCC)CCOC(=O)CCCCCCCC(CCCCCCCC(=O)OCC12CC(C1)C2)OC(=O)CCCN(C)C] |
| C29 | 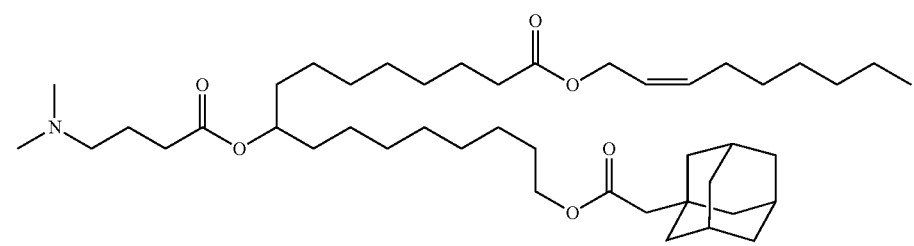 [SMILES: CCCCCC/C=C\COC(=O)CCCCCCCC(CCCCCCCCOC(=O)CC12CC3CC(CC(C3)C1)C2)OC(=O)CCCN(C)C] |
| C30 | 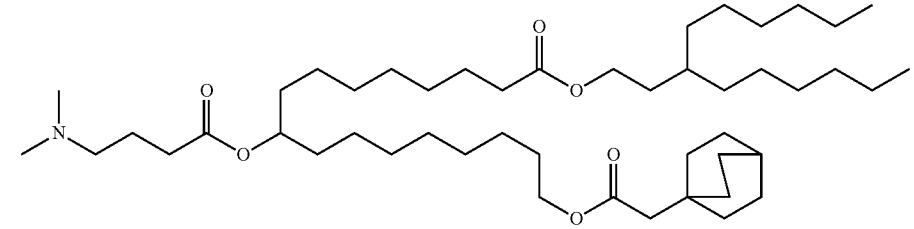 [SMILES: CCCCCCC(CCCCCC)CCOC(=O)CCCCCCCC(CCCCCCCCOC(=O)CC12CCC(CC1)CC2)OC(=O)CCCN(C)C] |

TABLE (III)-continued
Non-Limiting Examples of Ionizable Lipids with a Constrained Arm
| Compound No. | Structure |
|---|---|
| C31 | 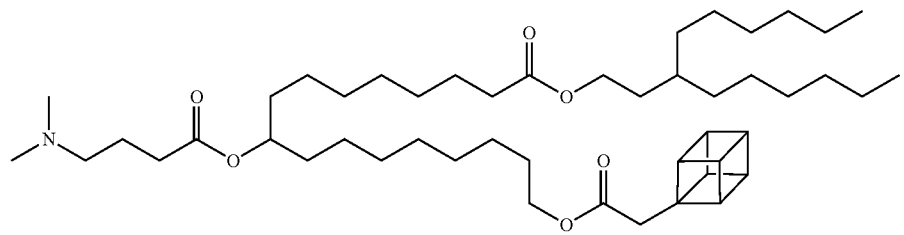 [SMILES: CCCCCCC(CCCCCC)CCOC(=O)CCCCCCCC(CCCCCCCCOC(=O)CC12C3C4C5C3C1C5C42)OC(=O)CCCN(C)C] |
| C32 | 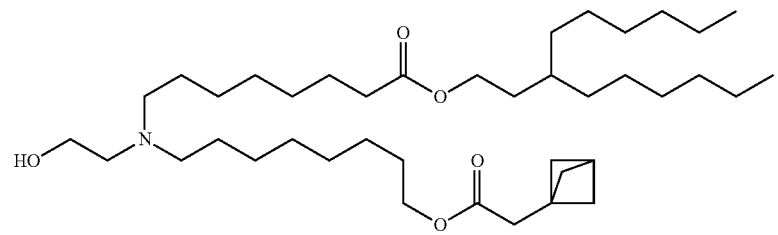 [SMILES: CCCCCCC(CCCCCC)CCOC(=O)CCCCCCCN(CCO)CCCCCCCCOC(=O)CC12CC(C1)C2] |
| C33 | 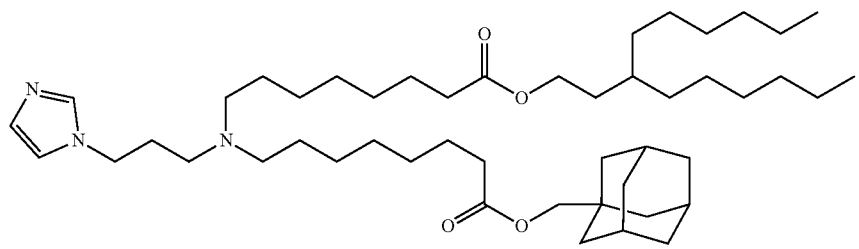 [SMILES: CCCCCCC(CCCCCC)CCOC(=O)CCCCCCCN(CCCCCCCC(=O)OCC12CC3CC(CC(C3)C1)C2)CCCn1ccnc1] |
| C34 | 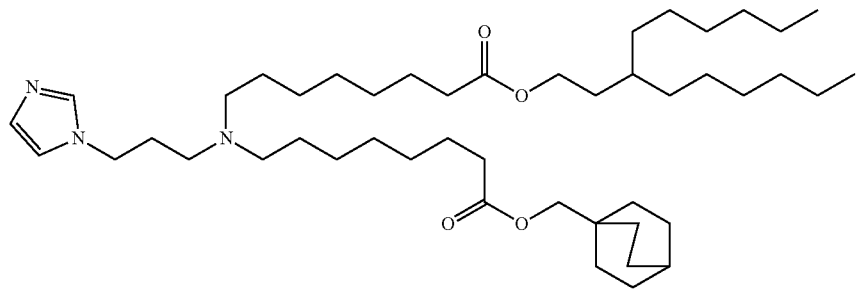 [SMILES: CCCCCCC(CCCCCC)CCOC(=O)CCCCCCCN(CCCCCCCC(=O)OCC12CCC(CC1)CC2)CCCn1ccnc1] |
| C35 | 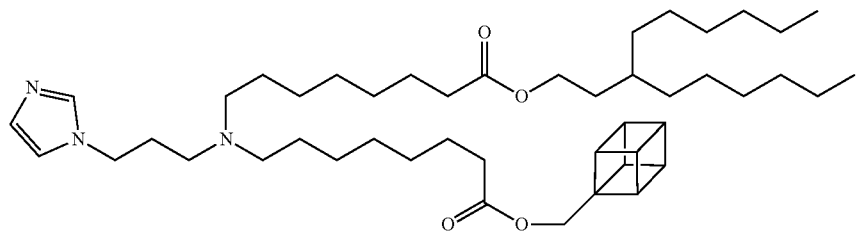 [SMILES: CCCCCCC(CCCCCC)CCOC(=O)CCCCCCCN(CCCCCCCC(=O)OCC12C3C4C5C3C1C5C42)CCCn1ccnc1] |
| C36 | 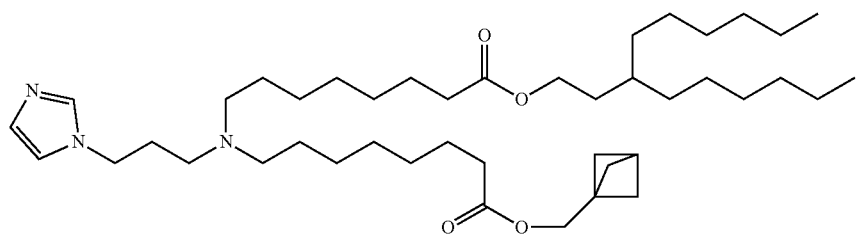 [SMILES: CCCCCCC(CCCCCC)CCOC(=O)CCCCCCCN(CCCCCCCC(=O)OCC12CC(C1)C2)CCCn1ccnc1] |

TABLE (III)-continued
Non-Limiting Examples of Ionizable Lipids with a Constrained Arm
| Compound No. | Structure |
|---|---|
| C37 | 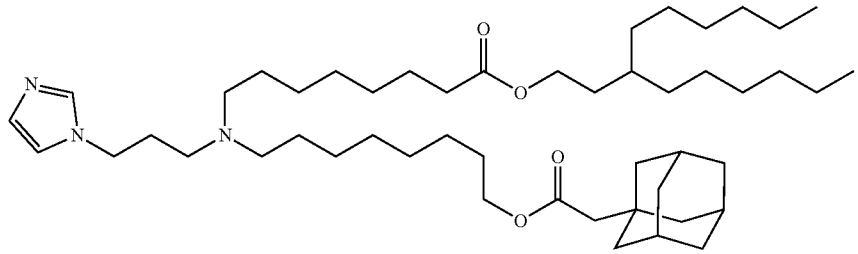 [SMILES: CCCCCCC(CCCCCC)CCOC(=O)CCCCCCCN(CCCCCCCCOC(=O)CC12CC3CC(CC(C3)C1)C2)CCCn1ccnc1] |
| C38 | 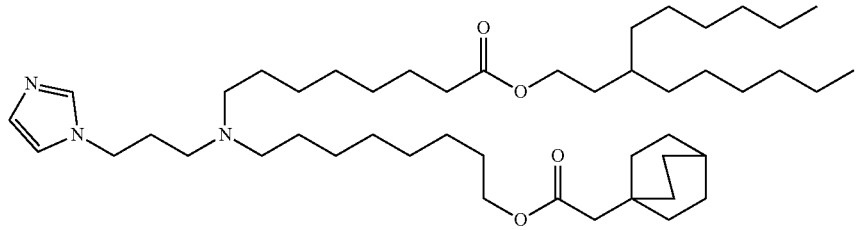 [SMILES: CCCCCCC(CCCCCC)CCOC(=O)CCCCCCCN(CCCCCCCCOC(=O)CC12CCC(CC1)CC2)CCCn1ccnc1] |
| C39 | 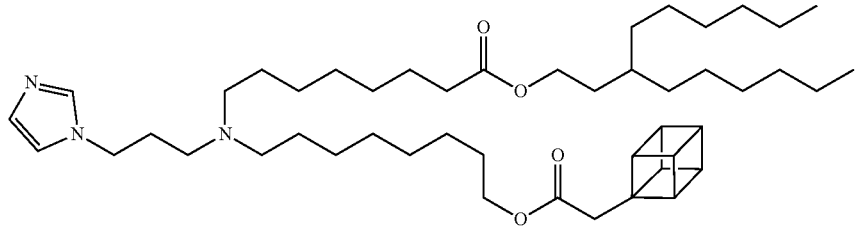 [SMILES: CCCCCCC(CCCCCC)CCOC(=O)CCCCCCCN(CCCCCCCCOC(=O)CC12C3C4C5C3C1C5C42)CCCn1ccnc1] |
| C40 | 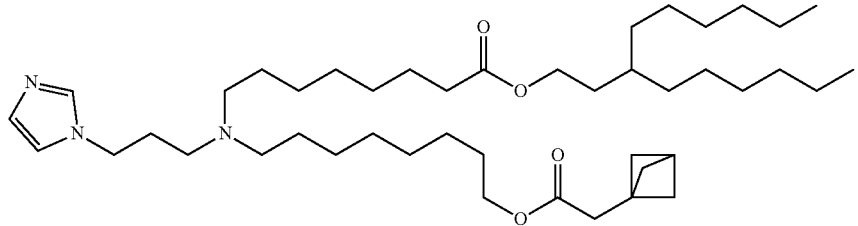 [SMILES: CCCCCCC(CCCCCC)CCOC(=O)CCCCCCCN(CCCCCCCCOC(=O)CC12CC(C1)C2)CCCn1ccnc1] |
| C41 | 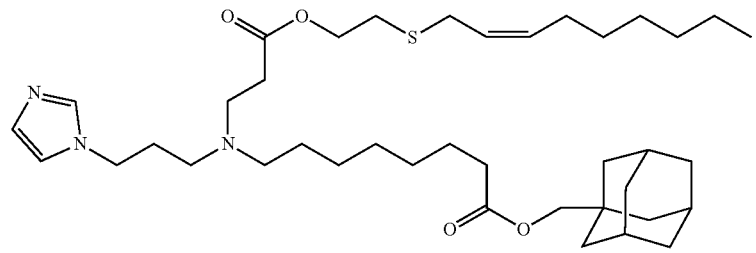 [SMILES: CCCCCC/C=C\CSCCOC(=O)CCN(CCCCCCCC(=O)OCC12CC3CC(CC(C3)C1)C2)CCCn1ccnc1] |
| C42 | 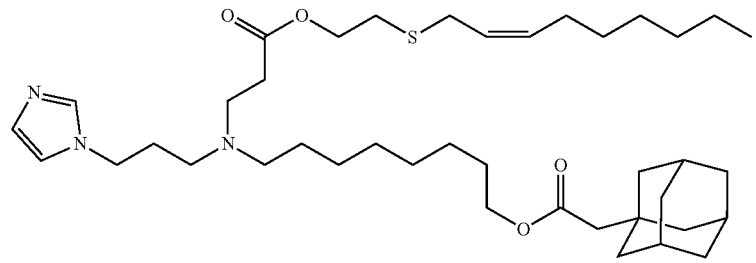 [SMILES: CCCCCC/C=C\CSCCOC(=O)CCN(CCCCCCCCOC(=O)CC12CC3CC(CC(C3)C1)C2)CCCn1ccnc1] |

TABLE (III)-continued

Non-Limiting Examples of Ionizable Lipids with a Constrained Arm

| Compound No. | Structure |
|---|---|
| C43 | |
| C44 | |
| C45 | |
| C46 | |
| C47 | |

TABLE (III)-continued

Non-Limiting Examples of Ionizable Lipids with a Constrained Arm

| Compound No. | Structure |
|---|---|
| C48 | 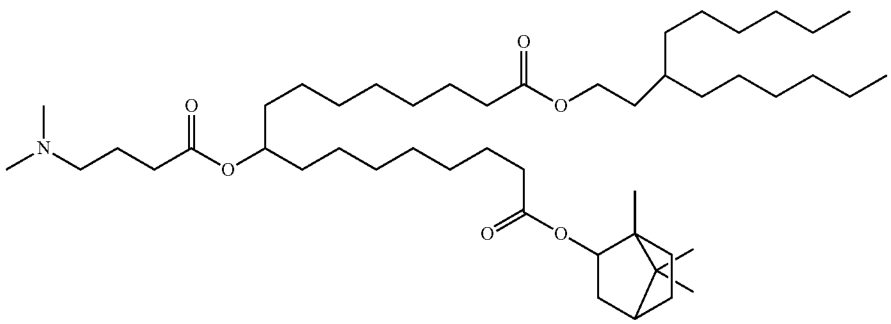 [SMILES: CCCCCCC(CCCCCC)CCOC(=O)CCCCCCCC(CCCCCCCC(=O)OC1CC2CCC1(C)C2(C)C)OC(=O)CCCN(C)C] |
| C49 | 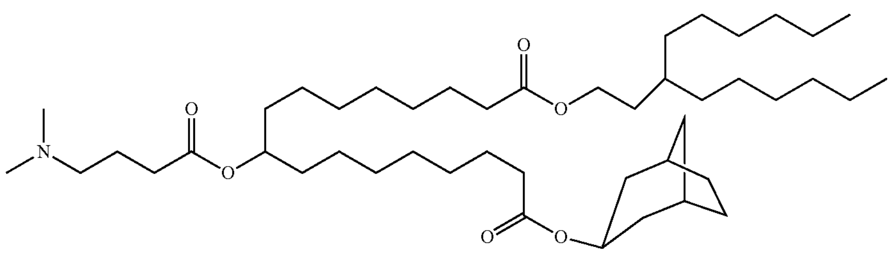 [SMILES: CCCCCCC(CCCCCC)CCOC(=O)CCCCCCCC(CCCCCCCC(=O)OC1CC2CCC(C2)C1)OC(=O)CCCN(C)C] |
| C50 | 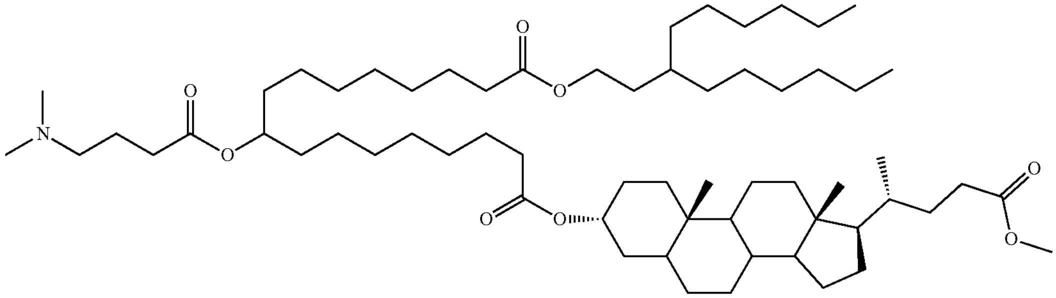 |
| C51 | 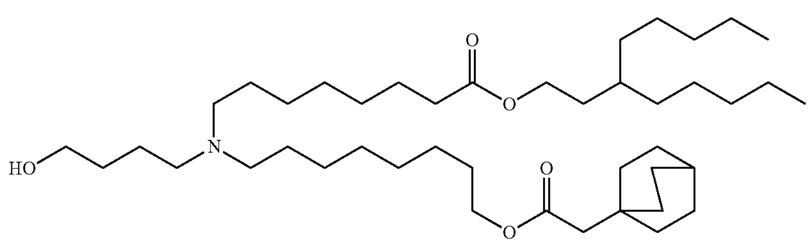 [SMILES: CCCCCC(CCCCC)CCOC(=O)CCCCCCCN(CCCCO)CCCCCCCCOC(=O)CC12CCC(CC1)CC2] |
| C52 | 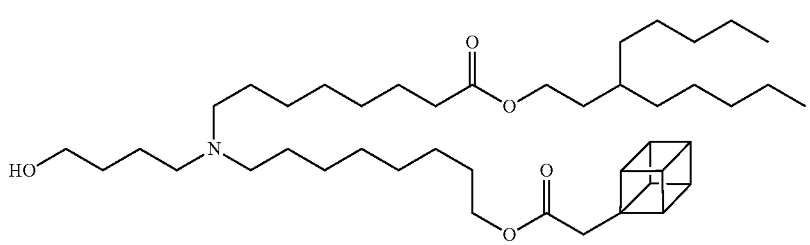 [SMILES: CCCCCC(CCCCC)CCOC(=O)CCCCCCCN(CCCCO)CCCCCCCCOC(=O)CC12C3C4C5C3C1C5C42] |

TABLE (III)-continued
Non-Limiting Examples of Ionizable Lipids with a Constrained Arm
| Compound No. | Structure |
|---|---|
| C53 | 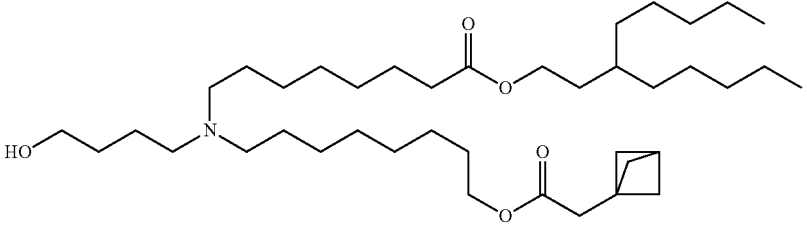 [SMILES: CCCCCC(CCCCC)CCOC(=O)CCCCCCCN(CCCCO)CCCCCCCCOC(=O)CC12CC(C1)C2] |
| C54 | 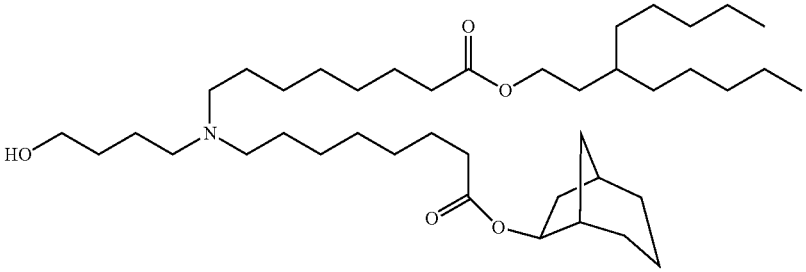 [SMILES: CCCCCC(CCCCC)CCOC(=O)CCCCCCCN(CCCCO)CCCCCCCC(=O)OC1CC2CCCC1C2] |
| C55 | 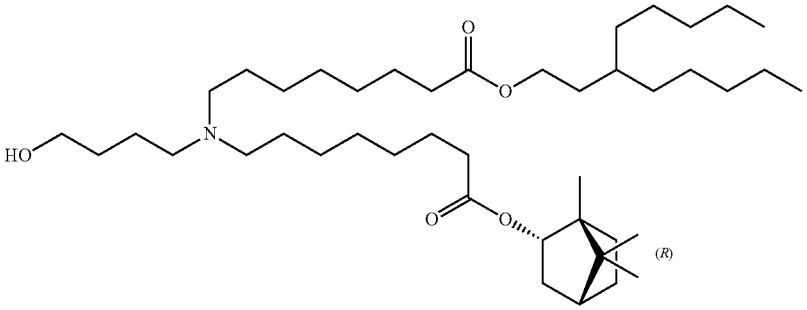 |
| C56 | 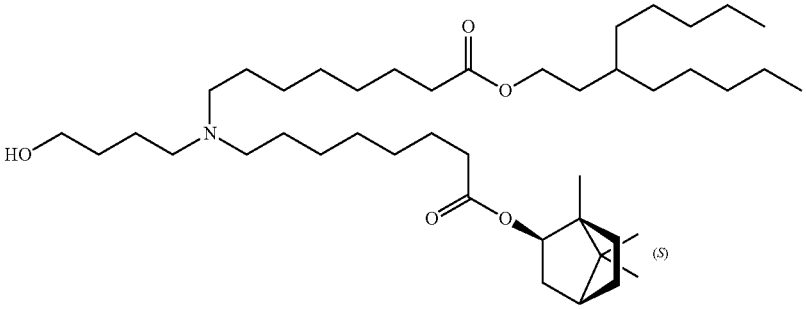 |
| C57 | 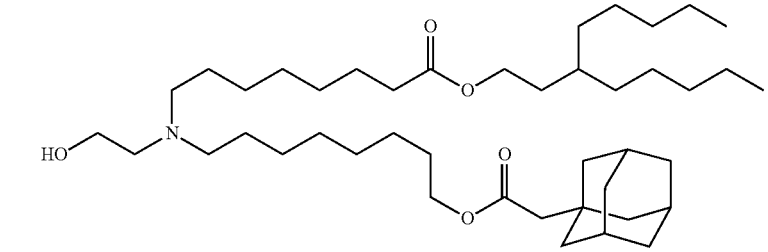 [SMILES: CCCCCC(CCCCC)CCOC(=O)CCCCCCCN(CCO)CCCCCCCCOC(=O)CC12CC3CC(CC(C3)C1)C2] |

TABLE (III)-continued

Non-Limiting Examples of Ionizable Lipids with a Constrained Arm

| Compound No. | Structure |
|---|---|
| C58 | 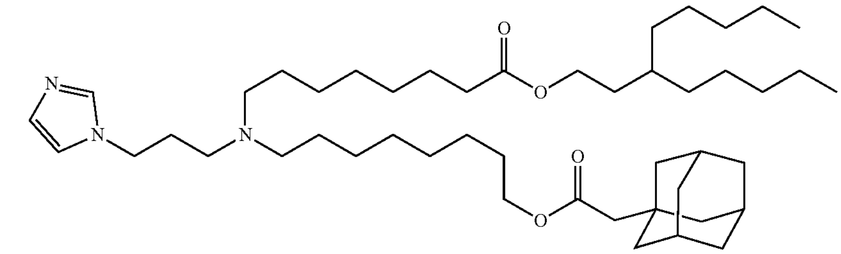 [SMILES: CCCCCC(CCCCC)CCOC(=O)CCCCCCCN(CCCCCCCCOC(=O)CC12CC3CC(CC(C3)C1)C2)CCCn1ccnc1] |
| C59 | 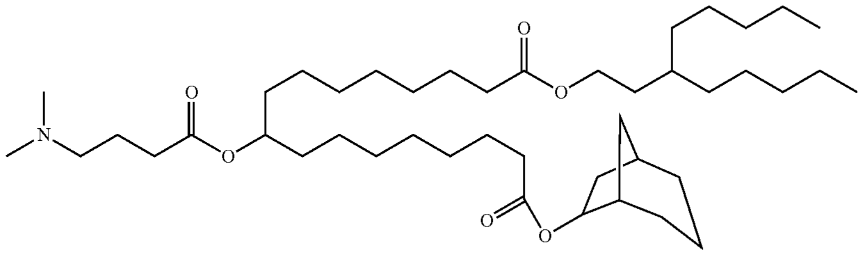 [SMILES: CCCCCC(CCCCC)CCOC(=O)CCCCCCCC(CCCCCCCC(=O)OC1CC2CCCC1C2)OC(=O)CCCN(C)C] |
| C60 | 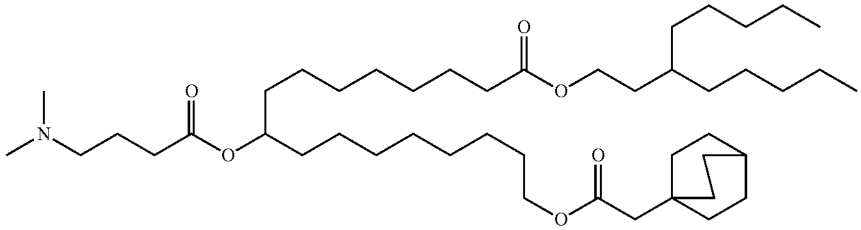 [SMILES: CCCCCC(CCCCC)CCOC(=O)CCCCCCCC(CCCCCCCCOC(=O)CC12CCC(CC1)CC2)OC(=O)CCCN(C)C] |
| C61 | 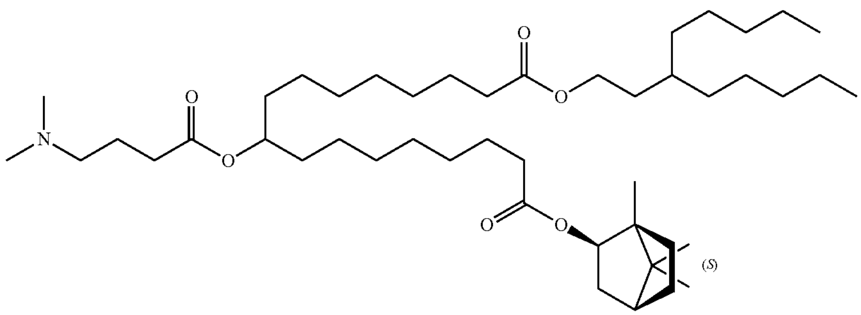 |
| C62 | 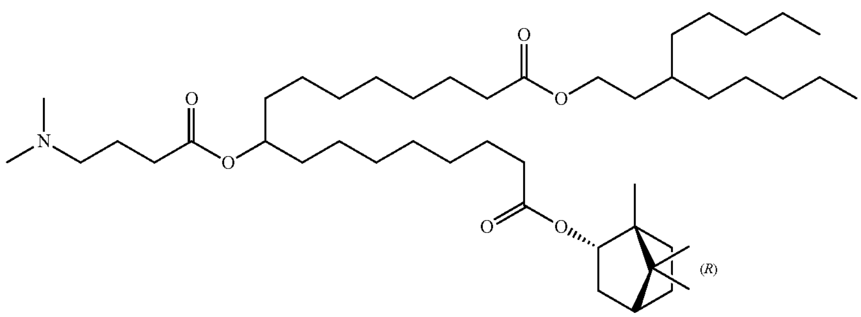 |

TABLE (III)-continued

Non-Limiting Examples of Ionizable Lipids with a Constrained Arm

| Compound No. | Structure |
|---|---|
| C63 | 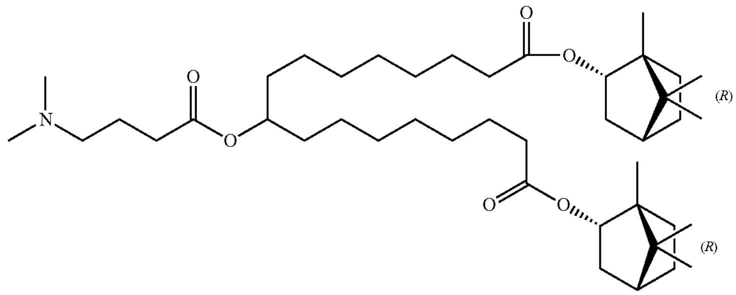 |
| C64 | 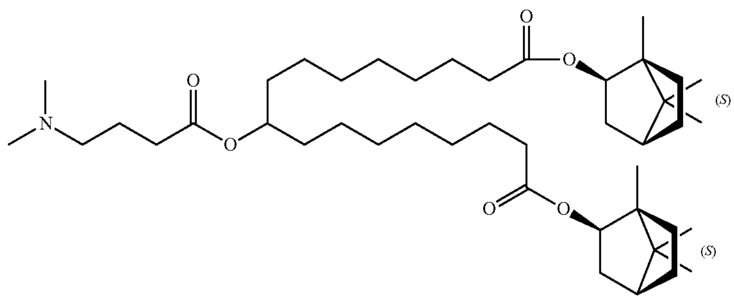 |
| C65 | 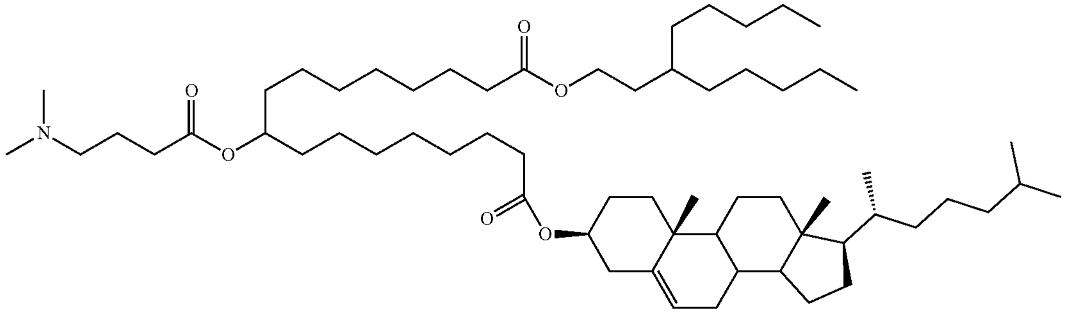 |
| C66 | 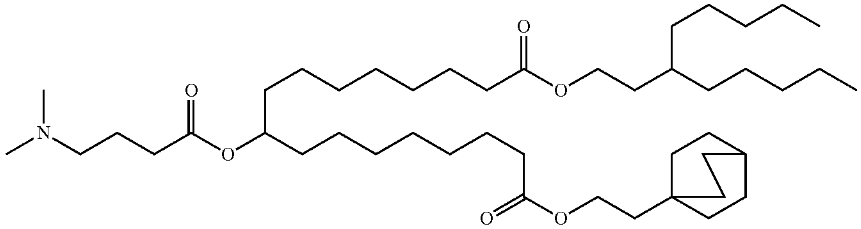 [SMILES: CCCCCC(CCCCC)CCOC(=O)CCCCCCCC(CCCCCCCC(=O)OCCC12CCC(CC1)CC2)OC(=O)CCCN(C)C] |
| C67 | 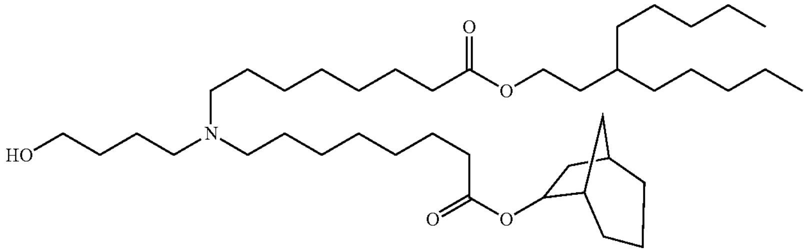 [SMILES: CCCCCC(CCCCC)CCOC(=O)CCCCCCCN(CCCCO)CCCCCCCC(=O)OC1CC2CCCC1C2] |

TABLE (III)-continued

Non-Limiting Examples of Ionizable Lipids with a Constrained Arm

| Compound No. | Structure |
|---|---|
| C68 | 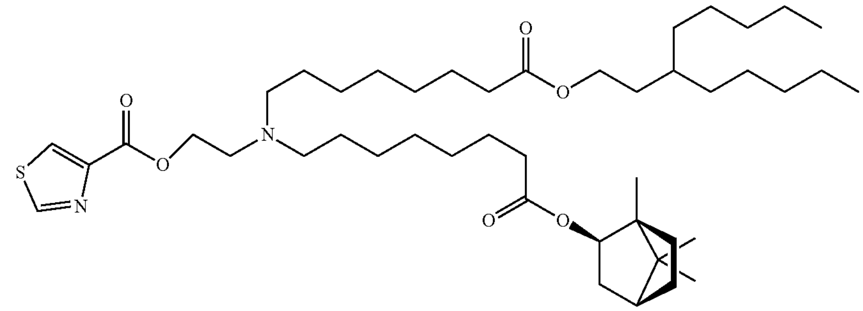 |
| C69 | 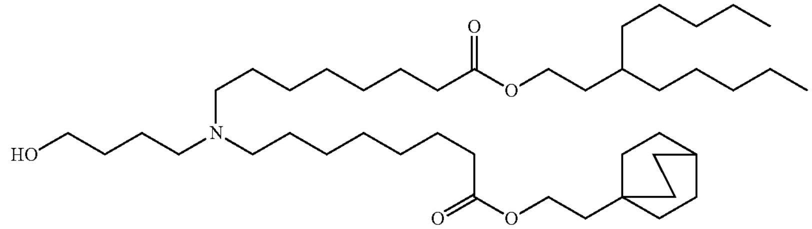 [SMILES: CCCCCC(CCCCC)CCOC(=O)CCCCCCCN(CCCCO)CCCCCCCC(=O)OCCC12CCC(CC1)CC2] |
| C70 | 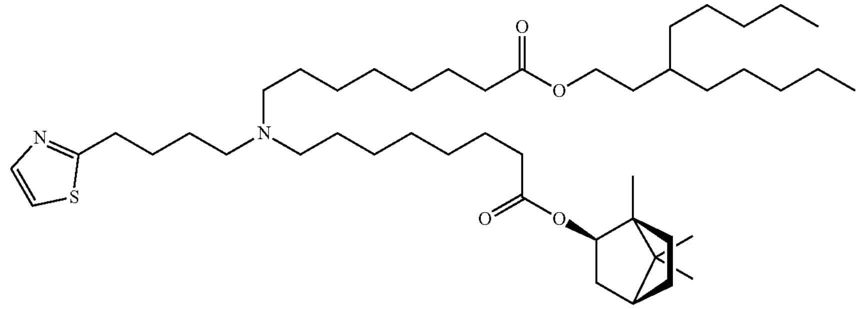 |
| C71 | 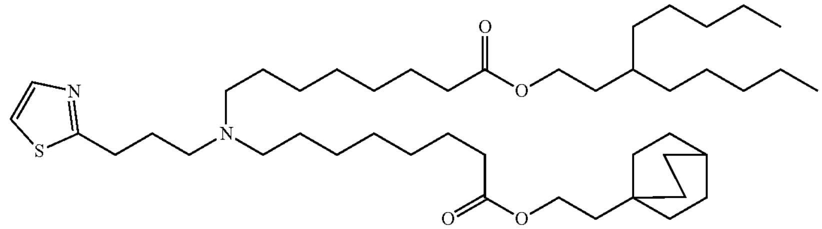 [SMILES: CCCCCC(CCCCC)CCOC(=O)CCCCCCCN(CCCCCCCC(=O)OCCC12CCC(CC1)CC2)CCCc1nccs1] |
| C72 | 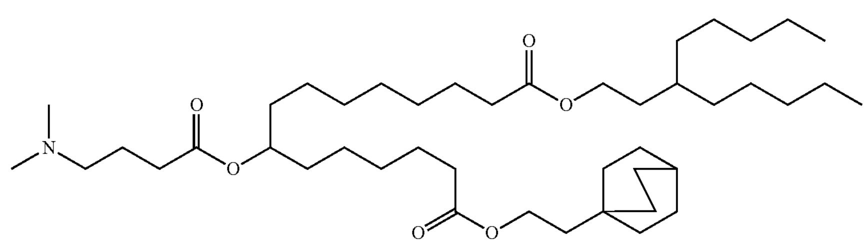 [SMILES: CCCCCC(CCCCC)CCOC(=O)CCCCCCCC(CCCCCC(=O)OCCC12CCC(CC1)CC2)OC(=O)CCCN(C)C] |

TABLE (III)-continued
Non-Limiting Examples of Ionizable Lipids with a Constrained Arm
| Compound No. | Structure |
|---|---|
| C73 | 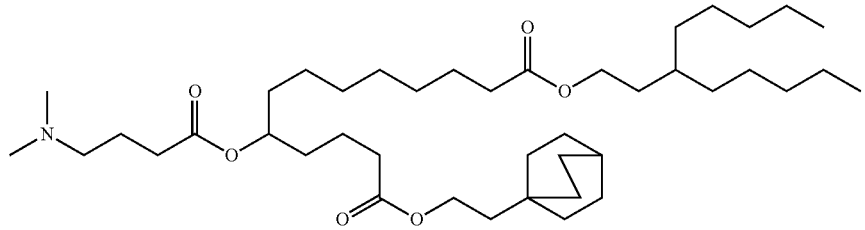 [SMILES: CCCCCC(CCCCC)CCOC(=O)CCCCCCCC(CCCC(=O)OCCC12CCC(CC1)CC2)OC(=O)CCCN(C)C] |
| C74 | 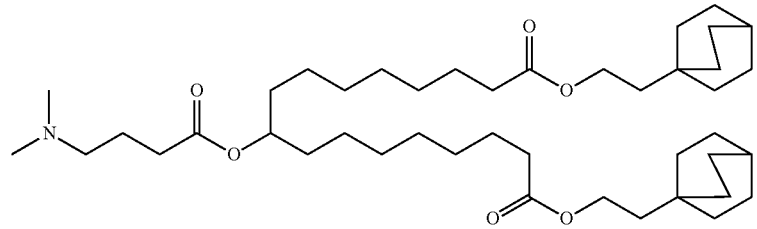 [SMILES: CN(C)CCCC(=O)OC(CCCCCCCC(=O)OCCC12CCC(CC1)CC2)CCCCCCCC(=O)OCCC12CCC(CC1)CC2] |
| C75 | 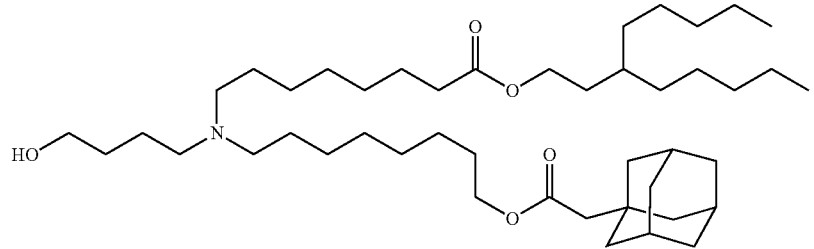 [SMILES: CCCCCC(CCCCC)CCOC(=O)CCCCCCCN(CCCCO)CCCCCCCCOC(=O)CC12CC3CC(CC(C3)C1)C2] |
| C76 | 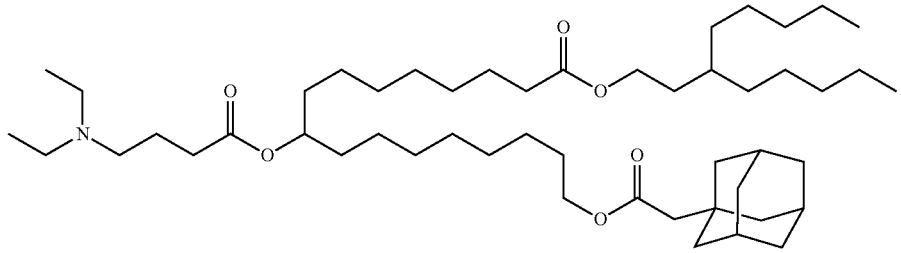 [SMILES: CCCCCC(CCCCC)CCOC(=O)CCCCCCCC(CCCCCCCCOC(=O)CC12CC3CC(CC(C3)C1)C2)OC(=O)CCCN(CC)CC] |
| C77 | 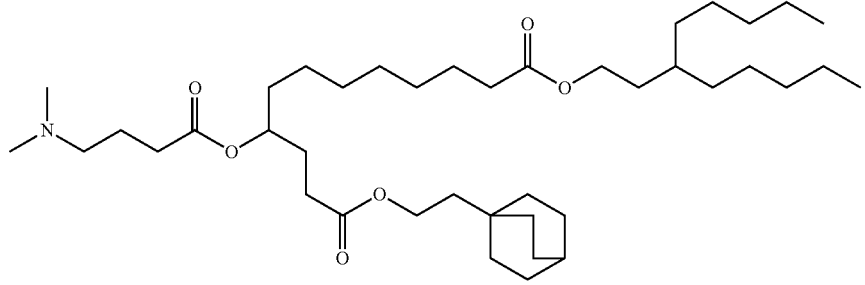 [SMILES: CCCCCC(CCCCC)CCOC(=O)CCCCCCCC(CCC(=O)OCCC12CCC(CC1)CC2)OC(=O)CCCN(C)C] |

TABLE (III)-continued

Non-Limiting Examples of Ionizable Lipids with a Constrained Arm

| Compound No. | Structure |
|---|---|
| C78 | 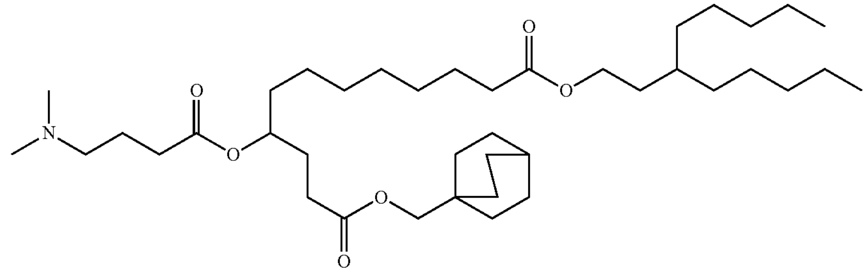 [SMILES: CCCCCC(CCCCC)CCOC(=O)CCCCCCCC(CCC(=O)OCC12CCC(CC1)CC2)OC(=O)CCCN(C)C] |
| C79 | 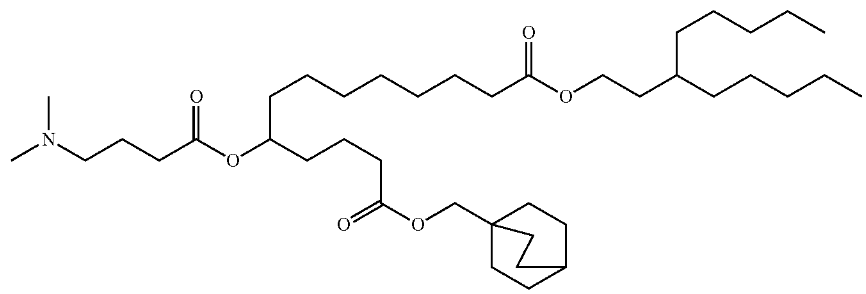 [SMILES: CCCCCC(CCCCC)CCOC(=O)CCCCCCCC(CCCC(=O)OCC12CCC(CC1)CC2)OC(=O)CCCN(C)C] |
| C80 | 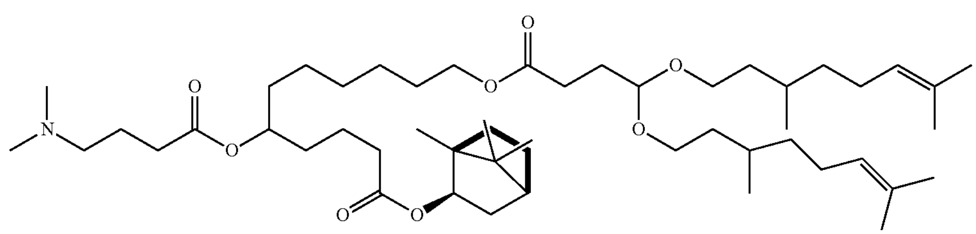 |
| C81 | 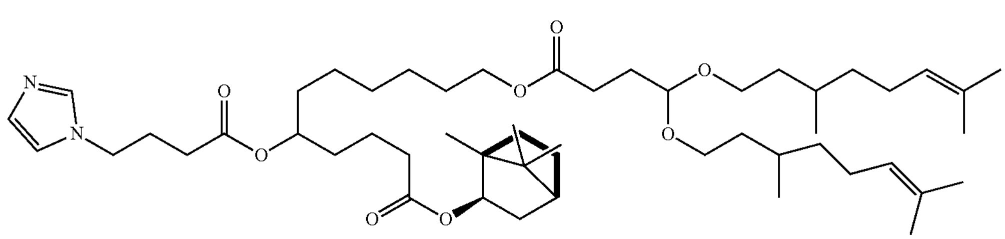 |

In some embodiments, an LNP of the present disclosure comprises an ionizable lipid disclosed in PCT Application PCT/US2023/065477, which is incorporated by reference herein, in its entirety.

In some embodiments, lipids of the present disclosure comprise a heterocyclic core, wherein the heteroatom is nitrogen. In some embodiments, the heterocyclic core comprises pyrrolidine or a derivative thereof. In some embodiments, the heterocyclic core comprises piperidine or a derivative thereof.

In some embodiments, a compound of the present disclosure is represented by Formula (CX-I):

(CX-I)

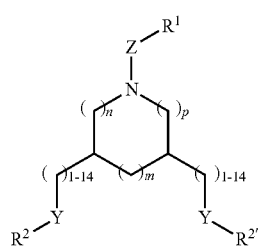

or a pharmaceutically acceptable salt thereof,
wherein
Z is selected from the group consisting of a bond,

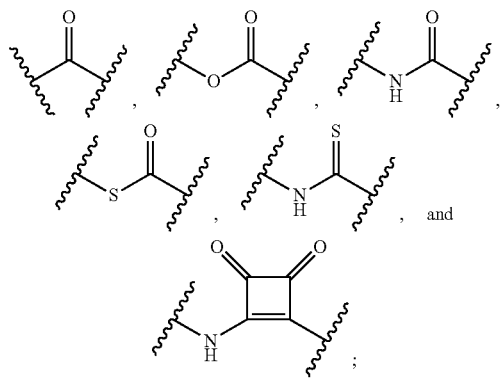

each Y is independently selected from the group consisting of

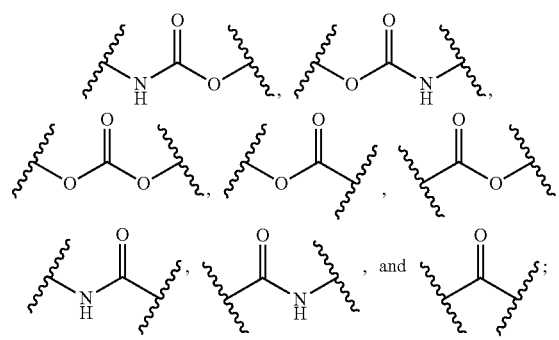

$R^1$ is —$(CH_2)_{1-6}N(R^a)_2$ or —$(CH_2)_{1-6}OH$;
$R^2$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;
$R^{2'}$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—; each $R^a$ is independently optionally substituted $C_1$-$C_6$ alkyl; or
two $R^a$ are taken together, with the nitrogen on which they are attached, to form an optionally substituted 4-7 membered heterocyclyl ring;

m is 0, 1, or 2;
n is 1 or 2; and
p is 1 or 2.
In some embodiments, a compound of the present disclosure is represented by Formula (CX-i):

(CX-i)

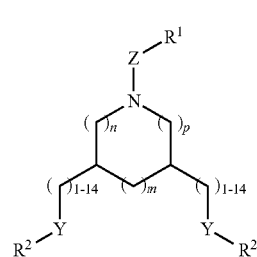

or a pharmaceutically acceptable salt thereof,
wherein
Σ is selected from the group consisting of a bond,

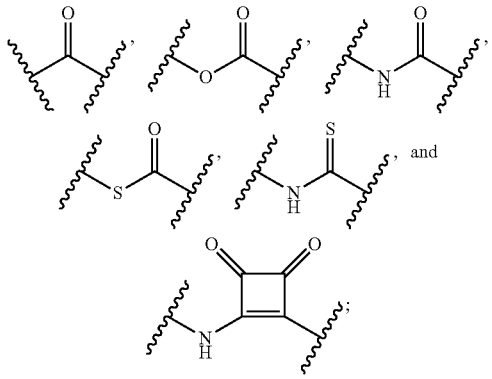

each Y is independently selected from the group consisting of

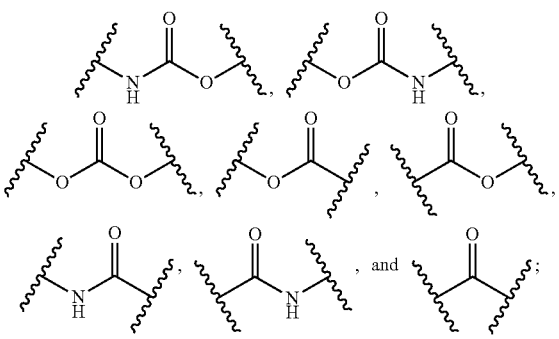

$R^1$ is —$(CH_2)_{1-6}N(R^a)_2$;
$R^2$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;
each $R^a$ is independently optionally substituted $C_1$-$C_6$ alkyl; or
two $R^a$ are taken together, with the nitrogen on which they are attached, to form an optionally substituted 4-7 membered heterocyclyl ring;

m is 0, 1, or 2;

n is 1 or 2; and p is 1 or 2.

In some embodiments, a compound of the present disclosure is represented by Formula (CX-I'), (CX-I''), (CX-I'''),

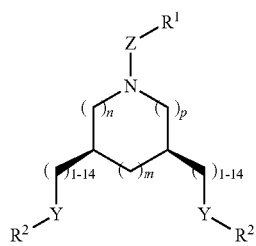
(CX-I')

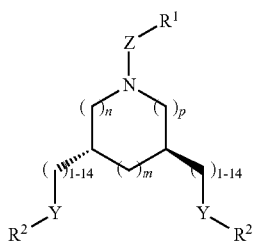
(CX-I'')

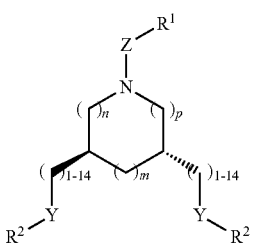
(CX-I''')

or a pharmaceutically acceptable salt thereof.

In some embodiments, a compound of the present disclosure is represented by Formula (CX-I-a), (CX-I-b), (CX-I-c), or (CX-I-d):

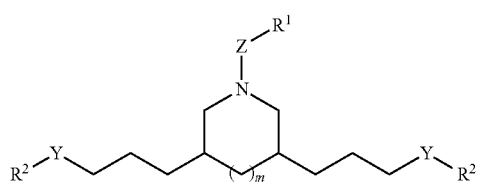
(CX-I-a)

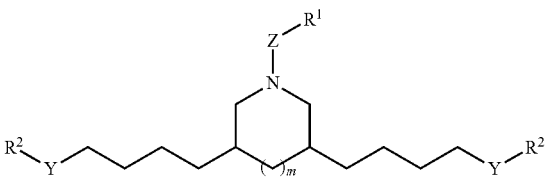
(CX-I-b)

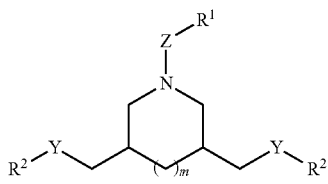
(CX-I-c)

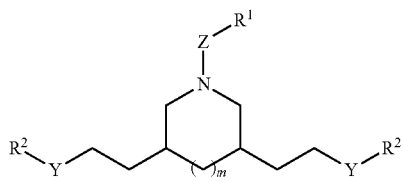
(CX-I-d)

or a pharmaceutically acceptable salt thereof.

In some embodiments, a compound of the present disclosure is represented by Formula (CX-I-a'), (CX-I-b'), (CX-I-c'), or (CX-I-d'):

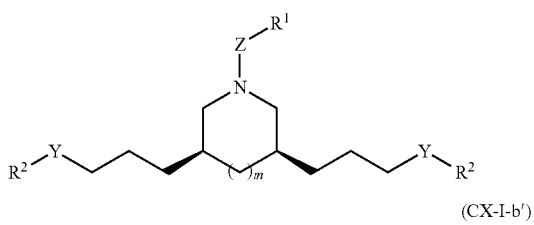
(CX-I-a')

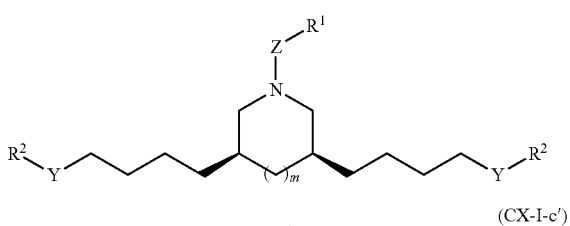
(CX-I-b')

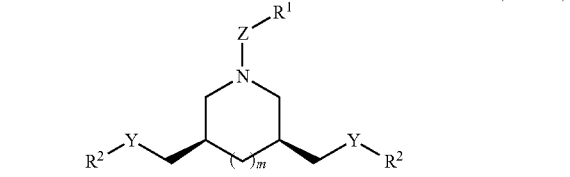
(CX-I-c')

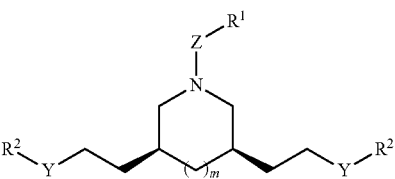
(CX-I-d')

or a pharmaceutically acceptable salt thereof.

In some embodiments, a compound of the present disclosure is represented by Formula (CX-I-a''), (CX-I-b''), (CX-I-c''), or (CX-I-d''):

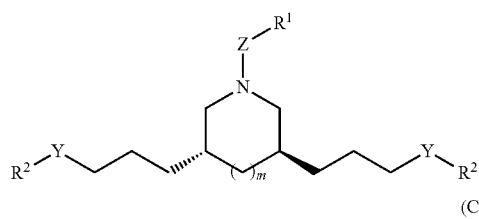
(CX-I-a″)

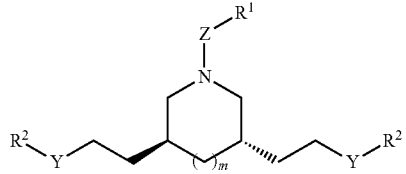
(CX-I-d‴)

or a pharmaceutically acceptable salt thereof.

In some embodiments, a compound of the present disclosure is represented by Formula (CX-I-e) or (CX-I-f):

(CX-I-b″)

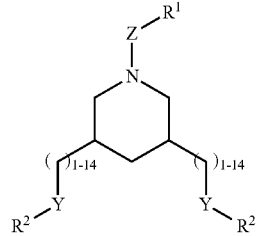
(CX-I-e)

(CX-I-c″)

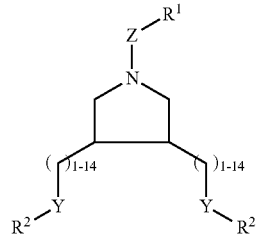
(CX-I-f)

(CX-I-d″)

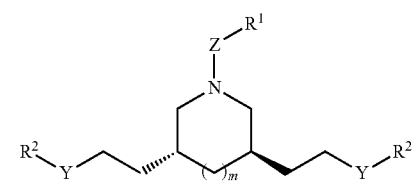

or a pharmaceutically acceptable salt thereof.

In some embodiments, a compound of the present disclosure is represented by Formula (CX-I-a‴), (CX-I-b‴), (CX-I-c‴), or (CX-I-d‴):

or a pharmaceutically acceptable salt thereof.

In some embodiments, a compound of the present disclosure is represented by Formula (CX-I-e′) or (CX-I-f′):

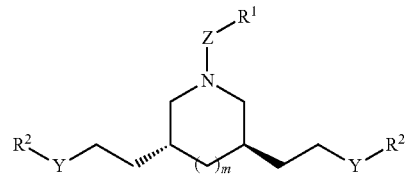
(CX-I-a‴)

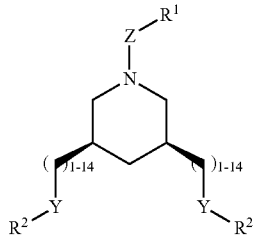
(CX-I-e′)

(CX-I-b‴)

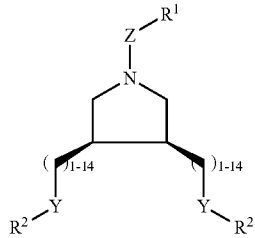
(CX-I-f′)

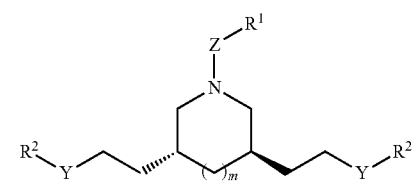
(CX-I-c‴)

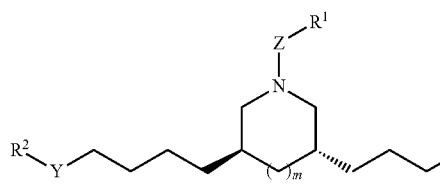

or a pharmaceutically acceptable salt thereof.

In some embodiments, a compound of the present disclosure is represented by Formula (CX-I-e″) or (CX-I-f″):

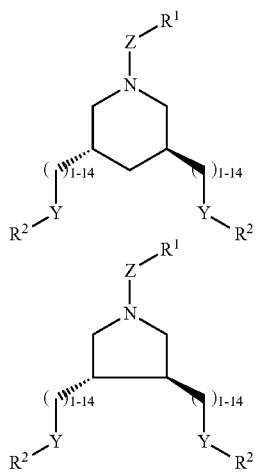
(CX-I-e'')

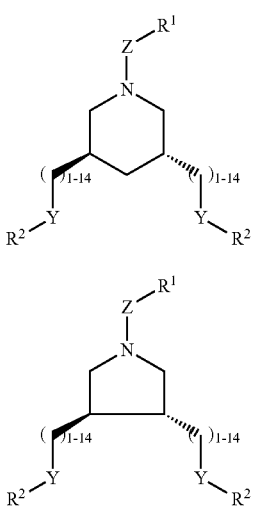
(CX-I-f'')

or a pharmaceutically acceptable salt thereof.

In some embodiments, a compound of the present disclosure is represented by Formula (CX-I-e''') or (CX-I-f'''):

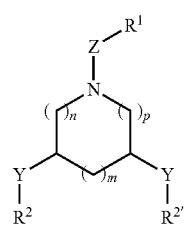
(CX-I-e''')

(CX-I-f''')

or a pharmaceutically acceptable salt thereof.

In some embodiments, a compound of the present disclosure is represented by Formula (CX-II):

(CX-II)

or a pharmaceutically acceptable salt thereof, wherein

Z is selected from the group consisting of a bond

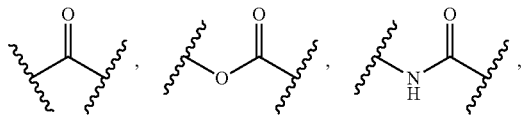

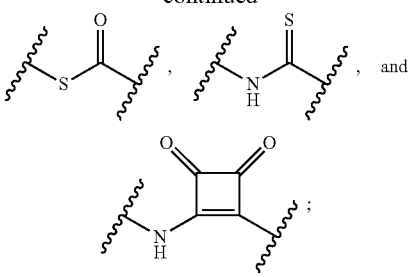

each Y is independently selected from the group consisting of

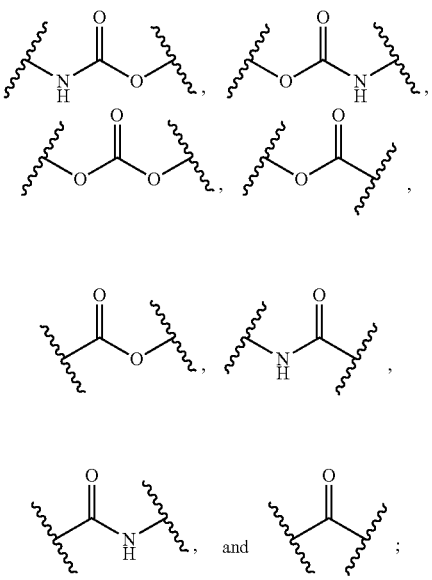

$R^1$ is —$(CH_2)_{1-6}N(R^a)_2$ or —$(CH_2)_{1-6}OH$;

$R^2$ is optionally substituted $C_5$-$C_{36}$ alkyl or optionally substituted $C_5$-$C_{36}$ alkenyl, wherein 2 methylene units of $R^2$ are replaced with —O— to form an acetal within $R^2$, and wherein 1-6 methylene units of $R^2$ are optionally replaced with a group each independently selected from cyclopropylene, —O—, —OC(O)—, and —C(O)O—;

$R^{2'}$ is optionally substituted $C_1$-$C_{36}$ alkyl or optionally substituted $C_5$-$C_{36}$ alkenyl, wherein 1-6 methylene units of $R^{2'}$ are optionally replaced with a group each independently selected from cyclopropylene, —O—, —OC(O)—, and —C(O)O—;

each $R^a$ is independently optionally substituted $C_1$-$C_6$ alkyl; or two $R^a$ are taken together, with the nitrogen on which they are attached, to form an optionally substituted 4-7 membered heterocyclyl ring;

m is 0, 1, or 2;

n is 1 or 2; and p is 1 or 2.

In some embodiments, a compound of the present disclosure is represented by Formula (CX-ii):

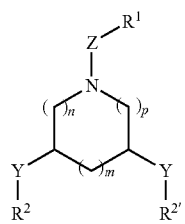
(CX-ii)

or a pharmaceutically acceptable salt thereof,
wherein
Z is selected from the group consisting of a bond,

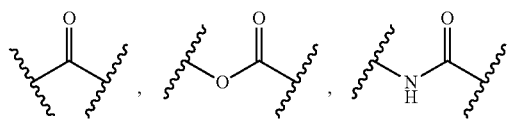
, and
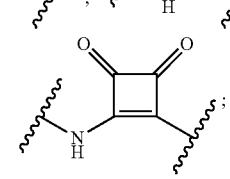
;

each Y is independently selected from the group consisting of

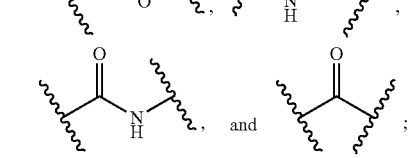

$R^1$ is —(CH$_2$)$_{1-6}$N(R$^a$)$_2$;

$R^2$ is optionally substituted C$_1$-C$_{36}$ alkyl or optionally substituted C$_2$-C$_{36}$ alkenyl, wherein 1-6 methylene units of R$^2$ are optionally replaced with a group each independently selected from cyclopropylene, —O—, —OC(O)—, and —C(O)O—;

$R^{2'}$ is optionally substituted C$_1$-C$_{36}$ alkyl, wherein 1-6 methylene units of R$^{2'}$ are optionally replaced with a group each independently selected from cyclopropylene, —O—, —OC(O)—, and —C(O)O—;

each R$^a$ is independently optionally substituted C$_1$-C$_6$ alkyl; or two R$^a$ are taken together, with the nitrogen on which they are attached, to form an optionally substituted 4-7 membered heterocyclyl ring;

m is 0, 1, or 2;

n is 1 or 2; and p is 1 or 2.

In some embodiments, a compound of the present disclosure is represented by Formula (CX-II'), (CX-II''), (CX-II'''),

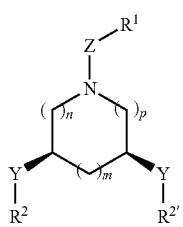
(CX-II')

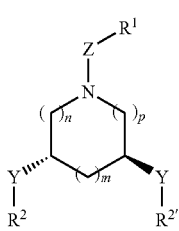
(CX-II'')

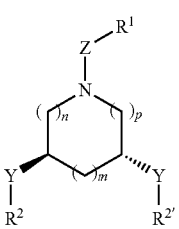
(CX-II''')

or a pharmaceutically acceptable salt thereof.

In some embodiments, a compound of the present disclosure is represented by Formula (CX-II-a)

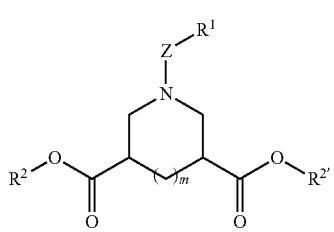
(CX-II-a)

or a pharmaceutically acceptable salt thereof.

In some embodiments, a compound of the present disclosure is represented by Formula (CX-II-a'), (CX-II-a''), or (CX-II-a'''), (CX-II-a′)

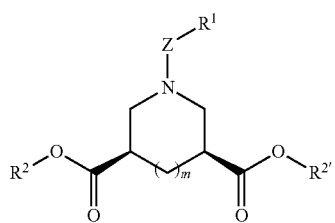

(CX-II-a″)

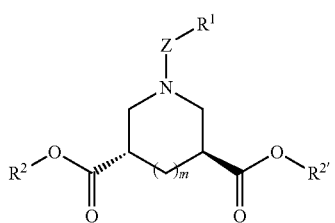

(CX-II-a‴)

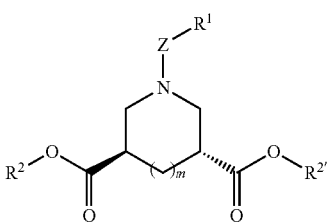

or a pharmaceutically acceptable salt thereof.

In some embodiments, a compound of the present disclosure is represented by Formula (CX-II-b), (CX-II-c), or (CX-II-d)

(CX-II-b)

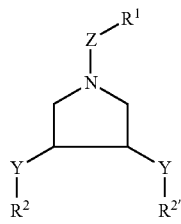

(CX-II-c)

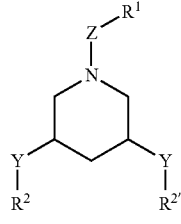

(CX-II-d)

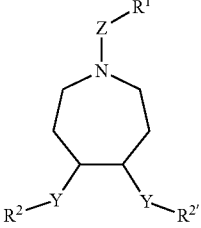

or a pharmaceutically acceptable salt thereof.

In some embodiments, a compound of the present disclosure is represented by Formula (CX-II-b′), (CX-II-c′), or (CX-II-d′)

(CX-II-b′)

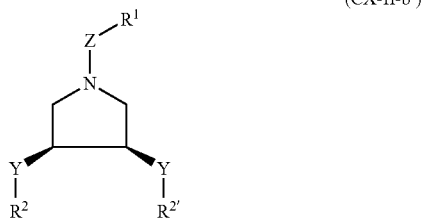

(CX-II-c′)

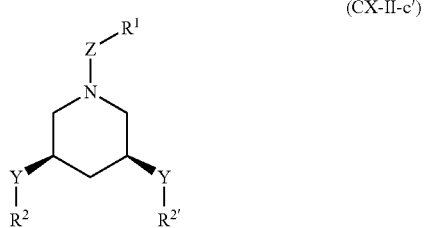

(CX-II-d′)

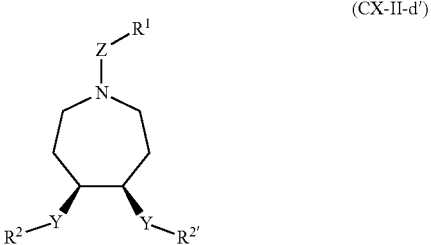

or a pharmaceutically acceptable salt thereof.

In some embodiments, a compound of the present disclosure is represented by Formula (CX-II-b″), (CX-II-c″), or (CX-II-d″)

(CX-II-b″)

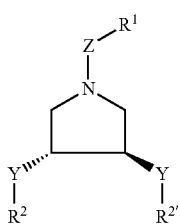

(CX-II-c″)

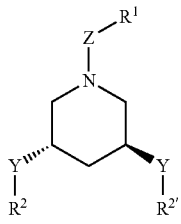

-continued (CX-II-d'')

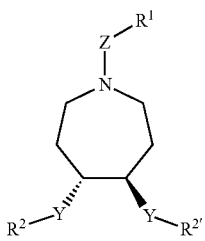

or a pharmaceutically acceptable salt thereof.

In some embodiments, a compound of the present disclosure is represented by Formula (CX-II-b'''), (CX-II-c'''), or (CX-II-d''')

(CX-II-b''')

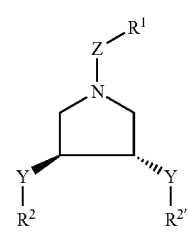

(CX-II-c''')

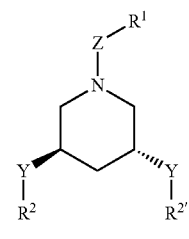

(CX-II-d''')

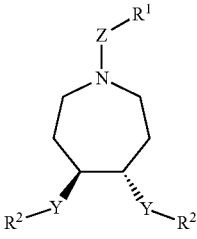

or a pharmaceutically acceptable salt thereof.

In some embodiments, a compound of the present disclosure is represented by is represented by formula (CX-II-e):

(CX-II-e)

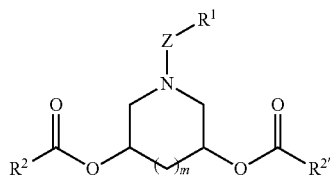

or a pharmaceutically acceptable salt thereof.

In some embodiments, a compound of the present disclosure is represented by Formula (CX-III)

(CX-III)

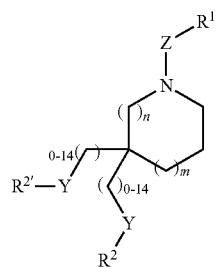

or a pharmaceutically acceptable salt thereof, wherein

Z is selected from the group consisting of a bond,

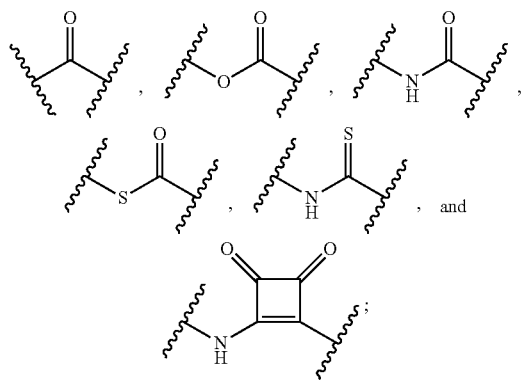

and each Y is independently selected from the group consisting of

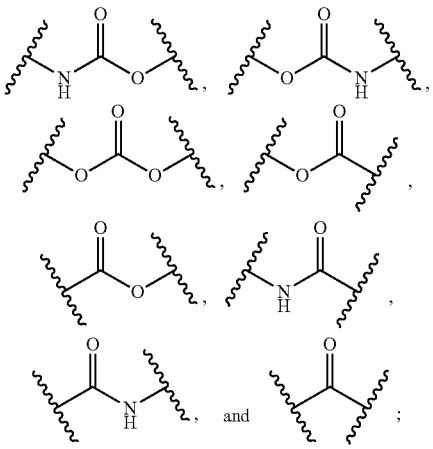

and ;

$R^1$ is —$(CH_2)_{1-6}N(R^a)_2$ or —$(CH_2)_{1-6}OH$;

$R^2$ is optionally substituted $C_5$-$C_{36}$ alkyl or optionally substituted $C_5$-$C_{36}$ alkenyl, wherein 2 methylene units of $R^2$ are replaced with —O— to form an acetal within $R^2$, and wherein 1-6 methylene units of $R^2$ are optionally replaced with a group each independently selected from cyclopropylene, —O—, —OC(O)—, and —C(O)O—;

$R^{2'}$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;

each $R^a$ is independently optionally substituted $C_1$-$C_6$ alkyl; or two $R^a$ are taken together, with the nitrogen on which they are attached, to form an optionally substituted 4-7 membered heterocyclyl ring;

m is 0, 1, or 2; and n is 1 or 2.

In some embodiments, a compound of the present disclosure is represented by Formula (CX-iii)

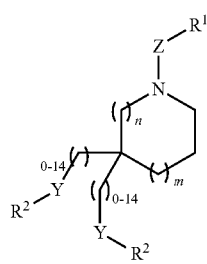

(CX-iii)

or a pharmaceutically acceptable salt thereof,
wherein
Z is selected from the group consisting of a bond,

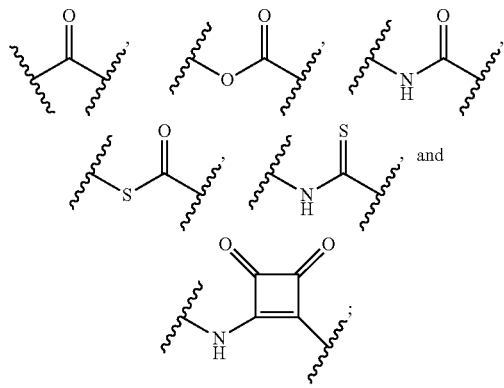

and each Y is independently selected from the group consisting of

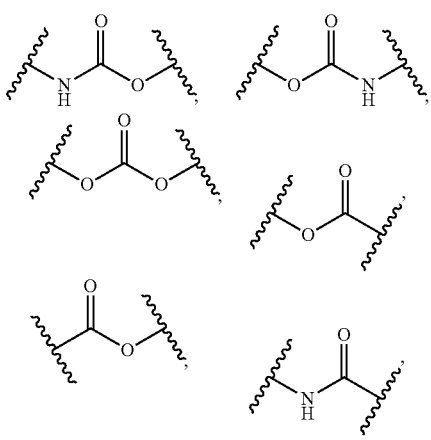

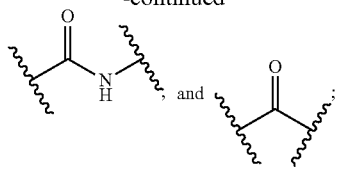

$R^1$ is —$(CH_2)_{1-6}N(R^a)_2$;

each $R^2$ is independently optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;

each $R^a$ is independently optionally substituted $C_1$-$C_6$ alkyl; or two $R^a$ are taken together, with the nitrogen on which they are attached, to form an optionally substituted 4-7 membered heterocyclyl ring;

m is 0, 1, or 2; and n is 1 or 2.

In some embodiments, a compound of the present disclosure is represented by Formula (CX-III-a), (CX-III-b), or (CX-III-c):

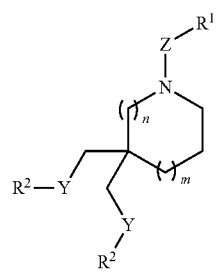

(CX-III-a)

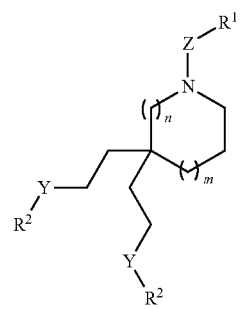

(CX-III-b)

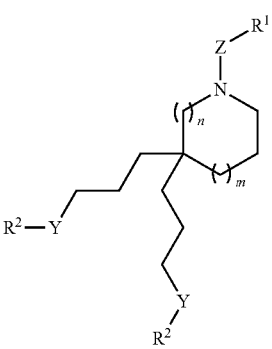

(CX-III-c)

or a pharmaceutically acceptable salt thereof.

In some embodiments, a compound of the present disclosure is represented by Formula (CX-III-d) or (CX-III-e)

(CX-III-d)

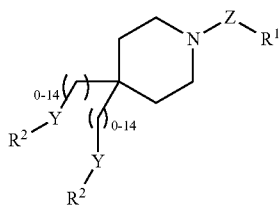

(CX-III-e)

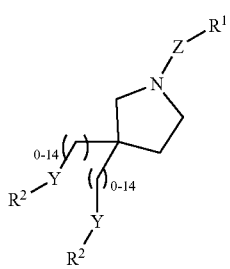

or a pharmaceutically acceptable salt thereof.

In some embodiments, a compound of the present disclosure is represented by Formula (CX-IV)

(CX-IV)

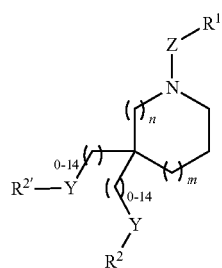

or a pharmaceutically acceptable salt thereof,
wherein
Z is selected from the group consisting of a bond,

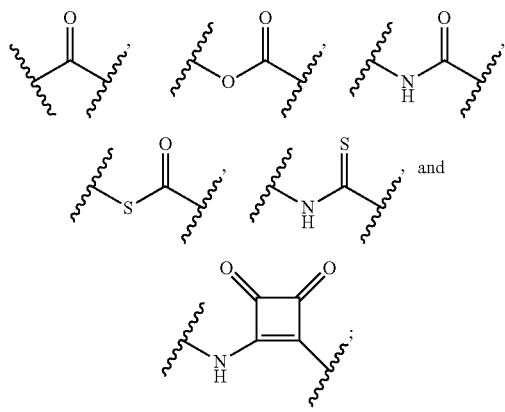

each Y is independently selected from the group consisting of

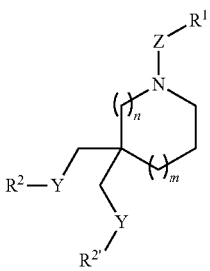

$R^1$ is —$(CH_2)_{1-6}N(R^a)_2$ or —$(CH_2)_{1-6}OH$;

$R^2$ is $C_3$-$C_{36}$ branched alkyl or optionally substituted $C_3$-$C_{36}$ branched alkenyl, wherein 1-6 methylene units of $R^2$ are optionally replaced with a group each independently selected from cyclopropylene and —O—;

$R^{2'}$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;

each $R^a$ is independently optionally substituted $C_1$-$C_6$ alkyl; or two $R^a$ are taken together, with the nitrogen on which they are attached, to form an optionally substituted 4-7 membered heterocyclyl ring;

m is 0, 1, or 2; and n is 1 or 2.

In some embodiments, a compound is represented by formula (CX-IV-a), (CX-IV-b), or (CX-IV-c):

(CX-IV-a)

-continued (CX-IV-b)

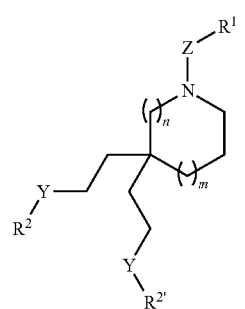

(CX-IV-c)

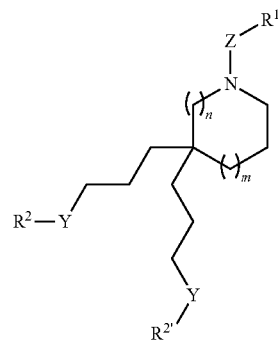

or a pharmaceutically acceptable salt thereof.

In some embodiments, a compound of the present disclosure compound is represented by formula (CX-IV-d) or (CX-IV-e):

(CX-IV-d)

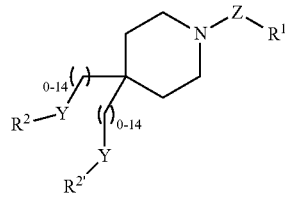

(CX-IV-e)

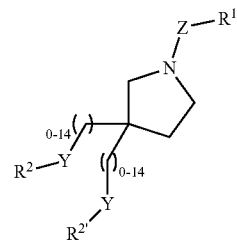

or a pharmaceutically acceptable salt thereof.

Z

In some embodiments, Z is selected from the group consisting of a bond,

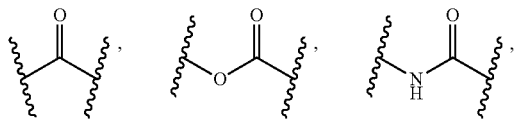

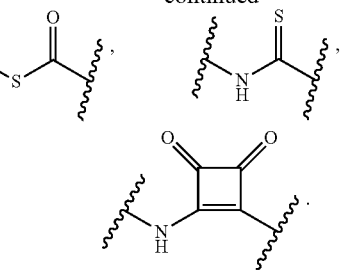

In some embodiments, Z is selected from the group consisting of

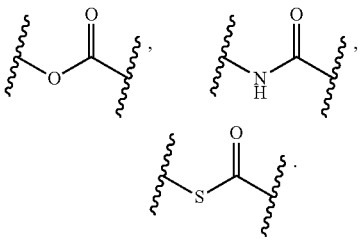

In some embodiments, Z is

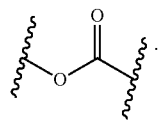

In some embodiments, Z is selected from the group consisting of a bond,

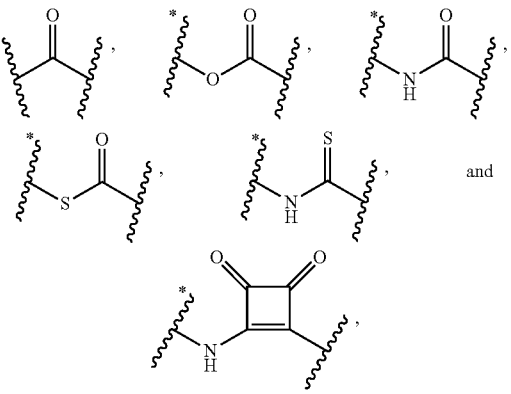

wherein $R^1$ is attached at the position denoted by *.

In some embodiments, Z is selected from the group consisting of

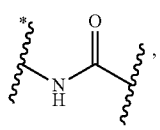, and 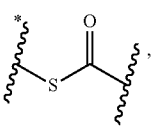, wherein R¹ is attached at the position denoted by *.

In some embodiments, Z is

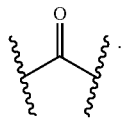.

In some embodiments, Z is

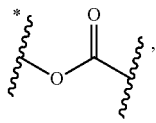, wherein R¹ is attached at the position denoted by *. In some embodiments, Z is

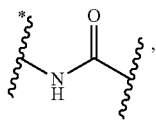, wherein R¹ is attached at the position denoted by *. In some embodiments, Z is

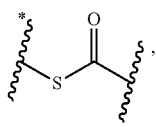, wherein R¹ is attached at the position denoted by *.

Y

In some embodiments, each Y is independently selected from the group consisting of

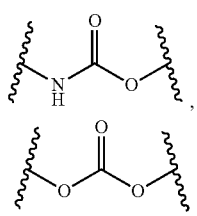

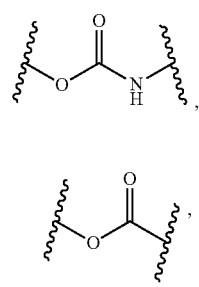

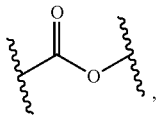, 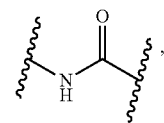,

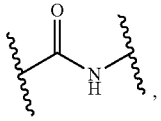, and 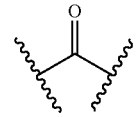.

In some embodiments, Y is selected from the group consisting of

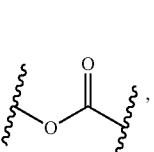, 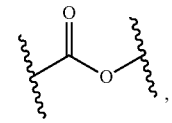,

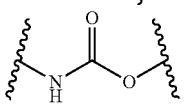, 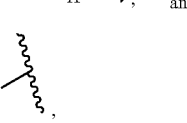, and

,

In some embodiments, Y is selected from the group consisting of

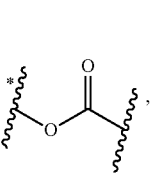 [SMILES: *OC(*)=O], 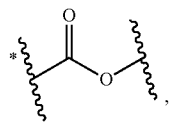,

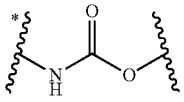, 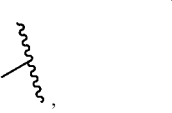, and

, wherein R² is attached at the position denoted by *.

In some embodiments, Y is

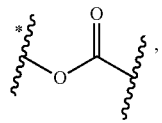, wherein R² is attached at the position denoted by *. In some embodiments, Y is

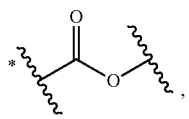

wherein R² is attached at the position denoted by *. In some embodiments, Y is

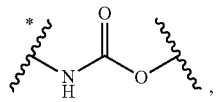

wherein R² is attached at the position denoted by *. In some embodiments, Y is

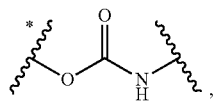

wherein R² is attached at the position denoted by *. In some embodiments, Y is

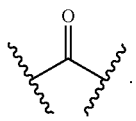 [SMILES: *C(*)=O]

In some embodiments, Y is

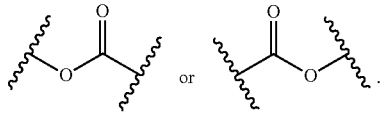 [SMILES: *OC(*)=O ; *OC(*)=O]

In some embodiments, Y is

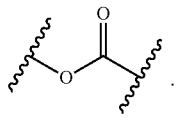 [SMILES: *OC(*)=O]

In some embodiments, Y is

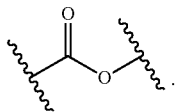 [SMILES: *OC(*)=O]

R¹

In some embodiments, R¹ is —(CH₂)₁₋₆N(Rᵃ)₂ or —(CH₂)₁₋₆OH. In some embodiments, R¹ is —(CH₂)₁₋₆OH. In some embodiments, R¹ is —(CH₂)₁₋₆N(Rᵃ)₂. In some embodiments, R¹ is —(CH₂)₂N(Rᵃ)₂. In some embodiments, R¹ is —(CH₂)₃N(Rᵃ)₂. In some embodiments, R¹ is —(CH₂)₄N(Rᵃ)₂. In some embodiments, R¹ is —(CH₂)₁₋₆N(Me)₂. In some embodiments, R¹ is —(CH₂)₁₋₆N(Et)₂. In some embodiments, R¹ is —(CH₂)₁₋₆N(n-Pr)₂. In some embodiments, R¹ is —(CH₂)₁₋₆N(i-Pr)₂. In some embodiments, R¹ is —(CH₂)₂N(Me)₂. In some embodiments, R¹ is —(CH₂)₃N(Me)₂. In some embodiments, R¹ is —(CH₂)₄N(Me)₂. In some embodiments, R¹ is —(CH₂)₂N(Et)₂. In some embodiments, R¹ is —(CH₂)₃N(Et)₂. In some embodiments, R¹ is —(CH₂)₄N(Et)₂.

In some embodiments, R¹ is selected from the group consisting of

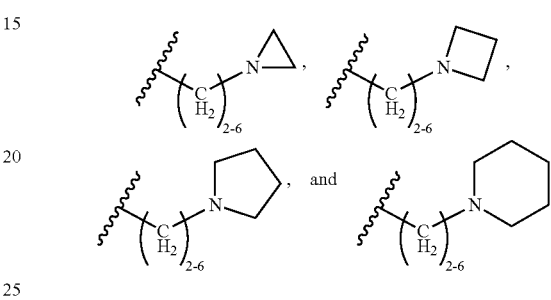

In some embodiments, R¹ is selected from the group consisting of

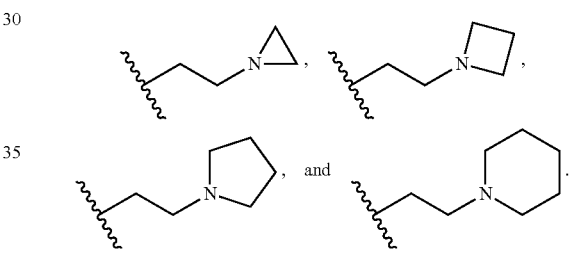

In some embodiments, R¹ is selected from the group consisting of

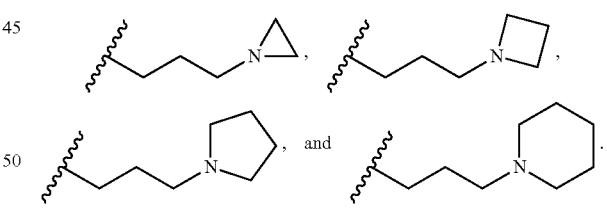

R² and R²'

In some embodiments, R² is optionally substituted C₁-C₃₆ alkyl or optionally substituted C₂-C₃₆ alkenyl, wherein 1-6 methylene units of R² are optionally replaced with a group each independently selected from cyclopropylene, —O—, —OC(O)—, and —C(O)O—. In some embodiments, R² is optionally substituted C₁-C₃₂ alkyl or optionally substituted C₂-C₃₂ alkenyl, wherein 1-6 methylene units of R² are optionally replaced with a group each independently selected from cyclopropylene, —O—, —OC(O)—, and —C(O)O—. In some embodiments, R² is optionally substituted C₁-C₃₀ alkyl or optionally substituted C₂-C₃₀ alkenyl, wherein 1-6 methylene units of R² are optionally replaced with a group each independently selected from cyclopropylene, —O—, —OC(O)—, and —C(O)O—. In some embodiments, $R^2$ is optionally substituted $C_1$-$C_{24}$ alkyl or optionally substituted $C_2$-$C_{24}$ alkenyl, wherein 1-6 methylene units of $R^2$ are optionally replaced with a group each independently selected from cyclopropylene, —O—, —OC(O)—, and —C(O)O—. In some embodiments, $R^2$ is optionally substituted $C_1$-$C_{24}$ alkyl or optionally substituted $C_2$-$C_{24}$ alkenyl, wherein 1-6 methylene units of $R^2$ are replaced with a group each independently selected from cyclopropylene, —O—, —OC(O)—, and —C(O)O—. In some embodiments, $R^2$ is optionally substituted $C_1$-$C_{24}$ alkyl or optionally substituted $C_2$-$C_{24}$ alkenyl. In some embodiments, $R^2$ is optionally substituted $C_{10}$-$C_{24}$ alkyl or optionally substituted $C_{10}$-$C_{24}$ alkenyl, wherein 1-6 methylene units of $R^2$ are replaced with —O—.

In some embodiments, $R^2$ is optionally substituted $C_5$-$C_{36}$ alkyl or optionally substituted $C_5$-$C_{36}$ alkenyl, wherein 2 methylene units of $R^2$ are replaced with —O— to form an acetal within $R^2$, and wherein 1-6 methylene units of $R^2$ are optionally replaced with a group each independently selected from cyclopropylene, —O—, —OC(O)—, and —C(O)O—; and $R^{2'}$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—.

In some embodiments, $R^2$ is optionally substituted $C_{10}$-$C_{24}$ alkyl or optionally substituted $C_{10}$-$C_{24}$ alkenyl, wherein 2 methylene units of $R^2$ are replaced with —O— to form an acetal within $R^2$ and wherein 1-6 methylene units of $R^2$ are optionally replaced with a group each independently selected from cyclopropylene, —O—, —OC(O)—, and —C(O)O—; and $R^{2'}$ is optionally substituted $C_{10}$-$C_{36}$ branched alkyl or optionally substituted $C_{10}$-$C_{36}$ alkenyl, wherein 1-6 methylene units of $R^2$ are optionally replaced with a group each independently selected from cyclopropylene, —O—, —OC(O)—, and —C(O)O—.

In some embodiments, $R^2$ is $C_3$-$C_{36}$ branched alkyl or optionally substituted $C_3$-$C_{36}$ branched alkenyl, wherein 1-6 methylene units of $R^2$ are optionally replaced with a group each independently selected from cyclopropylene and —O—; and $R^{2'}$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—. In some embodiments, $R^2$ is optionally substituted $C_{10}$-$C_{24}$ branched alkyl or optionally substituted $C_{10}$-$C_{24}$ branched alkenyl, wherein 1-3 methylene units of $R^2$ are optionally replaced with —O—; and $R^{2'}$ is optionally substituted $C_{10}$-$C_{36}$ alkyl or optionally substituted $C_{10}$-$C_{36}$ alkenyl, wherein 1-6 methylene units of $R^2$ are optionally replaced with a group each independently selected from cyclopropylene, —O—, —OC(O)—, and —C(O)O—.

In some embodiments, $R^2$ and/or $R^{2'}$ is

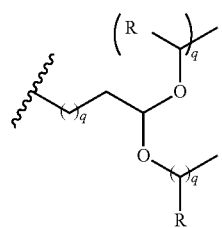

wherein each q is independently selected from 0-12 and each $R°$ is independently selected, and is as described and defined herein.

In some embodiments, $R^2$ and/or $R^{2'}$ is

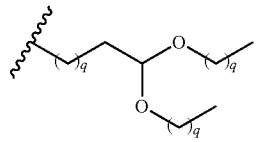

wherein each q is independently selected from 0-12.

In some embodiments, $R^2$ is optionally substituted $C_5$-$C_{36}$ alkyl or optionally substituted $C_5$-$C_{36}$ alkenyl, wherein 2 methylene units of $R^2$ are replaced with —O— to form an acetal within $R^2$, and wherein 1-6 methylene units of $R^2$ are optionally replaced with a group each independently selected from cyclopropylene, —O—, —OC(O)—, and —C(O)O—; $R^{2'}$ is optionally substituted $C_1$-$C_{36}$ alkyl or optionally substituted $C_5$-$C_{36}$ alkenyl, wherein 1-6 methylene units of $R^{2'}$ are optionally replaced with a group each independently selected from cyclopropylene, —O—, —OC(O)—, and —C(O)O—.

In some embodiments, $R^2$ is optionally substituted $C_{10}$-$C_{24}$ alkyl, wherein 2 methylene units of $R^2$ are replaced with —O— to form an acetal within $R^2$; and $R^{2'}$ is optionally substituted $C_{10}$-$C_{24}$ alkyl, wherein 2 methylene units of $R^{2'}$ are replaced with —O— to form an acetal within $R^{2'}$.

In some embodiments, each q is independently selected from 0-6. In some embodiments, each q is independently selected from 0-8. In some embodiments, each q is independently selected from 0-10. In some embodiments, each q is independently selected from 0-12.

In some embodiments, $R^2$ is optionally substituted $C_{10}$-$C_{24}$ alkyl or optionally substituted C10-C24 alkenyl, wherein 2 methylene units of $R^2$ are replaced with —O— to form an acetal within $R^2$ and wherein 1-6 methylene units of $R^2$ are optionally replaced with a group each independently selected from cyclopropylene, —O—, —OC(O)—, and —C(O)O—; and $R^{2'}$ is optionally substituted $C_{10}$-$C_{24}$ alkenyl, wherein 1-3 methylene units of $R^{2'}$ are optionally replaced with —O—.

In some embodiments, $R^2$ is selected from the group consisting of

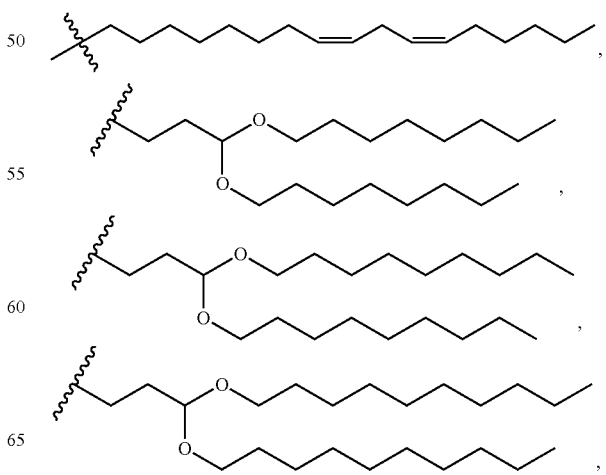

-continued

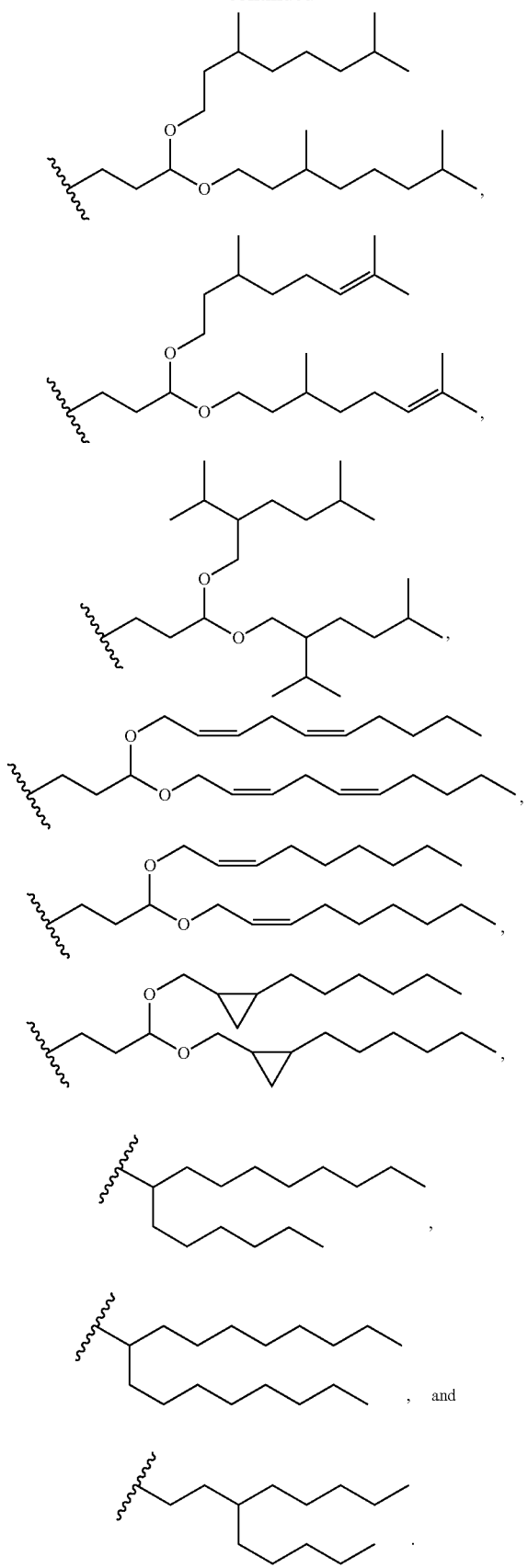

In some embodiments, $R^2$ is

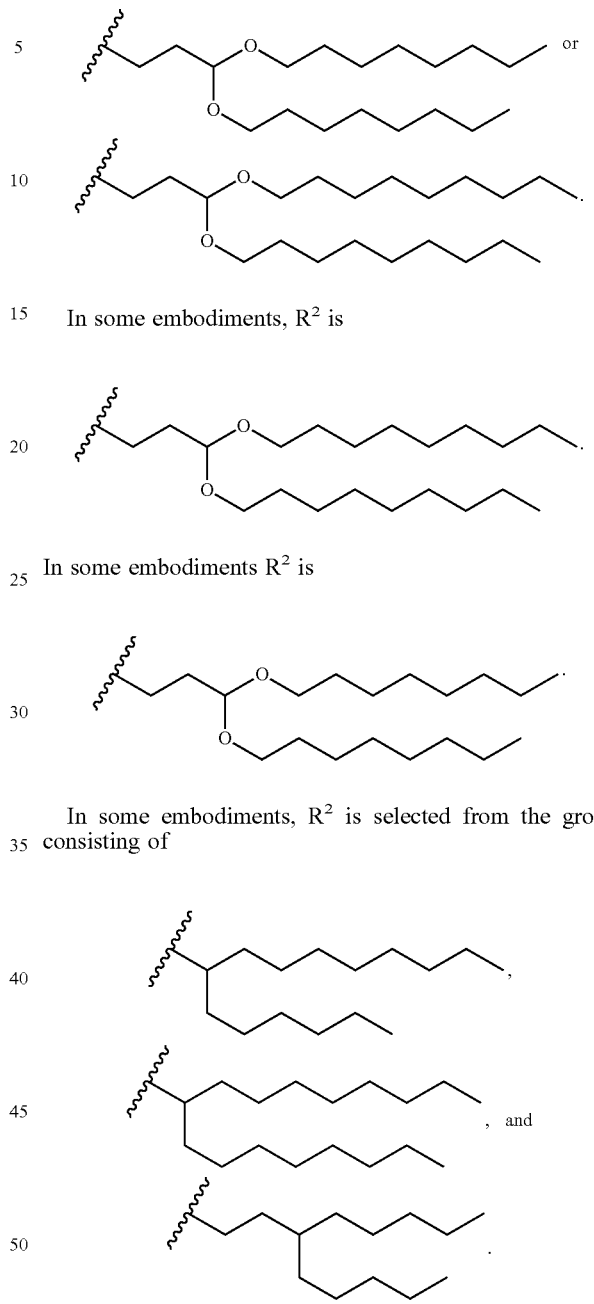

In some embodiments, $R^2$ is

In some embodiments $R^2$ is

In some embodiments, $R^2$ is selected from the group consisting of

In some embodiments, $R^{2'}$ is optionally substituted $C_1$-$C_{36}$ alkyl, wherein 1-6 methylene units of $R^{2'}$ are optionally replaced with a group each independently selected from cyclopropylene, —O—, —OC(O)—, and —C(O)O—. In some embodiments, $R^{2'}$ is optionally substituted $C_1$-$C_{32}$ alkyl, wherein 1-6 methylene units of $R^{2'}$ are optionally replaced with a group each independently selected from cyclopropylene, —O—, —OC(O)—, and —C(O)O—. In some embodiments, $R^{2'}$ is optionally substituted $C_1$-$C_{30}$ alkyl, wherein 1-6 methylene units of $R^{2'}$ are optionally replaced with a group each independently selected from cyclopropylene, —O—, —OC(O)—, and —C(O)O—. In some embodiments, $R^{2'}$ is optionally substituted $C_1$-$C_{24}$ alkyl, wherein 1-6 methylene units of $R^{2'}$ are optionally replaced with a group each independently selected from cyclopropylene, —O—, —OC(O)—, and —C(O)O—. In some embodiments, R² is optionally substituted C₁-C₂₄ alkyl, wherein 1-6 methylene units of R²' are replaced with a group each independently selected from —O—, —OC(O)—, and —C(O)O—. In some embodiments, R²' is optionally substituted C₁-C₂₄ alkyl. In some embodiments, R²' is optionally substituted C₁₀-C₂₄ alkyl, wherein 1-6 methylene units of R²' are replaced with —O—.

In some embodiments, R² is selected from the group consisting of

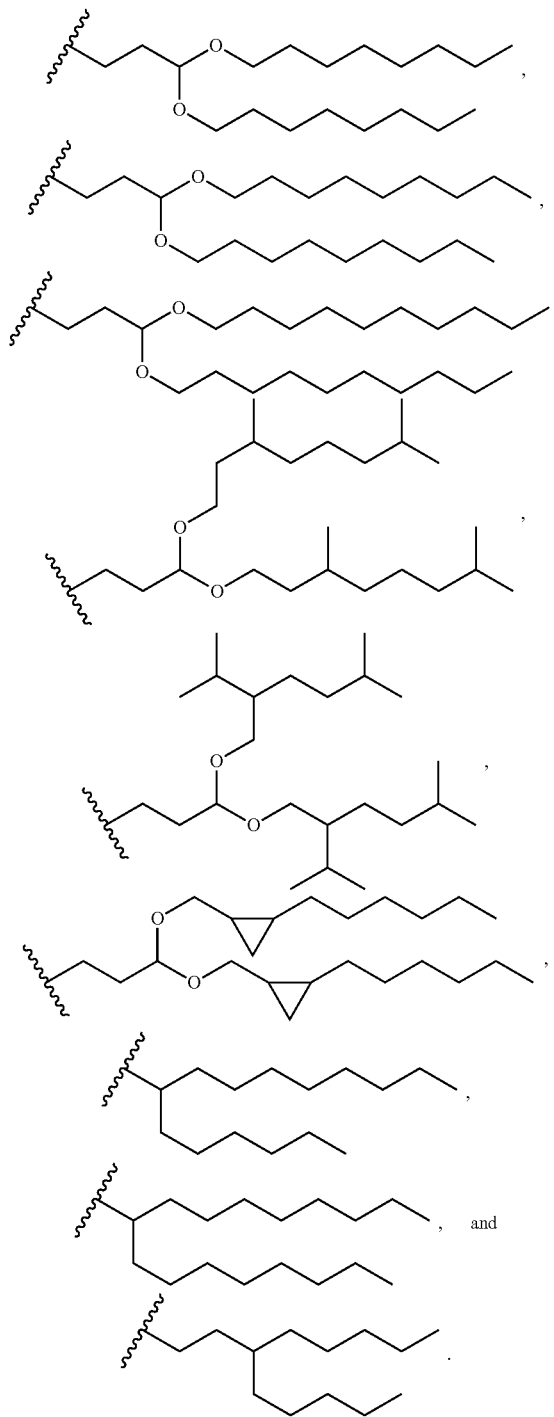

In some embodiments, R² and R²' are each independently selected from the group consisting of

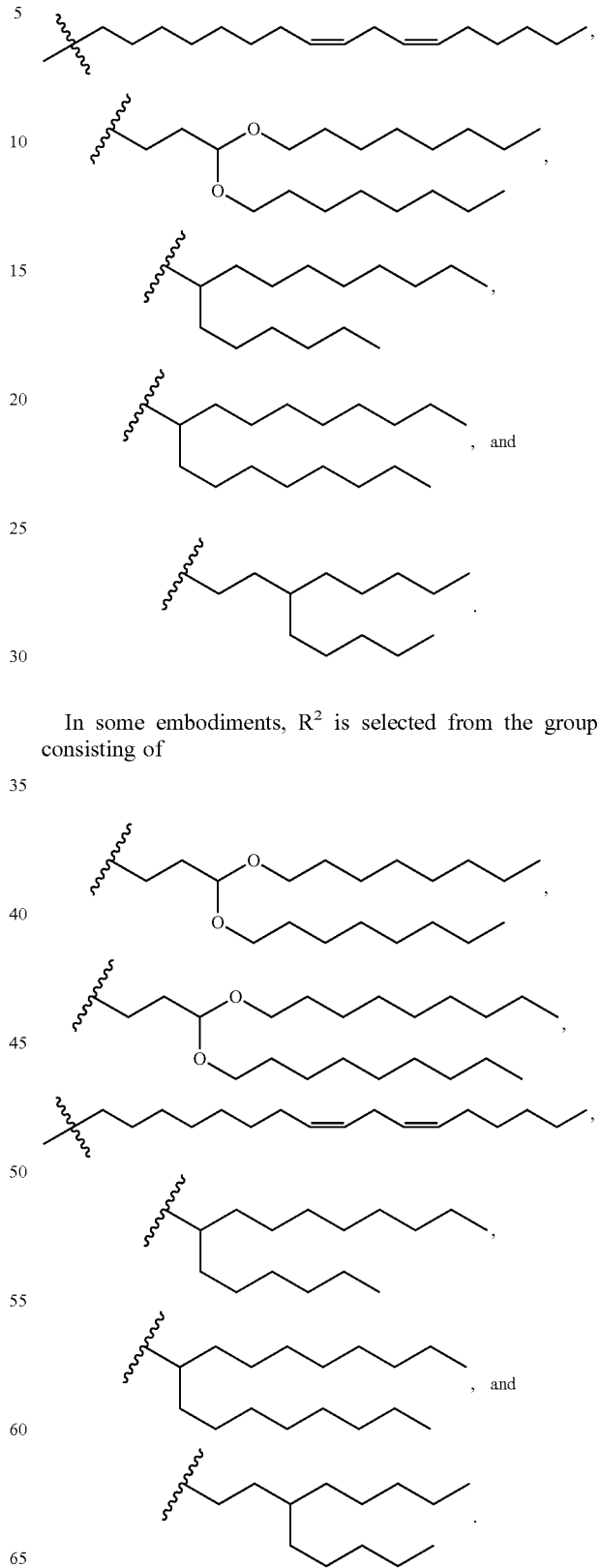

In some embodiments, R² is selected from the group consisting of

In some embodiments $R^2$ is

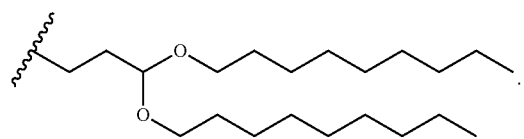 [SMILES: *CCC(OCCCCCCCCC)OCCCCCCCCC]

In some embodiments, $R^{2'}$ is

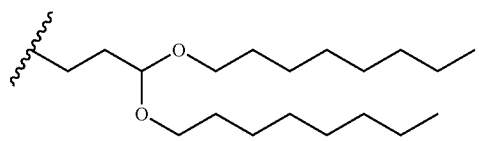

In some embodiments, $R^{2'}$ is selected from the group consisting of

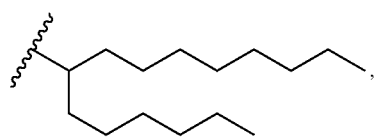, and

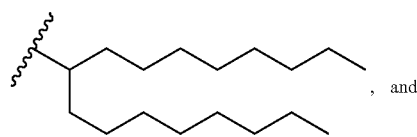

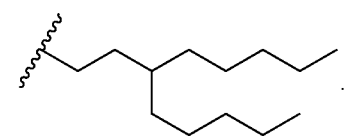.

In some embodiments, $R^2$ is selected from the group consisting of

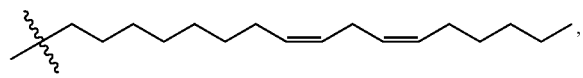,

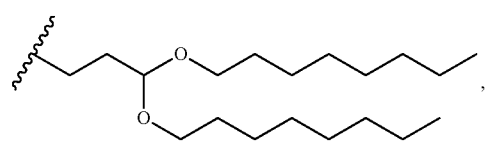 [SMILES: *CCC(OCCCCCCCC)OCCCCCCCC],

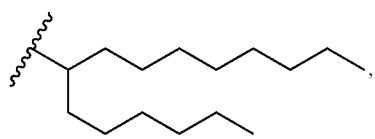,

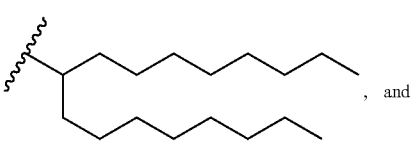, and

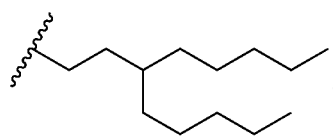.

In some embodiments, $R^{2'}$ is selected from the group consisting of

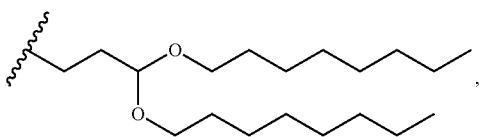,

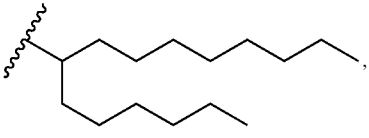,

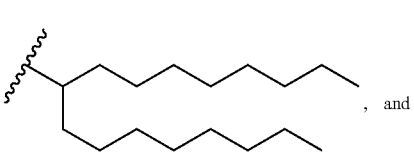, and

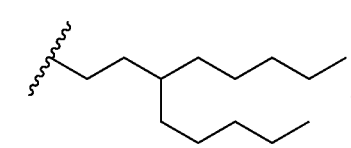.

In some embodiments, the present disclosure includes a compound selected from any lipid in Table (IV) below or a pharmaceutically acceptable salt thereof:

TABLE (IV)

Non-Limiting Examples of Ionizable Lipids

| Structure | Compound No. |
|---|---|
| 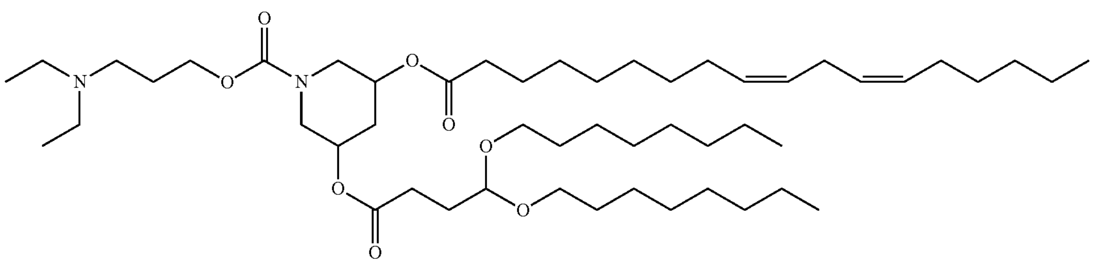 [SMILES: CCCCC/C=C\C/C=C\CCCCCCCC(=O)OC1CC(OC(=O)CCC(OCCCCCCCC)OCCCCCCCC)CN(C(=O)OCCCN(CC)CC)C1] | CX-1 |
| 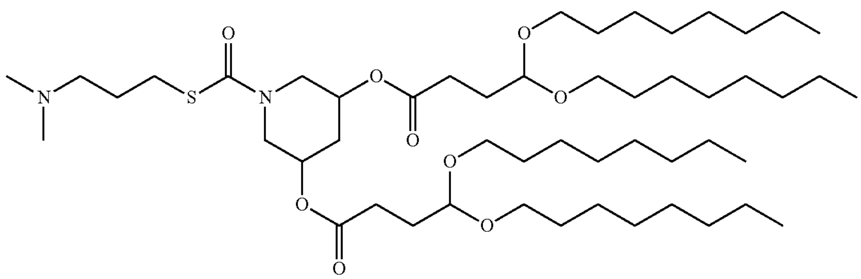 [SMILES: CCCCCCCCOC(CCC(=O)OC1CC(OC(=O)CCC(OCCCCCCCC)OCCCCCCCC)CN(C(=O)SCCCN(C)C)C1)OCCCCCCCC] | CX-2 |
| 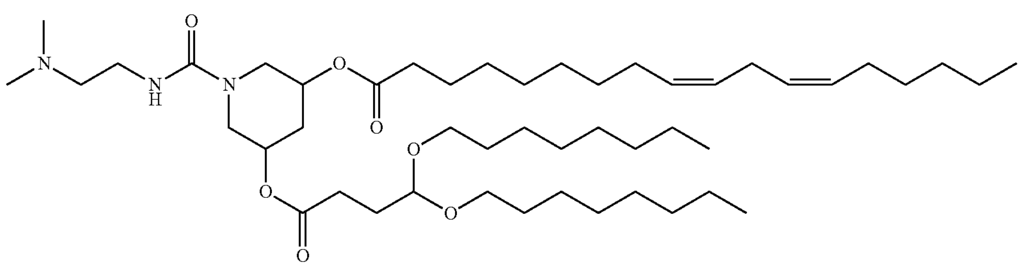 [SMILES: CCCCC/C=C\C/C=C\CCCCCCCC(=O)OC1CC(OC(=O)CCC(OCCCCCCCC)OCCCCCCCC)CN(C(=O)NCCN(C)C)C1] | CX-3 |
| 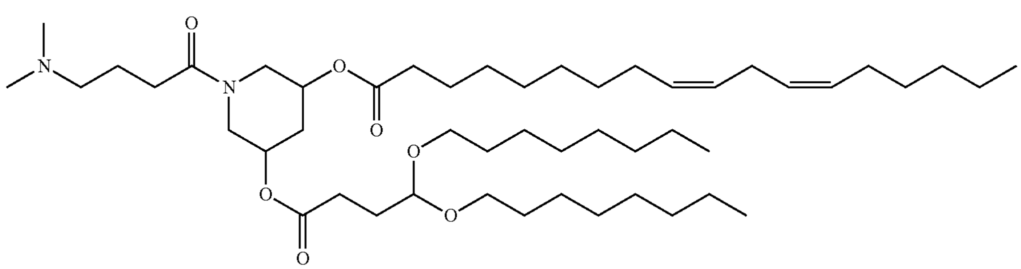 [SMILES: CCCCC/C=C\C/C=C\CCCCCCCC(=O)OC1CC(OC(=O)CCC(OCCCCCCCC)OCCCCCCCC)CN(C(=O)CCCN(C)C)C1] | CX-4 |
| 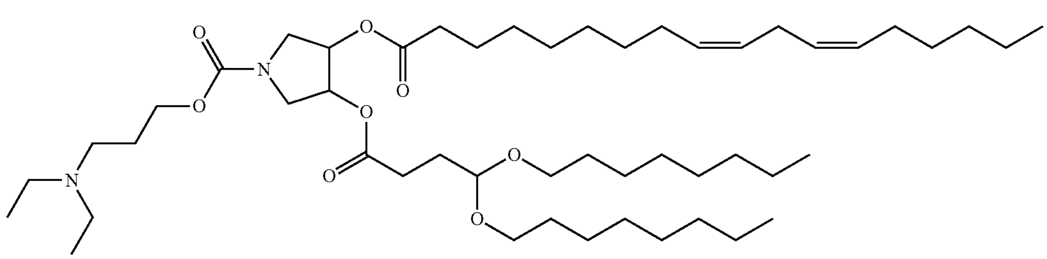 [SMILES: CCCCC/C=C\C/C=C\CCCCCCCC(=O)OC1CN(C(=O)OCCCN(CC)CC)CC1OC(=O)CCC(OCCCCCCCC)OCCCCCCCC] | CX-5 |

TABLE (IV)-continued

Non-Limiting Examples of Ionizable Lipids

| Structure | Compound No. |
|---|---|
| 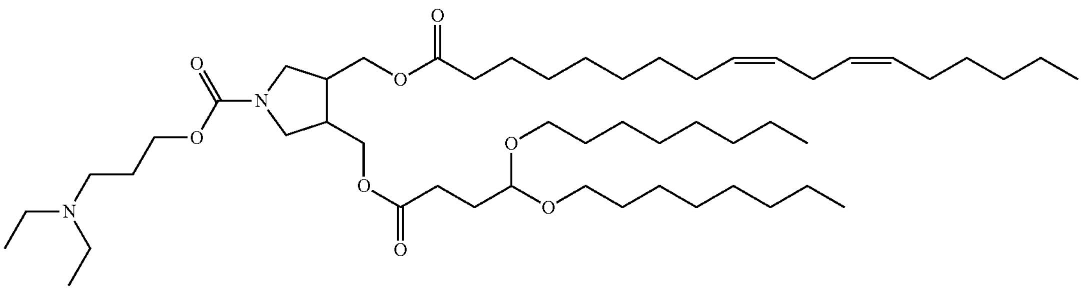 [SMILES: CCCCC/C=C\C/C=C\CCCCCCCC(=O)OCC1CN(C(=O)OCCCN(CC)CC)CC1COC(=O)CCC(OCCCCCCCC)OCCCCCCCC] | CX-6 |
| 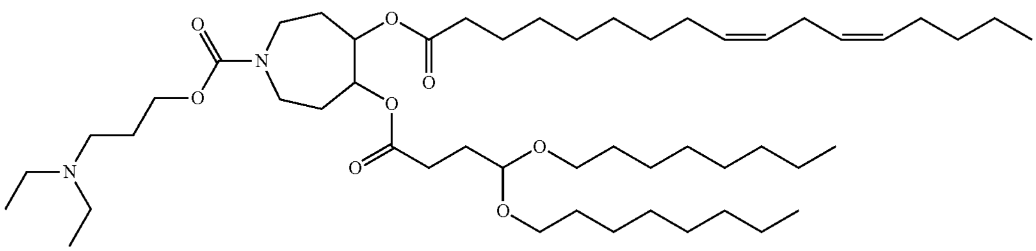 [SMILES: CCCC/C=C\C/C=C\CCCCCCCC(=O)OC1CCN(C(=O)OCCCN(CC)CC)CCC1OC(=O)CCC(OCCCCCCCC)OCCCCCCCC] | CX-7 |
| 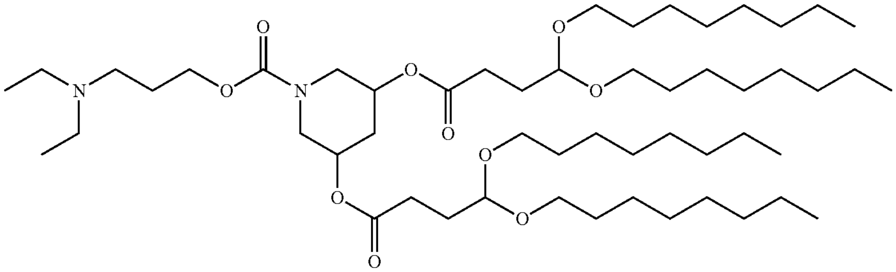 [SMILES: CCCCCCCCOC(CCC(=O)OC1CC(OC(=O)CCC(OCCCCCCCC)OCCCCCCCC)CN(C(=O)OCCCN(CC)CC)C1)OCCCCCCCC] | CX-8 |
| 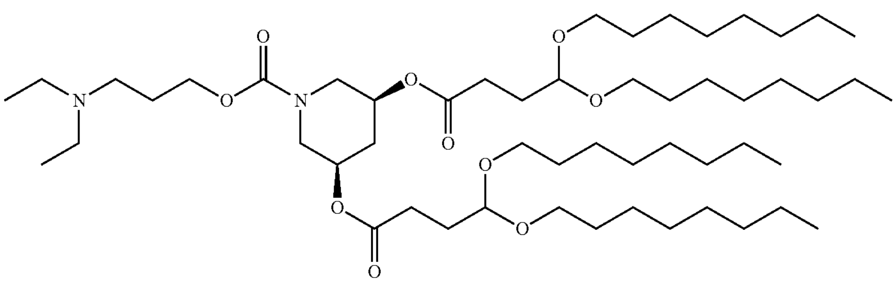 [SMILES: CCCCCCCCOC(CCC(=O)O[C@@H]1C[C@H](OC(=O)CCC(OCCCCCCCC)OCCCCCCCC)CN(C(=O)OCCCN(CC)CC)C1)OCCCCCCCC] | CX-8a |
| 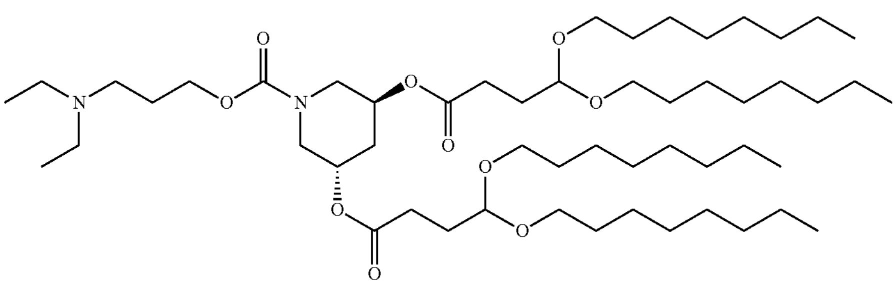 [SMILES: CCCCCCCCOC(CCC(=O)O[C@H]1C[C@H](OC(=O)CCC(OCCCCCCCC)OCCCCCCCC)CN(C(=O)OCCCN(CC)CC)C1)OCCCCCCCC] | CX-8b |

TABLE (IV)-continued

Non-Limiting Examples of Ionizable Lipids

| Structure | Compound No. |
|---|---|
| 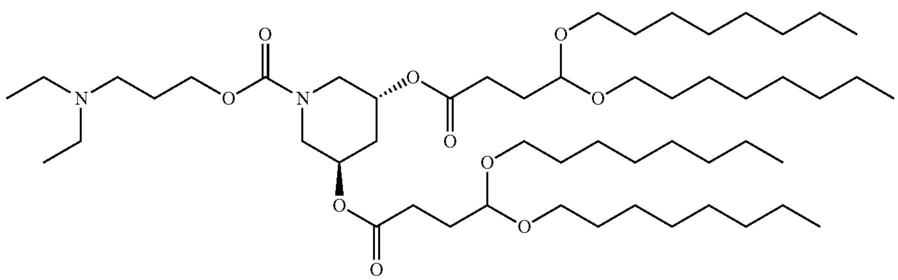 [SMILES: CCCCCCCCOC(CCC(=O)O[C@@H]1C[C@@H](OC(=O)CCC(OCCCCCCCC)OCCCCCCCC)CN(C(=O)OCCCN(CC)CC)C1)OCCCCCCCC] | CX-8c |
| 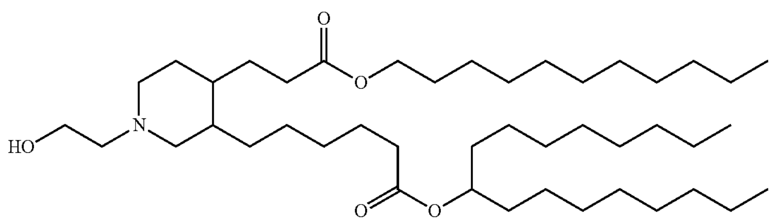 [SMILES: CCCCCCCCCCCOC(=O)CCC1CCN(CCO)CC1CCCCCC(=O)OC(CCCCCCCC)CCCCCCCC] | CX-9 |
| 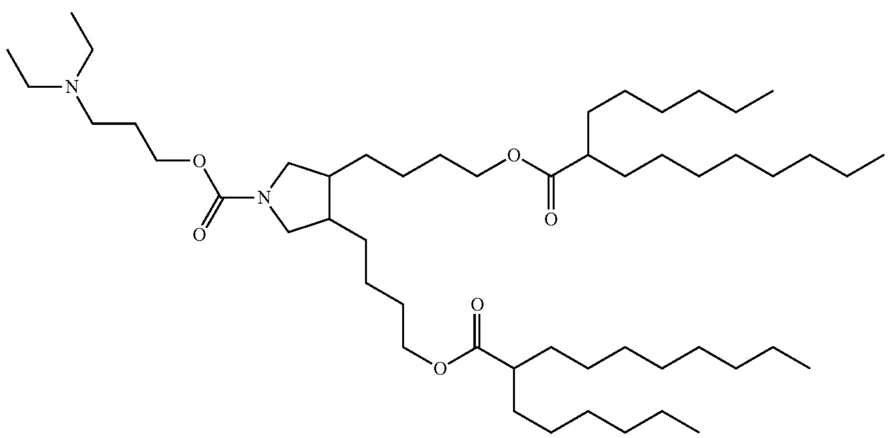 [SMILES: CCCCCCCCC(CCCCCC)C(=O)OCCCCC1CN(C(=O)OCCCN(CC)CC)CC1CCCCOC(=O)C(CCCCCC)CCCCCCCC] | CX-10 |
| 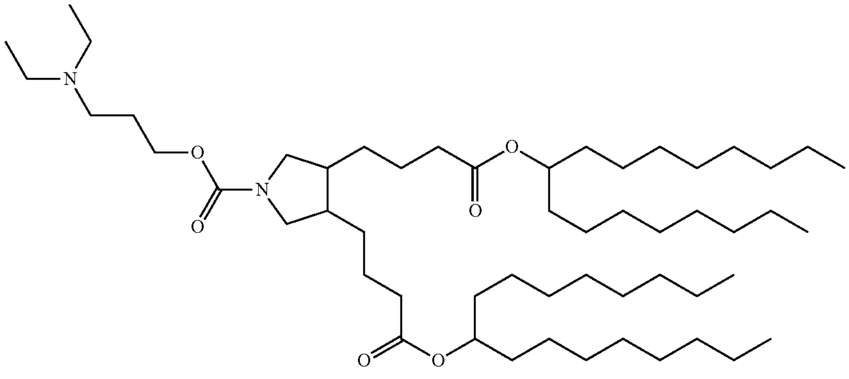 [SMILES: CCCCCCCCC(CCCCCCCC)OC(=O)CCCC1CN(C(=O)OCCCN(CC)CC)CC1CCCC(=O)OC(CCCCCCCC)CCCCCCCC] | CX-11 |

TABLE (IV)-continued

Non-Limiting Examples of Ionizable Lipids

| Structure | Compound No. |
|---|---|
| 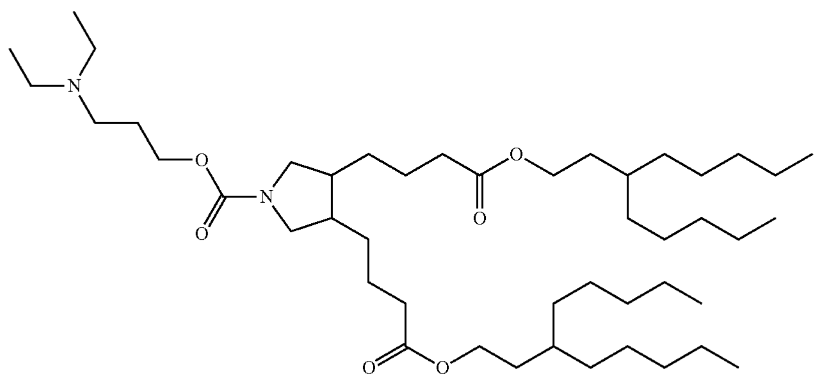 [SMILES: CCCCCC(CCCCC)CCOC(=O)CCCC1CN(C(=O)OCCCN(CC)CC)CC1CCCC(=O)OCCC(CCCCC)CCCCC] | CX-12 |
| 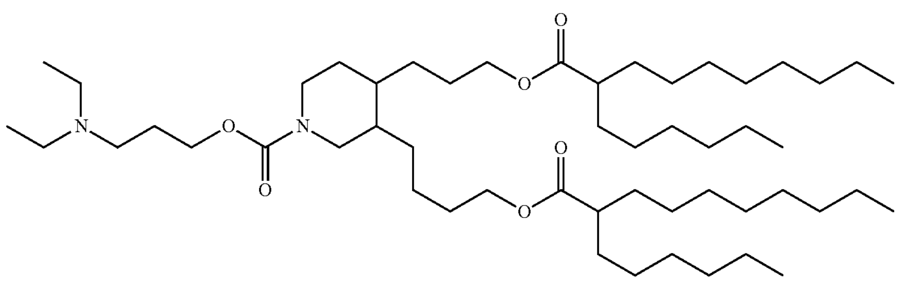 [SMILES: CCCCCCCCC(CCCCCC)C(=O)OCCCCC1CN(C(=O)OCCCN(CC)CC)CCC1CCCOC(=O)C(CCCCCC)CCCCCCCC] | CX-13 |
| 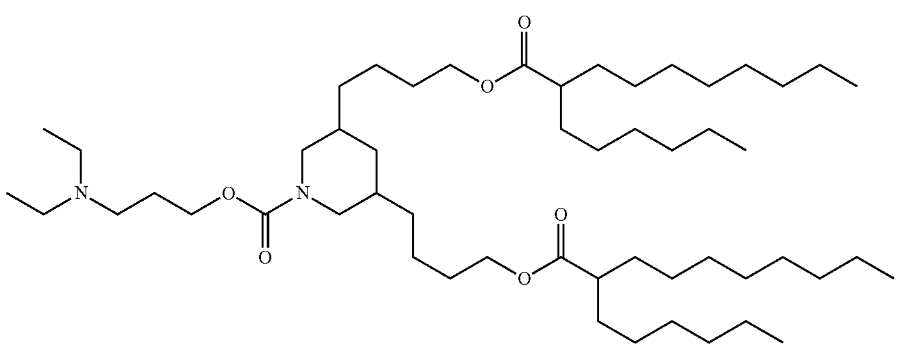 [SMILES: CCCCCCCCC(CCCCCC)C(=O)OCCCCC1CC(CCCCOC(=O)C(CCCCCC)CCCCCCCC)CN(C(=O)OCCCN(CC)CC)C1] | CX-14 |
| 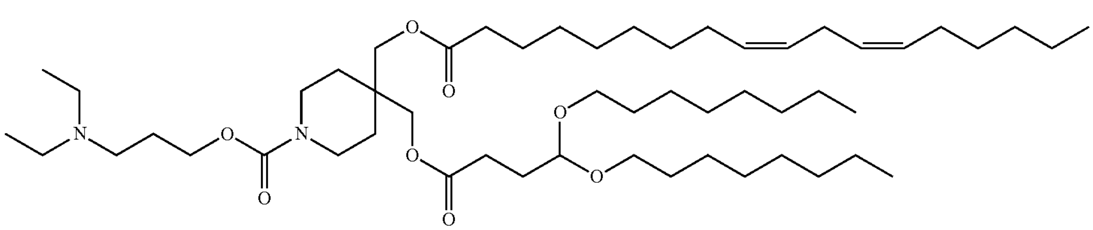 [SMILES: CCCCC/C=C\C/C=C\CCCCCCCC(=O)OCC1(COC(=O)CCC(OCCCCCCCC)OCCCCCCCC)CCN(C(=O)OCCCN(CC)CC)CC1] | CX-15 |
| 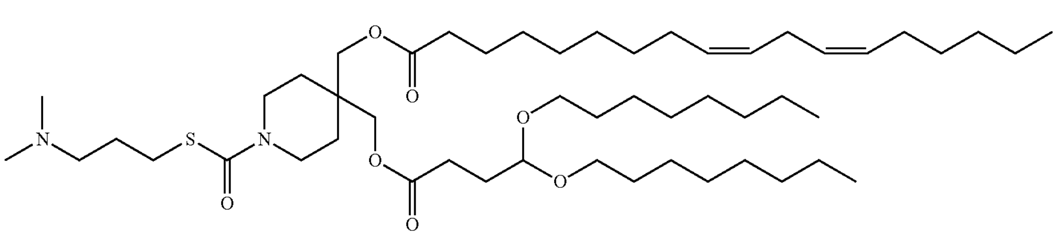 [SMILES: CCCCC/C=C\C/C=C\CCCCCCCC(=O)OCC1(COC(=O)CCC(OCCCCCCCC)OCCCCCCCC)CCN(C(=O)SCCCN(C)C)CC1] | CX-16 |

TABLE (IV)-continued
Non-Limiting Examples of Ionizable Lipids
| Structure | Compound No. |
|---|---|
| 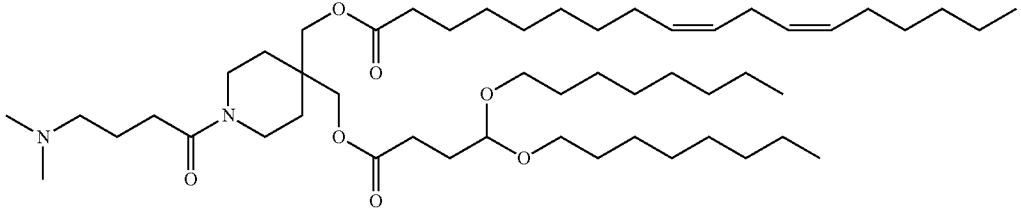 [SMILES: CCCCC/C=C\C/C=C\CCCCCCCC(=O)OCC1(COC(=O)CCC(OCCCCCCCC)OCCCCCCCC)CCN(C(=O)CCCN(C)C)CC1] | CX-17 |
| 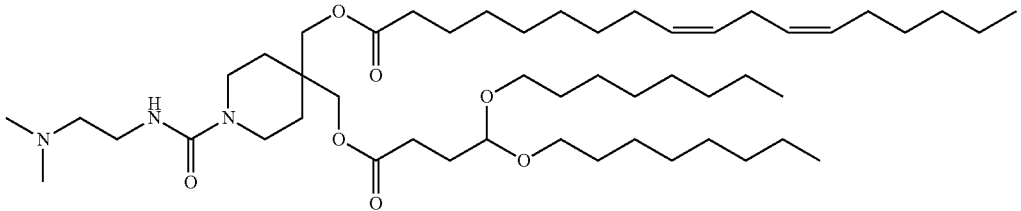 [SMILES: CCCCC/C=C\C/C=C\CCCCCCCC(=O)OCC1(COC(=O)CCC(OCCCCCCCC)OCCCCCCCC)CCN(C(=O)NCCN(C)C)CC1] | CX-18 |
| 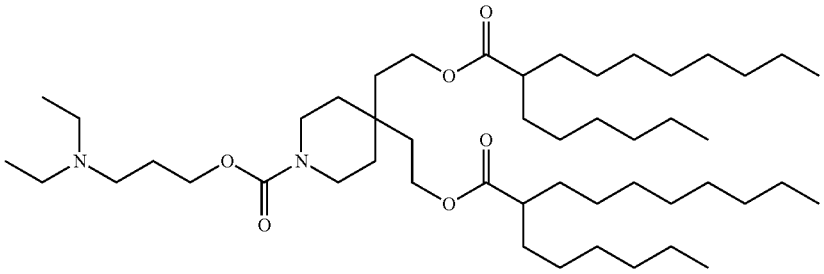 [SMILES: CCCCCCCCC(CCCCCC)C(=O)OCCC1(CCOC(=O)C(CCCCCC)CCCCCCCC)CCN(C(=O)OCCCN(CC)CC)CC1] | CX-19 |
| 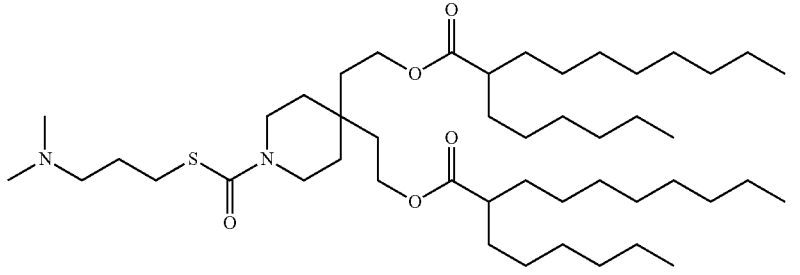 [SMILES: CCCCCCCCC(CCCCCC)C(=O)OCCC1(CCOC(=O)C(CCCCCC)CCCCCCCC)CCN(C(=O)SCCCN(C)C)CC1] | CX-20 |
| 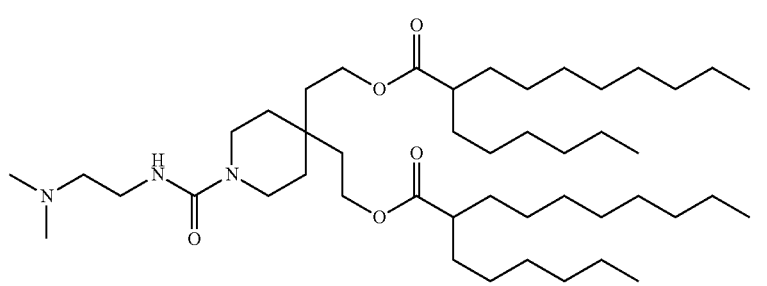 [SMILES: CCCCCCCCC(CCCCCC)C(=O)OCCC1(CCOC(=O)C(CCCCCC)CCCCCCCC)CCN(C(=O)NCCN(C)C)CC1] | CX-21 |

TABLE (IV)-continued
Non-Limiting Examples of Ionizable Lipids
| Structure | Compound No. |
|---|---|
| 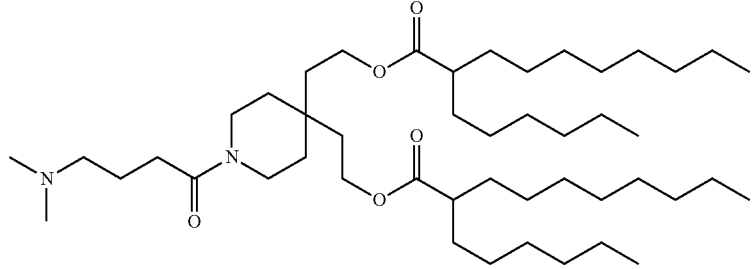 [SMILES: CCCCCCCCC(CCCCCC)C(=O)OCCC1(CCOC(=O)C(CCCCCC)CCCCCCCC)CCN(C(=O)CCCN(C)C)CC1] | CX-22 |
| 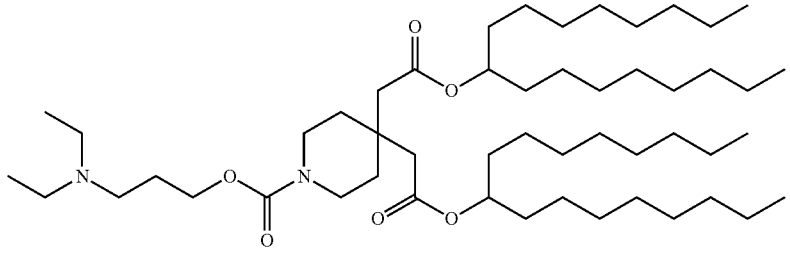 [SMILES: CCCCCCCCC(CCCCCCCC)OC(=O)CC1(CC(=O)OC(CCCCCCCC)CCCCCCCC)CCN(C(=O)OCCCN(CC)CC)CC1] | CX-23 |
| 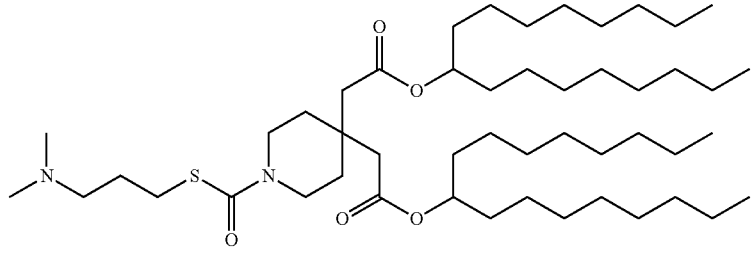 [SMILES: CCCCCCCCC(CCCCCCCC)OC(=O)CC1(CC(=O)OC(CCCCCCCC)CCCCCCCC)CCN(C(=O)SCCCN(C)C)CC1] | CX-24 |
| 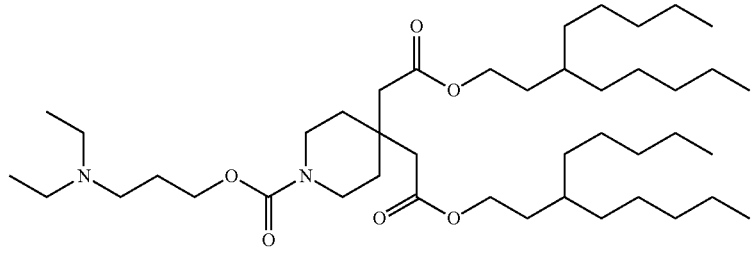 [SMILES: CCCCCC(CCCCC)CCOC(=O)CC1(CC(=O)OCCC(CCCCC)CCCCC)CCN(C(=O)OCCCN(CC)CC)CC1] | CX-25 |
| 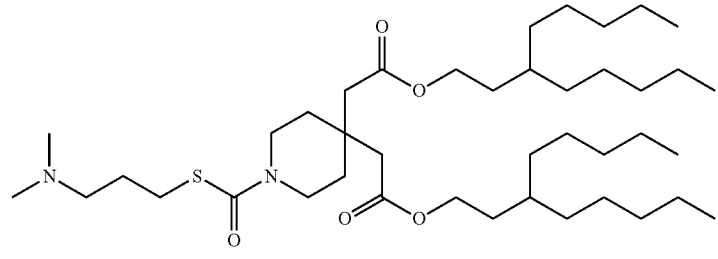 [SMILES: CCCCCC(CCCCC)CCOC(=O)CC1(CC(=O)OCCC(CCCCC)CCCCC)CCN(C(=O)SCCCN(C)C)CC1] | CX-26 |

TABLE (IV)-continued

Non-Limiting Examples of Ionizable Lipids

| Structure | Compound No. |
|---|---|
| 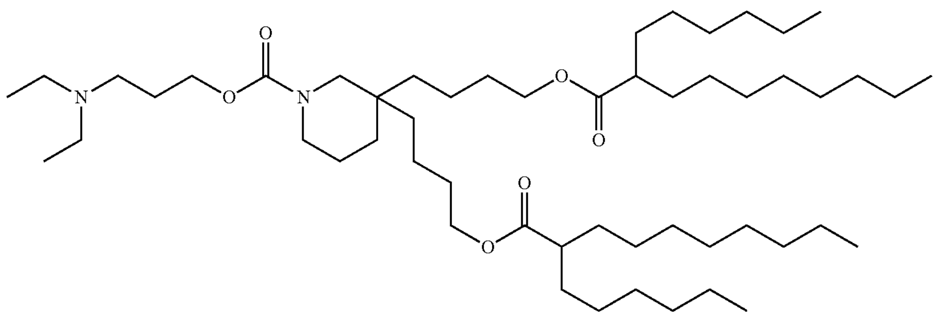 [SMILES: CCCCCCCCC(CCCCCC)C(=O)OCCCCC1(CCCCOC(=O)C(CCCCCC)CCCCCCCC)CCCN(C(=O)OCCCN(CC)CC)C1] | CX-27 |
| 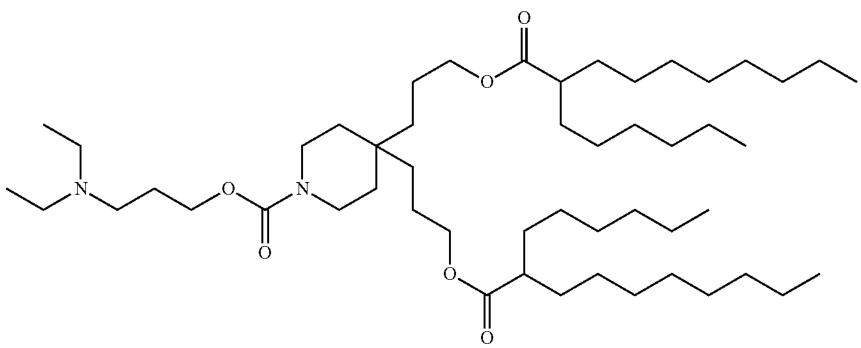 [SMILES: CCCCCCCCC(CCCCCC)C(=O)OCCCC1(CCCOC(=O)C(CCCCCC)CCCCCCCC)CCN(C(=O)OCCCN(CC)CC)CC1] | CX-28 |
| 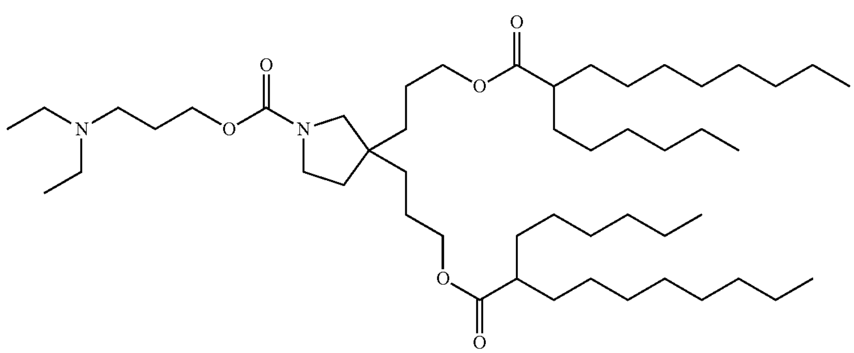 [SMILES: CCCCCCCCC(CCCCCC)C(=O)OCCCC1(CCCOC(=O)C(CCCCCC)CCCCCCCC)CCN(C(=O)OCCCN(CC)CC)C1] | CX-29 |
| 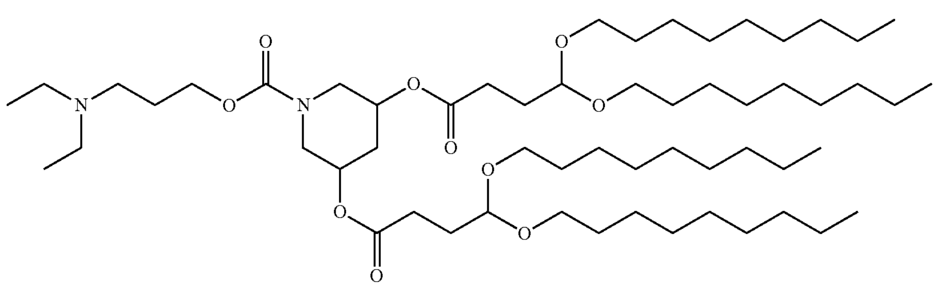 [SMILES: CCCCCCCCCOC(CCC(=O)OC1CC(OC(=O)CCC(OCCCCCCCCC)OCCCCCCCCC)CN(C(=O)OCCCN(CC)CC)C1)OCCCCCCCCC] | CX-30 |

TABLE (IV)-continued

Non-Limiting Examples of Ionizable Lipids

| Structure | Compound No. |
|---|---|
| 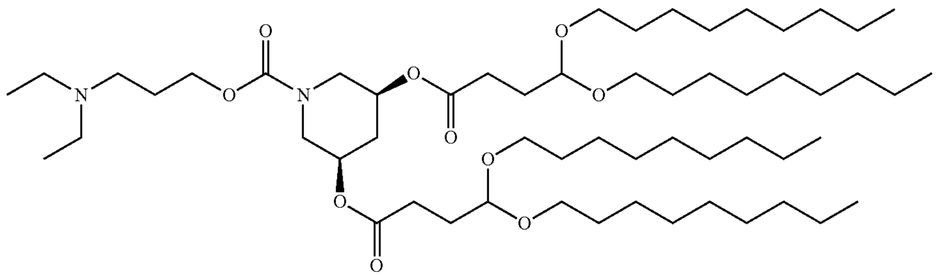 [SMILES: CCCCCCCCCOC(CCC(=O)O[C@@H]1C[C@H](OC(=O)CCC(OCCCCCCCCC)OCCCCCCCCC)CN(C(=O)OCCCN(CC)CC)C1)OCCCCCCCCC] | CX-30a |
| 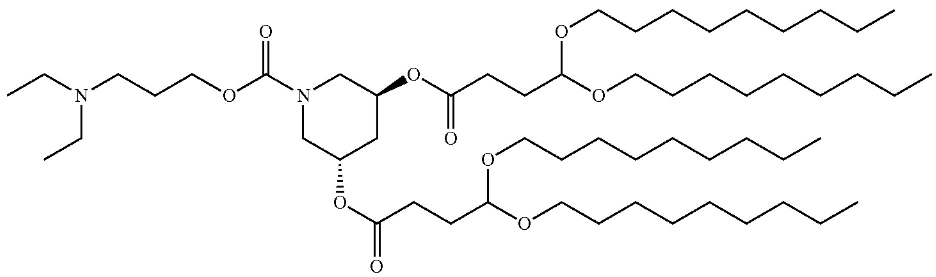 [SMILES: CCCCCCCCCOC(CCC(=O)O[C@H]1C[C@H](OC(=O)CCC(OCCCCCCCCC)OCCCCCCCCC)CN(C(=O)OCCCN(CC)CC)C1)OCCCCCCCCC] | CX-30b |
| 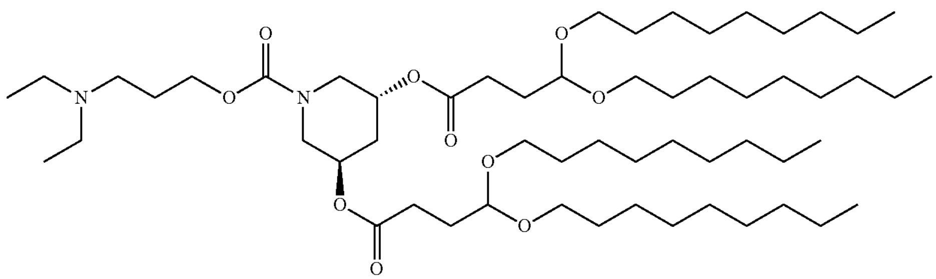 [SMILES: CCCCCCCCCOC(CCC(=O)O[C@@H]1C[C@@H](OC(=O)CCC(OCCCCCCCCC)OCCCCCCCCC)CN(C(=O)OCCCN(CC)CC)C1)OCCCCCCCCC] | CX-30c |

In some embodiments, lipids of the present disclosure comprise a heterocyclic core, wherein the heteroatom is nitrogen. In some embodiments, the heterocyclic core comprises pyrrolidine or a derivative thereof. In some embodiments, the heterocyclic core comprises piperidine or a derivative thereof.

In some embodiments, a compound of the present disclosure is represented by Formula

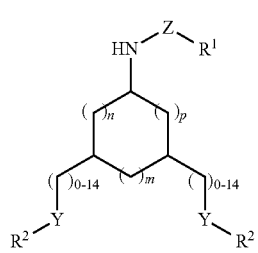
(CZ-I)

or a pharmaceutically acceptable salt thereof, wherein

Z is selected from the group consisting of a bond

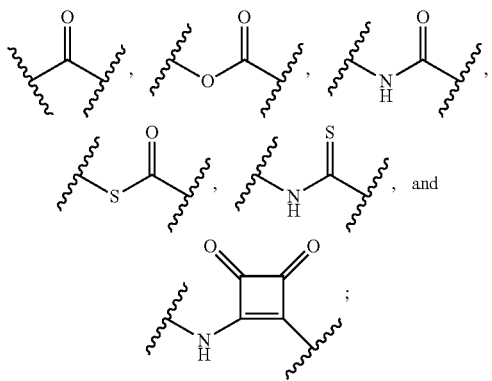
, and

;

each Y is independently selected from the group consisting of

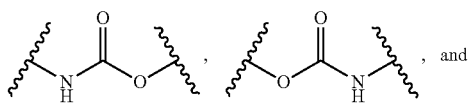
, and

-continued

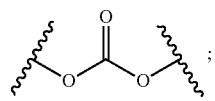;

$R^1$ is —$(CH_2)_{1-6}N(R^a)_2$;

each $R^2$ is independently optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;

each $R^a$ is independently optionally substituted $C_1$-$C_6$ alkyl; or two $R^a$ are taken together, with the nitrogen on which they are attached, to form an optionally substituted 4-7 membered heterocyclyl ring;

m is 0, 1, or 2;

n is 1 or 2; and p is 1 or 2.

In some embodiments, a compound of the present disclosure is represented by Formula (CZ—I-a), (CZ—I-b), (CZ—I-c), or (CZ—I-d)

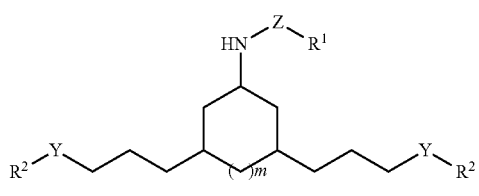
(CZ-I-a)

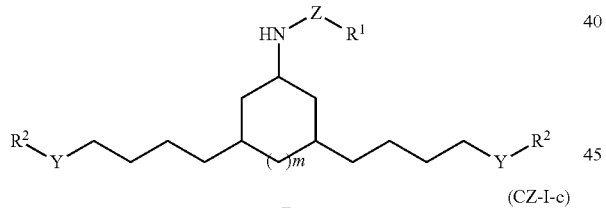
(CZ-I-b)

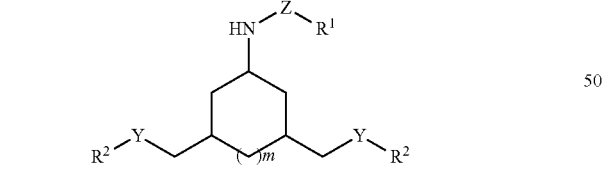
(CZ-I-c)

(CZ-I-d)

or a pharmaceutically acceptable salt thereof.

In some embodiments, a compound of the present disclosure is represented by Formula (CZ—I-e) or (CZ—I-f)

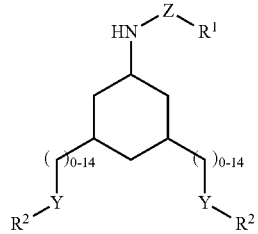
(CZ-I-e)

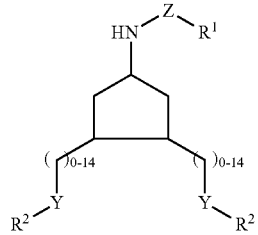
(CZ-I-f)

or a pharmaceutically acceptable salt thereof.

In some embodiments, a compound of the present disclosure is represented by Formula (CZ—I-g)

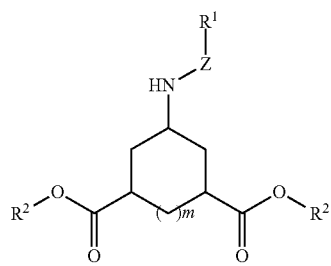
(CZ-I-g)

or a pharmaceutically acceptable salt thereof.

In some embodiments, a compound of the present disclosure is represented by Formula (CZ-II)

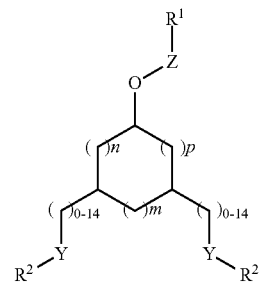
(CZ-II)

or a pharmaceutically acceptable salt thereof, wherein

Z is selected from the group consisting of a bond,

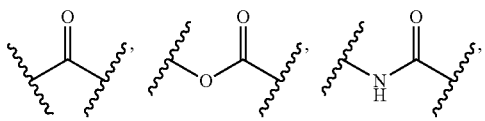

383
-continued

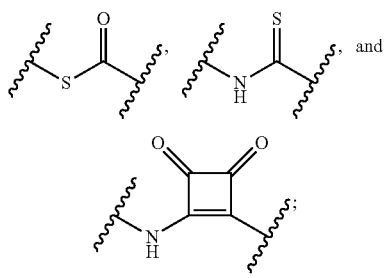
, and

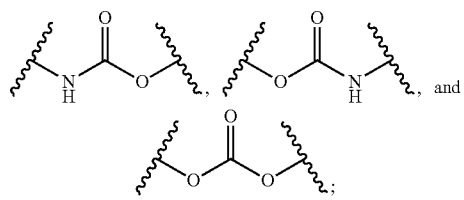
;

each Y is independently selected from the group consisting of,

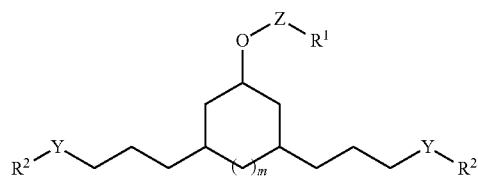
, and

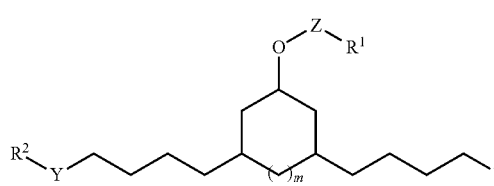
;

$R^1$ is —$(CH_2)_{1-6}N(R^a)_2$;

each $R^2$ is independently optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—;

each $R^a$ is independently optionally substituted $C_1$-$C_6$ alkyl; or two $R^a$ are taken together, with the nitrogen on which they are attached, to form an optionally substituted 4-7 membered heterocyclyl ring;

m is 0, 1, or 2;

n is 1 or 2; and p is 1 or 2.

or a pharmaceutically acceptable salt thereof.

In some embodiments, a compound of the present disclosure is represented by Formula (CZ-II-a), (CZ-II-b), (CZ-II-c) or (CZ-II-d):

(CZ-II-a)

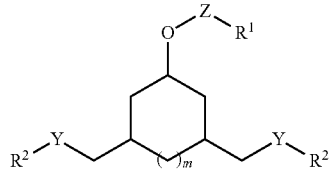

(CZ-II-b)

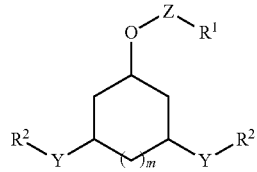

384
-continued (CZ-II-c)

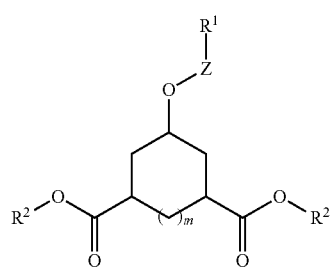

(CZ-II-d)

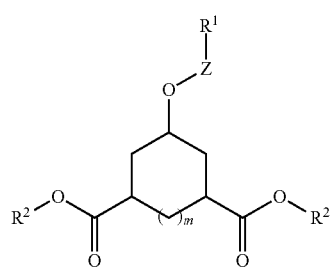

or a pharmaceutically acceptable salt thereof.

In some embodiments, a compound of the present disclosure is represented by Formula (CZ-II-e)

(CZ-II-e)

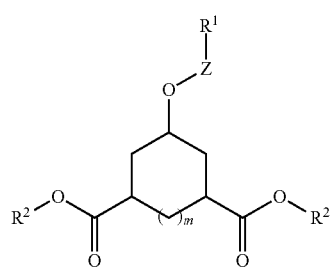

or a pharmaceutically acceptable salt thereof.

Z

In some embodiments, Z is selected from the group consisting of a bond,

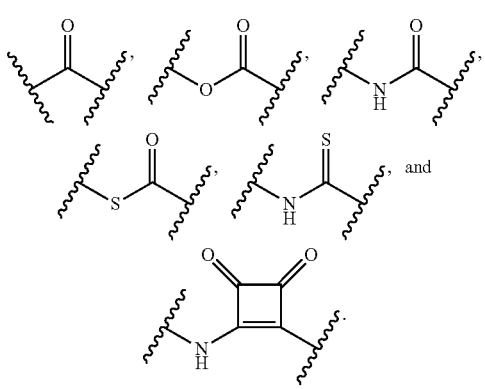

In some embodiments, Z is selected from the group consisting of

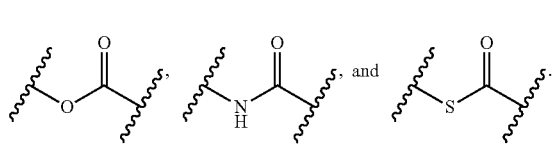 [SMILES: *OC(*)=O ; *NC(*)=O ; *SC(*)=O]

In some embodiments, Z is

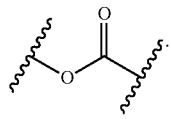 [SMILES: *OC(*)=O]

In some embodiments, Z is selected from the group consisting of a bond,

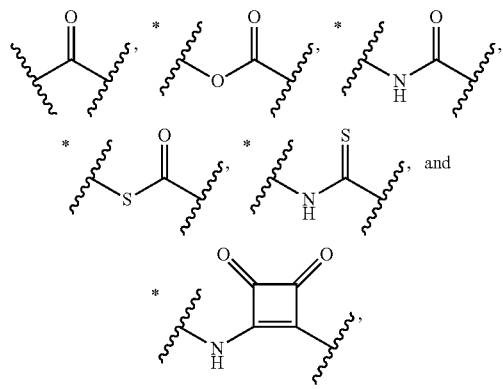

and wherein R is attached at the position denoted by *.

In some embodiments, Z is selected from the group consisting of

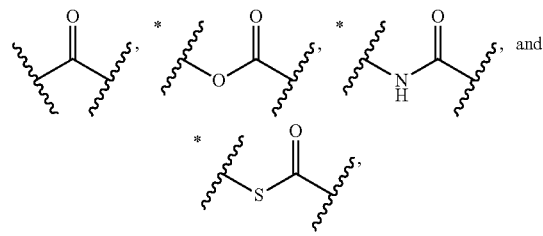

wherein $R^1$ is attached at the position denoted by *.

In some embodiments, Z is

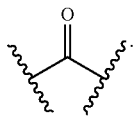 [SMILES: *C(*)=O]

In some embodiments, Z is

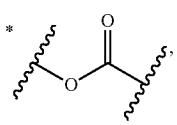

wherein $R^1$ is attached at the position denoted by *. In some embodiments, Z is

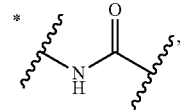

wherein $R^1$ is attached at the position denoted by *. In some embodiments, Z is

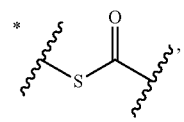

wherein $R^1$ is attached at the position denoted by *. In some embodiments, Z is

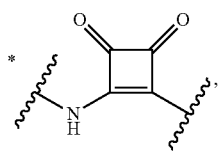

wherein $R^1$ is attached at the position denoted by *.

Y

In some embodiments, Y is selected from the group consisting of

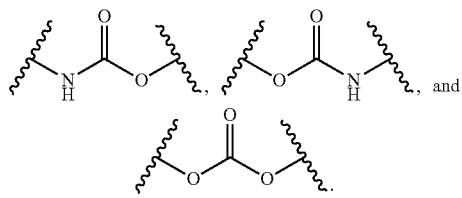

and

In some embodiments, Y is

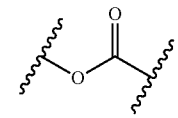 [SMILES: *OC(*)=O]

or

In some embodiments, Y is selected from the group consisting of,

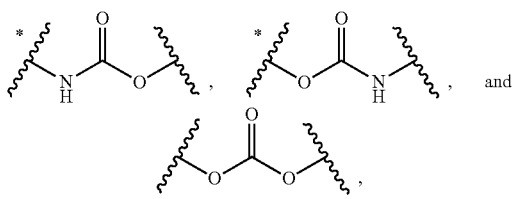

wherein $R^2$ is attached at the position denoted by *.

In some embodiments, Y is, wherein $R^2$ is attached at the position denoted by *. In some embodiments, Y is, wherein $R^2$ is attached at the position denoted by *. In some embodiments, Y is

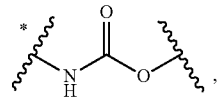

wherein $R^2$ is attached at the position denoted by *. In some embodiments, Y is

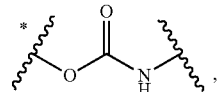

wherein $R^2$ is attached at the position denoted by *. In some embodiments, Y is

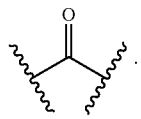 [SMILES: *C(*)=O]

In some embodiments, Y is

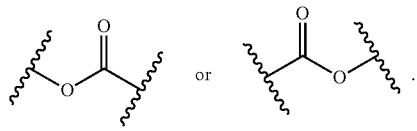 [SMILES: *OC(*)=O ; *OC(*)=O]

In some embodiments, Y is

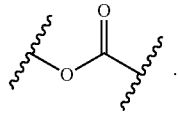 [SMILES: *OC(*)=O]

In some embodiments, Y is

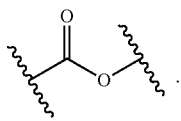 [SMILES: *OC(*)=O]

$R^1$

In some embodiments, $R^1$ is —$(CH_2)_{1-6}N(R^a)_2$. In some embodiments, $R^1$ is —$(CH_2)_2N(R^a)_2$. In some embodiments, $R^1$ is —$(CH_2)_3N(R^a)_2$. In some embodiments, $R^1$ is —$(CH_2)_4N(R^a)_2$. In some embodiments, $R^1$ is —$(CH_2)_{1-6}N(Me)_2$. In some embodiments, $R^1$ is —$(CH_2)_{1-6}N(Et)_2$. In some embodiments, $R^1$ is —$(CH_2)_{1-6}N(n\text{-Pr})_2$. In some embodiments, $R^1$ is —$(CH_2)_{1-6}N(CZ\text{-I-Pr})_2$. In some embodiments, $R^1$ is —$(CH_2)_2N(Me)_2$. In some embodiments, $R^1$ is —$(CH_2)_3N(Me)_2$. In some embodiments, $R^1$ is —$(CH_2)_4N(Me)_2$. In some embodiments, $R^1$ is —$(CH_2)_2N(Et)_2$. In some embodiments, $R^1$ is —$(CH_2)_3N(Et)_2$. In some embodiments, $R^1$ is —$(CH_2)_4N(Et)_2$.

In some embodiments, $R^1$ is selected from the group consisting of

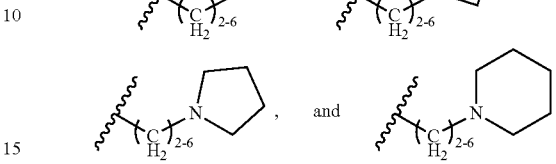

In some embodiments, $R^1$ is selected from the group consisting of

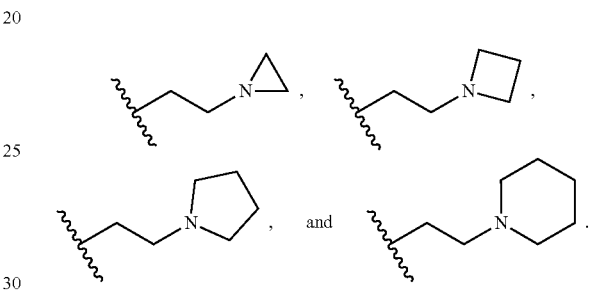

In some embodiments, $R^1$ is selected from the group consisting of

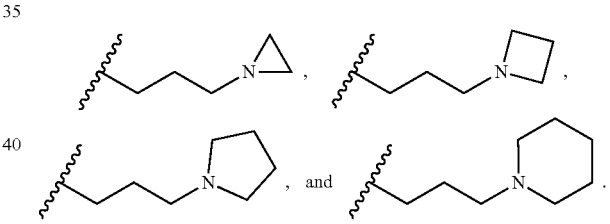

$R^2$

In some embodiments, $R^2$ is optionally substituted $C_1$-$C_{36}$ alkyl or optionally substituted $C_2$-$C_{36}$ alkenyl, wherein 1-6 methylene units of $R^2$ are optionally replaced with a group each independently selected from cyclopropylene, —O—, —OC(O)—, and —C(O)O—. In some embodiments, $R^2$ is optionally substituted $C_1$-$C_{32}$ alkyl or optionally substituted $C_2$-$C_{32}$ alkenyl, wherein 1-6 methylene units of $R^2$ are optionally replaced with a group each independently selected from cyclopropylene, —O—, —OC(O)—, and —C(O)O—. In some embodiments, $R^2$ is optionally substituted $C_1$-$C_{30}$ alkyl or optionally substituted $C_2$-$C_{30}$ alkenyl, wherein 1-6 methylene units of $R^2$ are optionally replaced with a group each independently selected from cyclopropylene, —O—, —OC(O)—, and —C(O)O—. In some embodiments, $R^2$ is optionally substituted $C_1$-$C_{24}$ alkyl or optionally substituted $C_2$-$C_{24}$ alkenyl, wherein 1-6 methylene units of $R^2$ are optionally replaced with a group each independently selected from cyclopropylene, —O—, —OC(O)—, and —C(O)O—. In some embodiments, $R^2$ is optionally substituted $C_1$-$C_{24}$ alkyl or optionally substituted $C_2$-$C_{24}$ alkenyl, wherein 1-6 methylene units of $R^2$ are replaced with a group each independently selected from —O—, —OC(O)—, and —C(O)O—. In some embodiments, $R^2$ is optionally substituted $C_1$-$C_{24}$ alkyl or optionally substituted $C_2$-$C_{24}$ alkenyl. In some embodiments, $R^2$ is optionally substituted $C_{10}$-$C_{24}$ alkyl or optionally substituted $C_{10}$-$C_{24}$ alkenyl, wherein 1-6 methylene units of $R^2$ are replaced with —O—.

In some embodiments, $R^2$ is

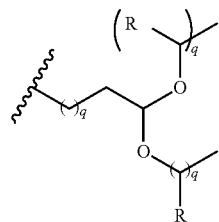

wherein each q is independently selected from 0-12 and each R° is independently selected and defined herein.

In some embodiments, $R^2$ is

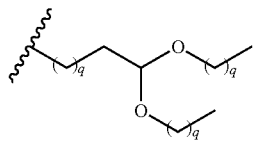

wherein each q is independently selected from 0-12.

In some embodiments, each q is independently selected from 0-6. In some embodiments, each q is independently selected from 0-8. In some embodiments, each q is independently selected from 0-10. In some embodiments, each q is independently selected from 0-12.

In some embodiments, $R^2$ is selected from the group consisting of

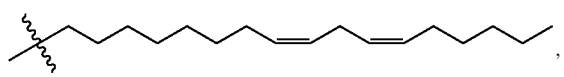

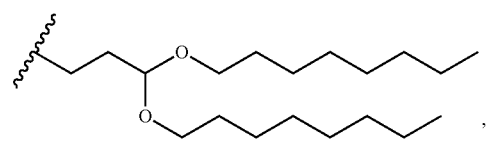

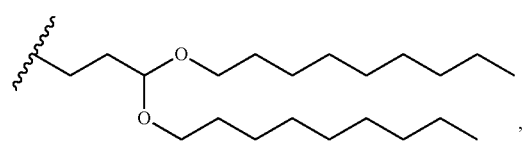

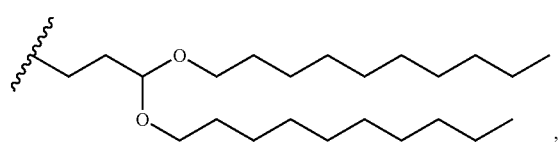

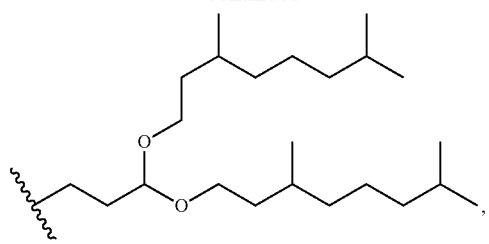

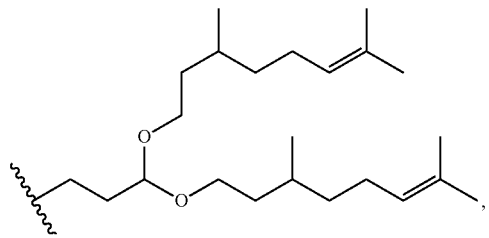

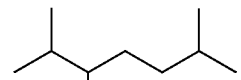

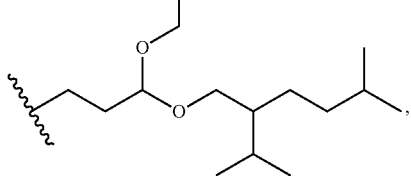

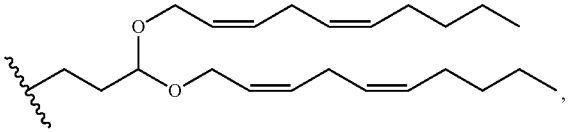

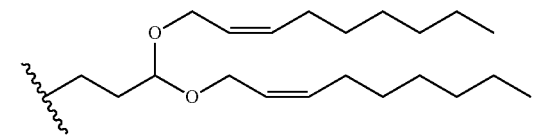

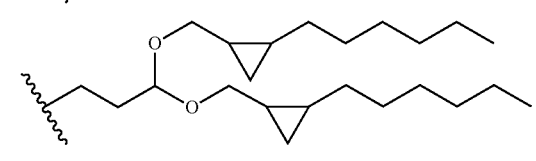

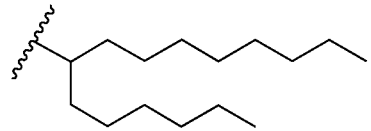

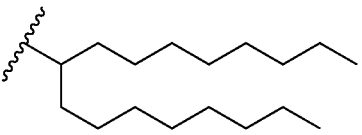

, and

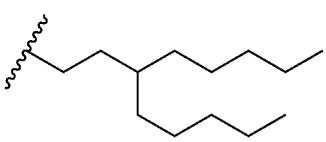

.

In some embodiments, $R^2$ is selected from the group consisting of

391
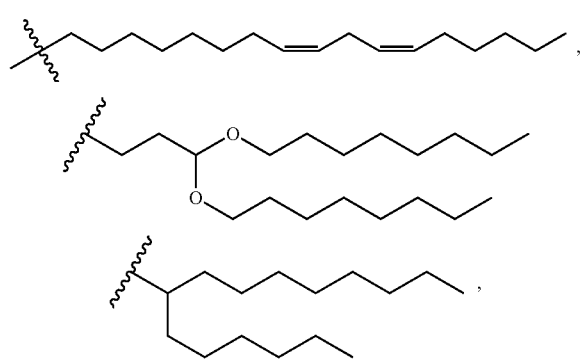
392
-continued
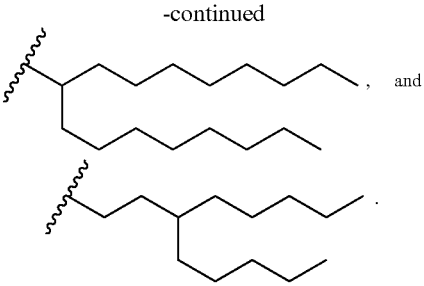
In some embodiments, the present disclosure includes a compound selected from any lipid in Table (V) below or a pharmaceutically acceptable salt thereof:
TABLE (V)
Non-Limiting Examples of Ionizable Lipids
| Structure | Compound No. |
|---|---|
| 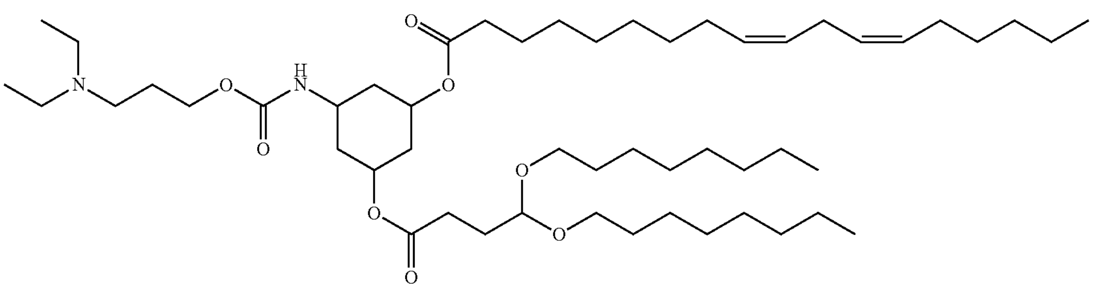 [SMILES: CCCCC/C=C\C/C=C\CCCCCCCC(=O)OC1CC(NC(=O)OCCCN(CC)CC)CC(OC(=O)CCC(OCCCCCCCC)OCCCCCCCC)C1] | CZ-1 |
| 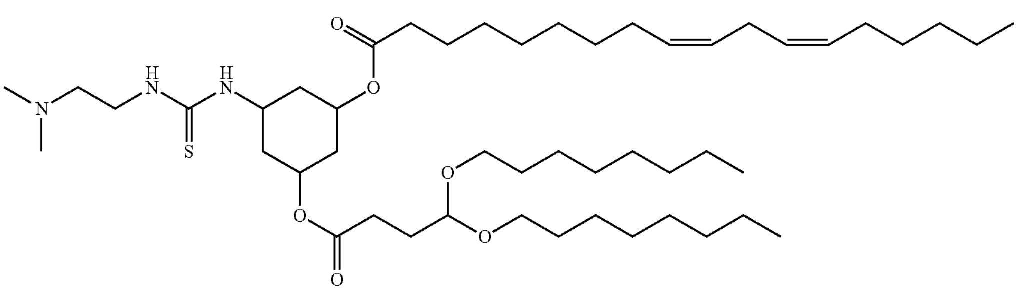 [SMILES: CCCCC/C=C\C/C=C\CCCCCCCC(=O)OC1CC(NC(=S)NCCN(C)C)CC(OC(=O)CCC(OCCCCCCCC)OCCCCCCCC)C1] | CZ-2 |
| 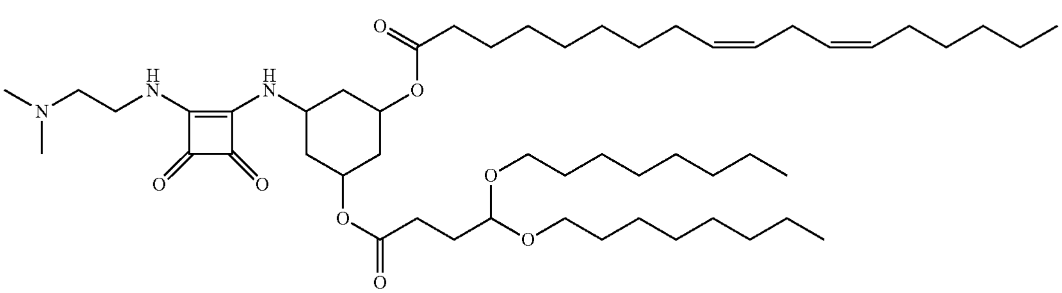 [SMILES: CCCCC/C=C\C/C=C\CCCCCCCC(=O)OC1CC(Nc2c(NCCN(C)C)c(=O)c2=O)CC(OC(=O)CCC(OCCCCCCCC)OCCCCCCCC)C1] | CZ-3 |

TABLE (V)-continued

Non-Limiting Examples of Ionizable Lipids

| Structure | Compound No. |
|---|---|
| 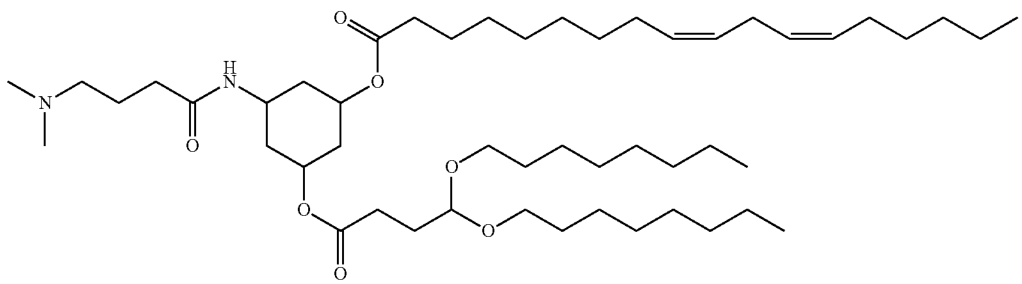 [SMILES: CCCCC/C=C\C/C=C\CCCCCCCC(=O)OC1CC(NC(=O)CCCN(C)C)CC(OC(=O)CCC(OCCCCCCCC)OCCCCCCCC)C1] | CZ-4 |
| 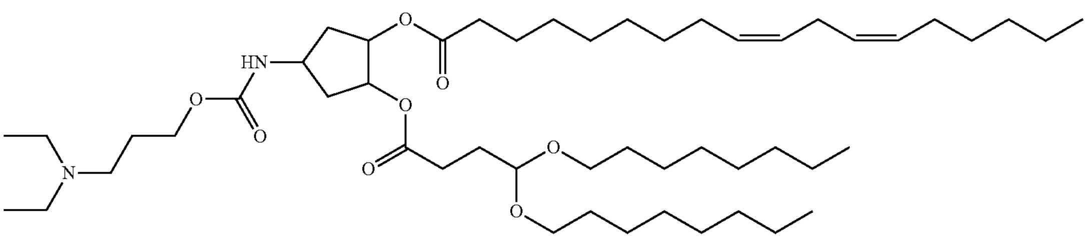 | CZ-5 |
| 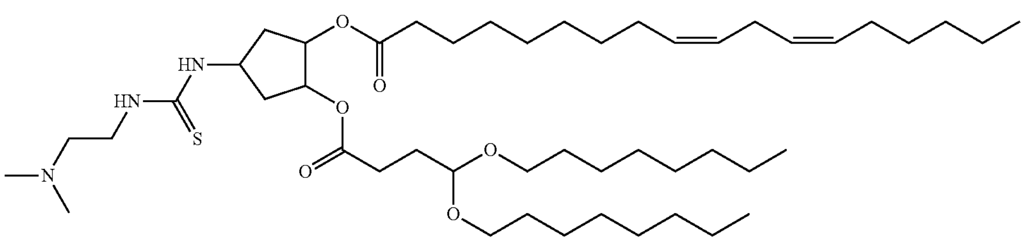 [SMILES: CCCCC/C=C\C/C=C\CCCCCCCC(=O)OC1CC(NC(=S)NCCN(C)C)CC1OC(=O)CCC(OCCCCCCCC)OCCCCCCCC] | CZ-6 |
| 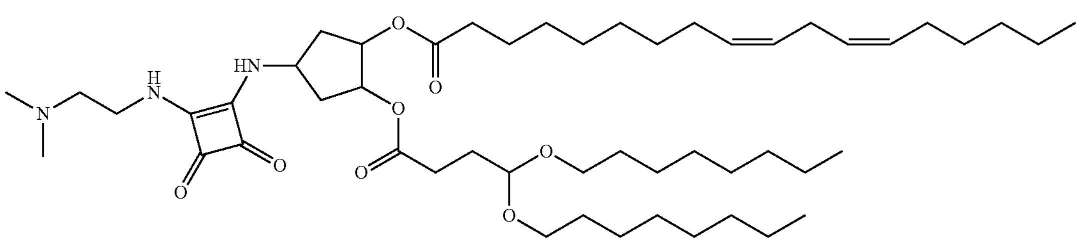 [SMILES: CCCCC/C=C\C/C=C\CCCCCCCC(=O)OC1CC(Nc2c(NCCN(C)C)c(=O)c2=O)CC1OC(=O)CCC(OCCCCCCCC)OCCCCCCCC] | CZ-7 |
| 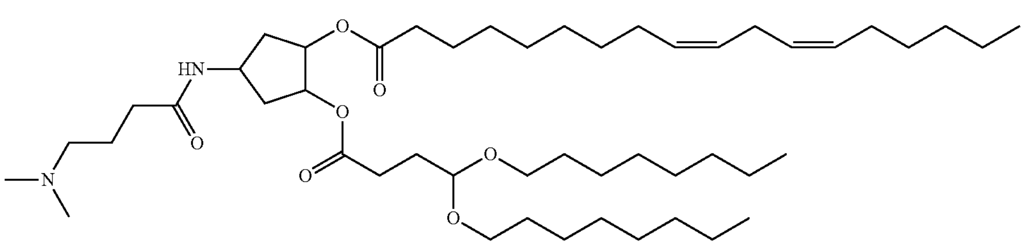 | CZ-8 |

TABLE (V)-continued

Non-Limiting Examples of Ionizable Lipids

| Structure | Compound No. |
|---|---|
| 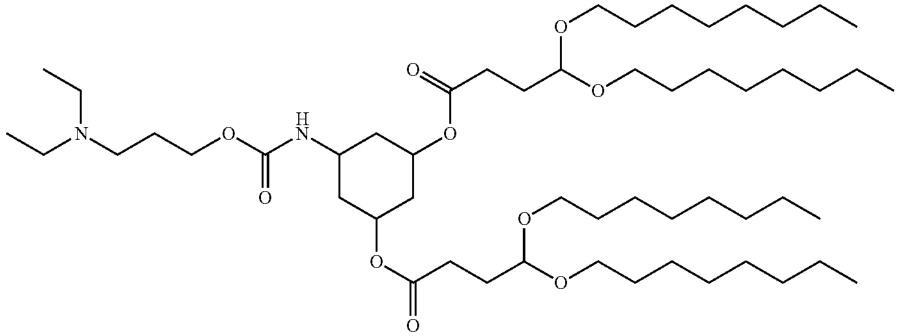 [SMILES: CCCCCCCCOC(CCC(=O)OC1CC(NC(=O)OCCCN(CC)CC)CC(OC(=O)CCC(OCCCCCCCC)OCCCCCCCC)C1)OCCCCCCCC] | CZ-9 |
| 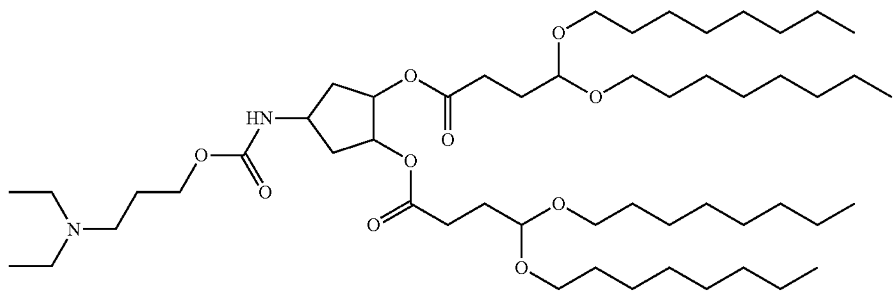 [SMILES: CCCCCCCCOC(CCC(=O)OC1CC(NC(=O)OCCCN(CC)CC)CC1OC(=O)CCC(OCCCCCCCC)OCCCCCCCC)OCCCCCCCC] | CZ-10 |
| 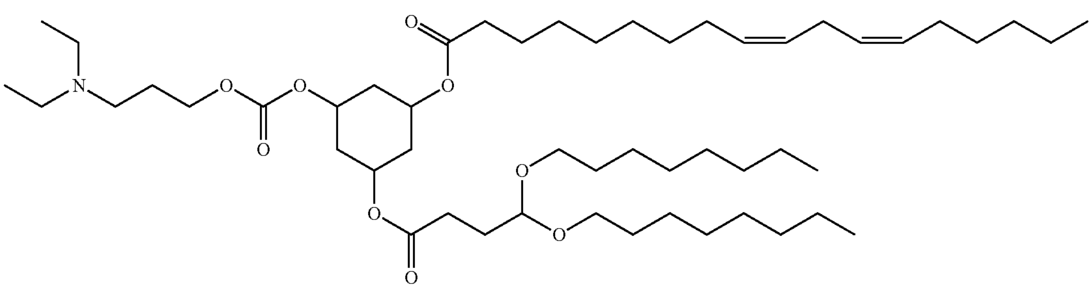 [SMILES: CCCCC/C=C\C/C=C\CCCCCCCC(=O)OC1CC(OC(=O)CCC(OCCCCCCCC)OCCCCCCCC)CC(OC(=O)OCCCN(CC)CC)C1] | CZ-11 |
| 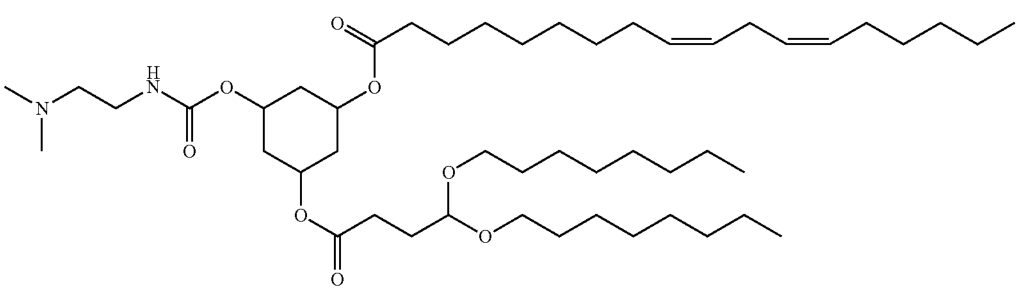 [SMILES: CCCCC/C=C\C/C=C\CCCCCCCC(=O)OC1CC(OC(=O)CCC(OCCCCCCCC)OCCCCCCCC)CC(OC(=O)NCCN(C)C)C1] | CZ-12 |
| 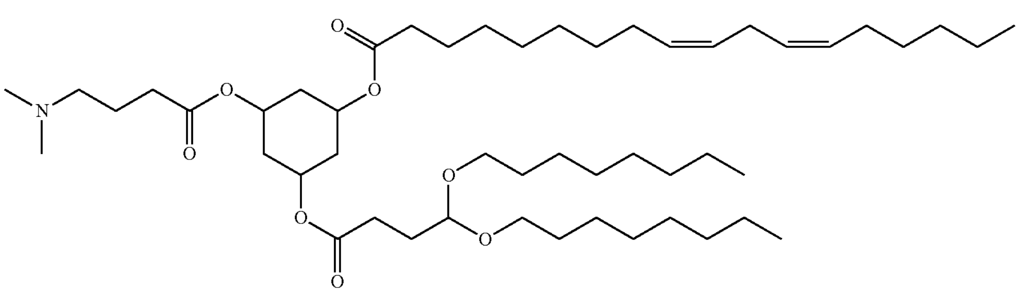 | CZ-13 |

TABLE (V)-continued

Non-Limiting Examples of Ionizable Lipids

| Structure | Compound No. |
|---|---|
| 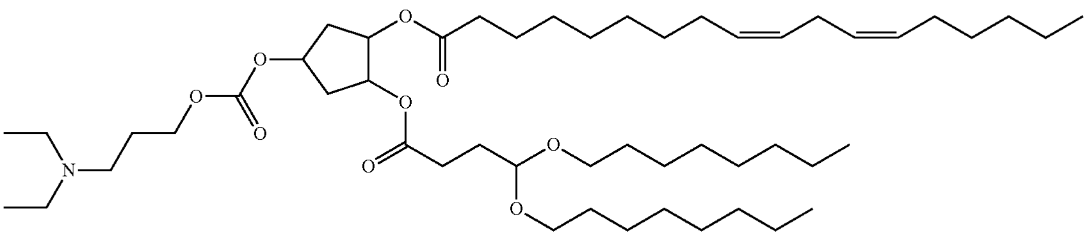 [SMILES: CCCCC/C=C\C/C=C\CCCCCCCC(=O)OC1CC(OC(=O)OCCCN(CC)CC)CC1OC(=O)CCC(OCCCCCCCC)OCCCCCCCC] | CZ-14 |
| 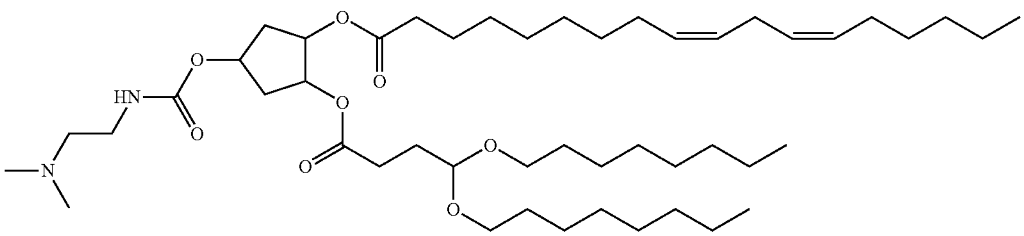 [SMILES: CCCCC/C=C\C/C=C\CCCCCCCC(=O)OC1CC(OC(=O)NCCN(C)C)CC1OC(=O)CCC(OCCCCCCCC)OCCCCCCCC] | CZ-15 |
| 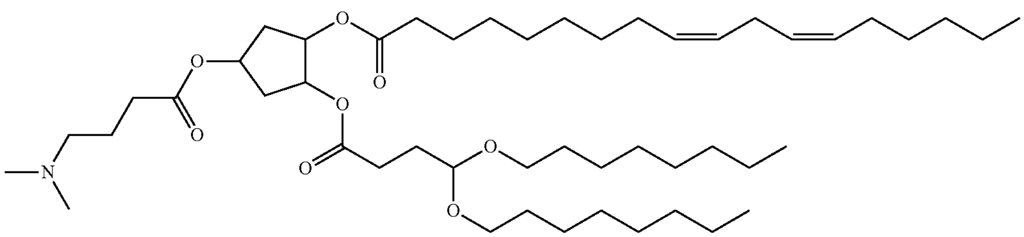 [SMILES: CCCCC/C=C\C/C=C\CCCCCCCC(=O)OC1CC(OC(=O)CCCN(C)C)CC1OC(=O)CCC(OCCCCCCCC)OCCCCCCCC] | CZ-16 |
| 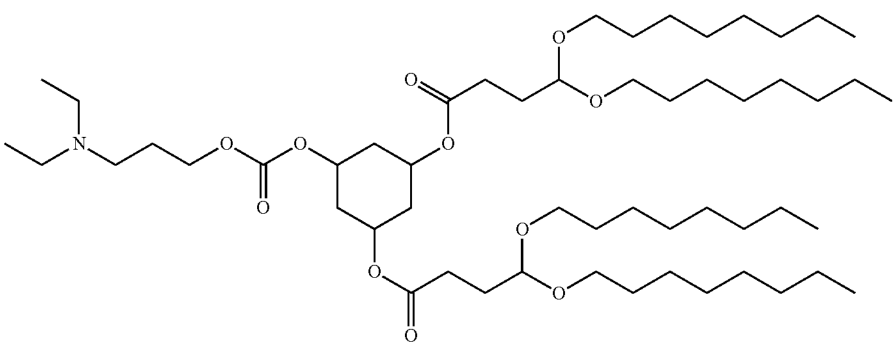 [SMILES: CCCCCCCCOC(CCC(=O)OC1CC(OC(=O)CCC(OCCCCCCCC)OCCCCCCCC)CC(OC(=O)OCCCN(CC)CC)C1)OCCCCCCCC] | CZ-17 |
| | CZ-18 | ii. Structural Lipids

In some embodiments, an LNP comprises a structural lipid. Structural lipids can be selected from the group consisting of, but are not limited to, cholesterol, fecosterol, fucosterol, beta sitosterol, sitosterol, ergosterol, campesterol, stigmasterol, brassicasterol, tomatidine, cholic acid, sitostanol, lithocholic acid, tomatine, ursolic acid, alpha-tocopherol, Vitamin D3, Vitamin D2, Calcipotriol, botulin, lupeol, oleanolic acid, beta-sitosterol-acetate and mixtures thereof. In some embodiments, the structural lipid is cholesterol. In some embodiments, the structural lipid is a cholesterol analogue disclosed by Patel, et al., Nat Commun., 11, 983 (2020), which is incorporated herein by reference in its entirety. In some embodiments, the structural lipid includes cholesterol and a corticosteroid (such as prednisolone, dexamethasone, prednisone, and hydrocortisone), or any combinations thereof. In some embodiments, a structural lipid is described in international patent application WO2019152557A1, which is incorporated herein by reference in its entirety.

In some embodiments, a structural lipid is a cholesterol analog. Using a cholesterol analog may enhance endosomal escape as described in Patel et al., Naturally-occurring cholesterol analogues in lipid nanoparticles induce polymorphic shape and enhance intracellular delivery of mRNA, Nature Communications (2020), which is incorporated herein by reference.

In some embodiments, a structural lipid is a phytosterol. Using a phytosterol may enhance endosomal escape as described in Herrera et al., Illuminating endosomal escape of polymorphic lipid nanoparticles that boost mRNA delivery, Biomaterials Science (2020), which is incorporated herein by reference.

In some embodiments, a structural lipid contains plant sterol mimetics for enhanced endosomal release.

iii. PEGylated Lipids

A PEGylated lipid is a lipid modified with polyethylene glycol.

In some embodiments, an LNP comprises one, two or more PEGylated lipid or PEG-modified lipid. A PEGylated lipid may be selected from the non-limiting group consisting of PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, a PEG lipid may be PEG-c-DOMG, PEG-DMG, PEG-DLPE, PEG-DMPE, PEG-DPPC, or a PEG-DSPE lipid.

In some embodiments, the PEGylated lipid is selected from (R)-2,3-bis(octadecyloxy)propyl-1-(methoxypoly(ethyleneglycol)2000)propylcarbamate, PEG-S-DSG, PEG-S-DMG, PEG-PE, PEG-PAA, PEG-OH DSPE C18, PEG-DSPE, PEG-DSG, PEG-DPG, PEG-DOMG, PEG-DMPE Na, PEG-DMPE, PEG-DMG2000, PEG-DMG C14, PEG-DMG 2000, PEG-DMG, PEG-DMA, PEG-Ceramide C16, PEG-C-DOMG, PEG-c-DMOG, PEG-c-DMA, PEG-cDMA, PEGA, PEG750-C-DMA, PEG400, PEG2k-DMG, PEG2k-C11, PEG2000-PE, PEG2000P, PEG2000-DSPE, PEG2000-DOMG, PEG2000-DMG, PEG2000-C-DMA, PEG2000, PEG200, PEG(2k)-DMG, PEG DSPE C18, PEG DMPE C14, PEG DLPE C12, PEG Click DMG C14, PEG Click C12, PEG Click C10, N(Carbonyl-methoxypolyethylenglycol-2000)-1,2-distearoyl-sn-glycero3-phosphoethanolamine, Myrj52, mPEG-PLA, MPEG-DSPE, mPEG3000-DMPE, MPEG-2000-DSPE, MPEG2000-DSPE, mPEG2000-DPPE, mPEG2000-DMPE, mPEG2000-DMG, mDPPE-PEG2000, 1,2-distearoyl-sn-glycero-3-phosphoethanolamine-PEG2000, HPEG-2K-LIPID, Folate PEG-DSPE, DSPE-PEGMA 500, DSPE-PEGMA, DSPE-PEG6000, DSPE-PEG5000, DSPE-PEG2K-NAG, DSPE-PEG2k, DSPE-PEG2000maleimide, DSPE-PEG2000, DSPE-PEG, DSG-PEGMA, DSG-PEG5000, DPPE-PEG-2K, DPPE-PEG, DPPE-mPEG2000, DPPE-mPEG, DPG-PEGMA, DOPE-PEG2000, DMPE-PEGMA, DMPE-PEG2000, DMPE-Peg, DMPE-mPEG2000, DMG-PEGMA, DMG-PEG2000, DMG-PEG, distearoyl-glycerol-polyethyleneglycol, C18PEG750, C18PEG5000, CI8PEG3000, CI8PEG2000, CI6PEG2000, CI4PEG2000, C18-PEG5000, C18PEG, C16PEG, C16 mPEG (polyethylene glycol) 2000 Ceramide, C14-PEG-DSPE200, C14-PEG2000, C14PEG2000, C14-PEG 2000, C14-PEG, C14PEG, 14:0-PEG2KPE, 1,2-distearoyl-sn-glycero-3-phosphoethanolamine-PEG2000, (R)-2,3-bis(octadecyloxy)propyl-1-(methoxypoly(ethyleneglycol)2000)propylcarbamate, (PEG)-C-DOMG, PEG-C-DMA, and DSPE-PEG-X.

In some embodiments, the LNP comprises a PEGylated lipid disclosed in one of US 2019/0240354; US 2010/0130588; US 2021/0087135; WO 2021/204179; US 2021/0128488; US 2020/0121809; US 2017/0119904; US 2013/0108685; US 2013/0195920; US 2015/0005363; US 2014/0308304; US 2013/0053572; WO 2019/232095A1; WO 2021/077067; WO 2019/152557; US 2015/0203446; US 2017/0210697; US 2014/0200257; or WO 2019/089828A1, each of which is incorporated by reference herein in their entirety.

In some embodiments, the LNP comprises a PEGylated lipid substitute in place of the PEGylated lipid. All embodiments disclosed herein that contemplate a PEGylated lipid should be understood to also apply to PEGylated lipid substitutes. In some embodiments, the LNP comprises a polysarcosine-lipid conjugate, such as those disclosed in US 2022/0001025 A1, which is incorporated by reference herein in its entirety.

iv. Phospholipids

In some embodiments, an LNP of the present disclosure comprises a phospholipid. Phospholipids useful in the compositions and methods may be selected from the non-limiting group consisting of 1,2-distearoyl-sn-glycero-3-phosphocholine (DSPC), 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1.2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 1-palmitoyl-2-oleoyl-sn-glycero-3-phosphocho line (POPC), 1,2-di-O-octadecenyl-sn-glycero-3-phosphocholine (18:0 Diether PC), 1-oleoyl-2-cholesterylhemisuc cinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-diphytanoylsn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), sodium (S)-2-ammonio-3-((((R)-2-(oleoyloxy)-3-(stearoyloxy)propoxy)oxidophosphoryl)oxy)propanoate (L-α-phosphatidylserine; Brain PS), dimyristoyl phosphatidylcholine (DMPC), dimyristoyl phosphoethanolamine (DMPE), dimyristoylphosphatidylglycerol (DMPG), dioleoyl-phosphatidylethanolamine4-(N-maleimidomethyl)-cyclohexane-1-carboxylate (DOPE-mal), dioleoylphosphatidylglycerol (DOPG), 1,2-dioleoyl-sn-glycero-3-(phospho-L-serine) (DOPS), acell-fusogenicphospholipid (DPhPE), dipalmitoylphosphatidylethanolamine (DPPE), 1,2-Dielaidoyl-sn-phosphatidylethanolamine (DEPE), dipalmitoylphosphatidylglycerol (DPPG), dipalmitoylphosphatidylserine (DPPS), distearoylphosphatidylcholine (DSPC), distearoyl-phosphatidyl-ethanolamine (DSPE), distearoyl phosphoethanolamineimidazole (DSPEI), 1,2-diundecanoyl-sn-glycerophosphocholine (DUPC), egg phosphatidylcholine (EPC), 1,2-dioleoyl-sn-glycero-3-phosphate (18:1 PA; DOPA), ammonium bis((S)-2-hydroxy-3-(oleoyloxy)propyl) phosphate (18:1 DMP; LBPA), 1,2-dioleoyl-sn-glycero-3-phospho-(1'-myo-inositol) (DOPI; 18:1 PI), 1,2-distearoyl-sn-glycero-3-phospho-L-serine (18:0 PS), 1,2-dilinoleoyl-sn-glycero-3-phospho-L-serine (18:2 PS), 1-palmitoyl-2-oleoyl-sn-glycero-3-phospho-L-serine (16:0-18:1 PS; POPS), 1-stearoyl-2-oleoyl-sn-glycero-3-phospho-L-serine (18:0-18:1 PS), 1-stearoyl-2-linoleoyl-sn-glycero-3-phospho-L-serine (18:0-18:2 PS), 1-oleoyl-2-hydroxy-sn-glycero-3-phospho-L-serine (18:1 Lyso PS), 1-stearoyl-2-hydroxy-sn-glycero-3-phospho-L-serine (18:0 Lyso PS), and sphingomyelin. In some embodiments, an LNP includes DSPC. In certain embodiments, an LNP includes DOPE. In some embodiments, an LNP includes both DSPC and DOPE.

In some embodiments, an LNP comprises a phospholipid selected from 1-pentadecanoyl-2-oleoyl-sn-glycero-3-phosphocholine, 1-myristoyl-2-palmitoyl-sn-glycero-3-phosphocholine, 1-myristoyl-2-stearoyl-sn-glycero-3-phosphocholine, 1-palmitoyl-2-myristoyl-sn-glycero-3-phosphocholine, 1-palmitoyl-2-stearoyl-sn-glycero-3-phosphocholine, 1-palmitoyl-2-oleoyl-glycero-3-phosphocholine, 1-palmitoyl-2-linoleoyl-sn-glycero-3-phosphocholine, 1-palmitoyl-2-arachidonoyl-sn-glycero-3-phosphocholine, 1-palmitoyl-2-docosahexaenoyl-sn-glycero-3-phosphocholine, 1-stearoyl-2-myristoyl-sn-glycero-3-phosphocholine, 1-stearoyl-2-palmitoyl-sn-glycero-3-phosphocholine, 1-stearoyl-2-oleoyl-sn-glycero-3-phosphocholine, 1-stearoyl-2-linoleoyl-sn-glycero-3-phosphocholine, 1-stearoyl-2-arachidonoyl-sn-glycero-3-phosphocholine, 1-stearoyl-2-docosahexaenoyl-sn-glycero-3-phosphocholine, 1-oleoyl-2-myristoyl-sn-glycero-3-phosphocholine, 1-oleoyl-2-palmitoyl-sn-glycero-3-phosphocholine, 1-oleoyl-2-stearoyl-sn-glycero-3-phosphocholine, 1-palmitoyl-2-acetyl-sn-glycero-3-phosphocholine, 1,2-dioleoyl-sn-glycero-3-phospho-(1'-myo-inositol-3', 4'-bisphosphate), 1,2-dioleoyl-sn-glycero-3-phospho-(1'-myo-inositol-3', 5'-bisphosphate), 1,2-dioleoyl-sn-glycero-3-phospho-(1'-myo-inositol-4', 5'-bisphosphate), 1,2-dioleoyl-sn-glycero-3-phospho-(1'-myo-inositol-3', 4', 5'-trisphosphate), 1,2-dioleoyl-sn-glycero-3-phospho-(1'-myo-inositol-3'-phosphate), 1,2-dioleoyl-sn-glycero-3-phospho-(1'-myo-inositol-4'-phosphate), 1,2-dioleoyl-sn-glycero-3-phospho-(1'-myo-inositol-5'-phosphate), 1,2-dioleoyl-sn-glycero-3-phospho-(1'-myo-inositol), 1,2-dioleoyl-sn-glycero-3-phospho-L-serine, and 1-(8Z-octadecenoyl)-2-palmitoyl-sn-glycero-3-phosphocholine.

In some embodiments, a phospholipid tail may be modified in order to promote endosomal escape as described in U.S. Application Publication 2021/0121411, which is incorporated herein by reference.

In some embodiments, the LNP comprises a phospholipid disclosed in one of US 2019/0240354; US 2010/0130588; US 2021/0087135; WO 2021/204179; US 2021/0128488; US 2020/0121809; US 2017/0119904; US 2013/0108685; US 2013/0195920; US 2015/0005363; US 2014/0308304; US 2013/0053572; WO 2019/232095A1; WO 2021/077067; WO 2019/152557; US 2017/0210697; or WO 2019/089828A1, each of which is incorporated by reference herein in their entirety.

In some embodiments, phospholipids disclosed in US 2020/0121809 have the following structure:

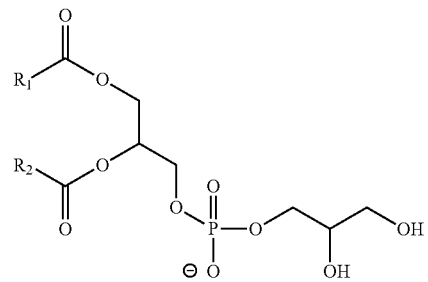

wherein R1 and R2 are each independently a branched or straight, saturated or unsaturated carbon chain (e.g., alkyl, alkenyl, alkynyl).

vi. Targeting Moieties

In some embodiments, the lipid nanoparticle further comprises a targeting moiety. The targeting moiety may be an antibody or a fragment thereof. The targeting moiety may be capable of binding to a target antigen.

In some embodiments, the pharmaceutical composition comprises a targeting moiety that is operably connected to a lipid nanoparticle. In some embodiments, the targeting moiety is capable of binding to a target antigen. In some embodiments, the target antigen is expressed in a target organ. In some embodiments, the target antigen is expressed more in the target organ than it is in the liver.

In some embodiments, the targeting moiety is an antibody as described in WO2016189532A1, which is incorporated herein by reference. For example, in some embodiments, the targeted particles are conjugated to a specific anti-CD38 monoclonal antibody (mAb), which allows specific delivery of the siRNAs encapsulated within the particles at a greater percentage to B-cell lymphocytes malignancies (such as MCL) than to other subtypes of leukocytes.

In some embodiments, the lipid nanoparticles may be targeted when conjugated/attached/associated with a targeting moiety such as an antibody.

vii. Zwitterionic Amino Lipids

In some embodiments, an LNP comprises a zwitterionic lipid. In some embodiments, an LNP comprising a zwitterionic lipid does not comprise a phospholipid.

Zwitterionic amino lipids have been shown to be able to self-assemble into LNPs without phospholipids to load, stabilize, and release mRNAs intracellularly as described in U.S. Patent Application 20210121411, which is incorporated herein by reference in its entirety. Zwitterionic, ionizable cationic and permanently cationic helper lipids enable tissue-selective mRNA delivery and CRISPR-Cas9 gene editing in spleen, liver and lungs as described in Liu et al., Membrane-destablizing ionizable phospholipids for organ-selective mRNA delivery and CRISPR-Cas gene editing, Nat Mater. (2021), which is incorporated herein by reference in its entirety.

The zwitterionic lipids may have head groups containing a cationic amine and an anionic carboxylate as described in Walsh et al., Synthesis, Characterization and Evaluation of Ionizable Lysine-Based Lipids for siRNA Delivery, Bioconjug Chem. (2013), which is incorporated herein by reference in its entirety. Ionizable lysine-based lipids containing a lysine head group linked to a long-chain dialkylamine through an amide linkage at the lysine α-amine may reduce immunogenicity as described in Walsh et al., Synthesis, Characterization and Evaluation of Ionizable Lysine-Based Lipids for siRNA Delivery, Bioconjug Chem. (2013).

viii. Additional Lipid Components

In some embodiments, the LNP compositions of the present disclosure further comprise one or more additional lipid components capable of influencing the tropism of the LNP. In some embodiments, the LNP further comprises at least one lipid selected from DDAB, EPC, 14PA, 18BMP, DODAP, DOTAP, and C12-200 (see Cheng, et al. Nat Nanotechnol. 2020 April; 15(4): 313-320.; Dillard, et al. PNAS 2021 Vol. 118 No. 52.).

In some embodiments, the LNP compositions of the present disclosure comprise, or further comprise one or more lipids selected from 1,2-di-O-octadecenyl-sn-glycero-3-phosphocholine (18:0 Diether PC), 1,2-dilinolenoyl-sn-glycero-3-phosphocholine (18:3 PC), Acylcarnosine (AC), 1-hexadecyl-sn-glycero-3-phosphocholine (C16 Lyso PC), N-oleoyl-sphingomyelin (SPM) (C18:1), N-lignoceryl SPM (C24:0), N-nervonoylshphingomyelin (C24:1), Cardiolipin (CL), 1,2-bis(tricosa-10,12-diynoyl)-sn-glycero-3-phosphocholine (DC8-9PC), dicetyl phosphate (DCP), dihexadecyl phosphate (DCP1), 1,2-Dipalmitoylglycerol-3-hemisuccinate (DGSucc), short-chain bis-n-heptadecanoyl phosphatidylcholine (DHPC), dihexadecoyl-phosphoethanolamine (DUPE), 1,2-dilinoleoyl-sn-glycero-3-phosphocholine (DLPC), 1,2-dilauroyl-sn-glycero-3-PE (DLPE), dimyristoyl glycerol hemisuccinate (DMGS), dimyristoyl phosphatidylcholine (DMPC), dimyristoyl phosphoethanolamine (DMPE), dimyristoylphosphatidylglycerol (DMPG), dioleyloxybenzylalcohol (DOBA), 1,2-dioleoylglyceryl-3-hemisuccinate (DOGHEMS), N-[2-(2-{2-[2-(2,3-Bis-octadec-9-enyloxy-propoxy)-ethoxy]-ethoxy}-ethoxy)-ethyl]-3-(3,4,5-1rihydroxy-6-hydroxymethyl-1etrahydro-pyran-2-ylsulfanyl)-propionamide (DOGP4aMan), dioleoylphosphatidylcholine (DOPC), dioleoylphosphatidylethanolamine (DOPE), dioleoyl-phosphatidylethanolamine4-(N-maleimidomethyl)-cyclohexane-1-carboxylate (DOPE-mal), dioleoylphosphatidylglycerol (DOPG), 1,2-dioleoyl-sn-glycero-3-(phospho-L-serine) (DOPS), acell-fusogenicphospholipid (DPhPE), dipalmitoylphosphatidylethanolamine (DPPE), dipalmitoylphosphatidylglycerol (DPPG), dipalmitoylphosphatidylserine (DPPS), distearoylphosphatidylcholine (DSPC), distearoylphosphatidyl-ethanolamine (DSPE), distearoyl phosphoethanolamineimidazole (DSPEI), 1,2-diundecanoyl-sn-glycero-phosphocholine (DUPC), egg phosphatidylcholine (EPC), histaminedistearoylglycerol (HDSG), 1,2-Dipalmitoylglycerol-hemisuccinate-Nα-Histidinyl-Hemisuccinate (HistSuccDG), N-(5'-hydroxy-3'-oxypentyl)-10-12-pentacosadiynamide (h-Pegi-PCDA), 2-[1-hexyloxyethyl]-2-devinylpyropheophorbide-a (HPPH), hydrogenatedsoybeanphosphatidylcholine (HSPC), 1,2-Dipalmitoylglycerol-O-α-histidinyl-Nα-hemisuccinate (IsohistsuccDG), mannosialized dipalmitoylphosphatidylethanolamine (ManDOG), 1,2-Dioleoyl-sn-Glycero-3-Phosphoethanolamine-N-[4-(p-maleimidomethyl)cyclohexane-carboxamide](MCC-PE), 1,2-diphytanoyl-sn-glycero-3-phosphoethanolamine (ME 16:0 PE), 1-myristoyl-2-hydroxy-sn-glycero-phosphocholine (MHPC), a thiol-reactive maleimide headgroup lipid e.g. 1,2-dioleoyl-sn-glycero-3-phosphoethanolamine-N-[4-(p-maleimidophenyl)but-yramid (MPB-PE), Nervonic Acid (NA), sodium cholate (NaChol), 1,2-dioleoyl-sn-glycero-3-[phosphoethanolamine-N-dodecanoyl (NC12-DOPE), 1-oleoyl-2-cholesteryl hemisuccinoyl-sn-glycero-3-phosphocholine (OChemsPC), phosphatidylethanolamine lipid (PE), PE lipid conjugated with polyethylene glycol(PEG) (e.g., polyethylene glycol-distearoylphosphatidylethanolamine lipid (PEG-PE)), phosphatidylglycerol (PG), partially hydrogenated soy phosphatidylchloline (PHSPC), phosphatidylinositol lipid (PI), phosphotidylinositol-4-phosphate (PIP), palmitoyloleoylphosphatidylcholine (POPC), phosphatidylethanolamine (POPE), palmitoyloleyolphosphatidylglycerol (POPG), phosphatidylserine (PS), lissamine rhodamine B-phosphatidylethanolamine lipid (Rh-PE), purified soy-derived mixture of phospholipids (SIOO), phosphatidylcholine (SM), 18-1-trans-PE, 1-stearoyl-2-oleoyl-phosphatidyethanolamine (SOPE), soybean phosphatidylcholine (SPC), sphingomyelins (SPM), alpha,alpha-trehalose-6,6'-dibehenate (TDB), 1,2-dielaidoyl-sn-glycero-3-phophoethanolamine (transDOPE), ((23S, 5R)-3-(bis(hexadecyloxy)methoxy)-5-(5-methyl-2,4-dioxo-3,4-dihydropyrimidin-1(2H)-yl)tetrahydrofuran-2-yl)methylmethylphosphate, 1,2-diarachidonoyl-sn-glycero-3-phosphocholine, 1,2-diarachidonoyl-sn-glycero-3-phosphoethanolamine, 1,2-didocosahexaenoyl-sn-glycero-3-phosphocholine, 1,2-didocosahexaenoyl-sn-glycero-3-phosphoethanolamine, 1,2-dilinolenoyl-sn-glycero-3-phosphocholine, 1,2-dilinolenoyl-sn-glycero-3-phosphoethanolamine, 1,2-dilinoleoyl-sn-glycero-3-phosphoethanolamine, 1,2-dioleyl-sn-glycero-3-phosphoethanolamine, 1,2-distearoyl-sn-glycero-3-phosphoethanolamine, 16-O-monomethyl PE, 16-O-dimethyl PE, and dioleylphosphatidylethanolamine.

G. LNP Payloads

The Cas12a (or Cas Type V) gene editing systems and/or components thereof may be delivered by way of LNPs as described here. In various embodiments, the Cas12a (or Cas Type V) gene editing systems may be delivered by LNPs into cells, tissues, organs, or organisms. Depending on the chosen format, the Cas12a-based gene editing systems and/or the individual or combined components thereof may be delivered as DNA molecules (e.g., encoded on one or more plasmids), RNA molecules (e.g., guide RNAs for targeting the Cas12a (or Cas Type V) protein or linear or circular mRNAs coding for the Cas12a protein or accessory protein components of the Cas12a-based gene editing systems), proteins (e.g., Cas12a (or Cas Type V) polypeptides, accessory proteins having other functions (e.g., recombinases, nucleases, polymerases, ligases, deaminases, or reverse transcriptases), or protein-nucleic acid complexes (e.g., complexes between a guide RNA and a Cas12a (or Cas Type V) protein or fusion protein comprising a Cas12a protein). These DNA, RNA, protein, or nucleoprotein corresponding to and/or encoding the Cas12a (or Cas Type V) gene editing systems or components thereof comprise the LNP cargo or payloads. In various embodiments, the LNP cargo or payloads may comprise nucleic acid payloads, including coding payloads such as linear and circular mRNA for encoding the various components of the Cas12a (or Cas Type V) editing system.

A. Nucleic Acid Payloads

In various embodiments, the LNP compositions described herein can be used to deliver a nucleic acid or polynucleotide payload, e.g., a linear or circular mRNA.

In various embodiments, the Cas12a editing compositions described herein can include a nucleic acid or polynucleotide payload, e.g., a linear or circular mRNA. For example, the Cas12a gene editing systems may comprise one or more coding mRNA (circular or linear) for encoding Cas12a and other accessory proteins and these RNA components may be delivered by LNPs.

In some embodiments, a LNP is capable of delivering a polynucleotide to a target cell, tissue, or organ. A polynucleotide, in its broadest sense of the term, includes any compound and/or substance that is or can be incorporated into an oligonucleotide chain. Exemplary polynucleotides for use in accordance with the present disclosure include, but are not limited to, one or more of deoxyribonucleic acid (DNA), ribonucleic acid (RNA) including messenger mRNA (mRNA), hybrids thereof, RNAi-inducing agents, RNAi agents, siRNAs, shRNAs, miRNAs, antisense RNAs, ribozymes, catalytic DNA, RNAs that induce triple helix formation, aptamers, vectors, etc. RNAs useful in the compositions and methods described herein can be selected from the group consisting of but are not limited to, shortimers, antagomirs, antisense, ribozymes, short interfering RNA (siRNA), asymmetrical interfering RNA (aiRNA), microRNA (miRNA), Dicer substrate RNA (dsRNA), short hairpin RNA (shRNA), transfer RNA (tRNA), messenger RNA (mRNA), and mixtures thereof. In some embodiments, a polynucleotide is mRNA. In some embodiments, a polynucleotide is circular RNA. In some embodiments, a polynucleotide encodes a protein, e.g., a nucleobase editing enzyme. A polynucleotide may encode any polypeptide of interest, including any naturally or non-naturally occurring or otherwise modified polypeptide. A polypeptide may be of any size and may have any secondary structure or activity. In some embodiments, a polypeptide encoded by an mRNA may have a therapeutic effect when expressed in a cell.

In other embodiments, a polynucleotide is an siRNA. An siRNA may be capable of selectively knocking down or down regulating expression of a gene of interest. For example, an siRNA could be selected to silence a gene associated with a particular disease, disorder, or condition upon administration to a subject in need thereof of a nanoparticle composition including the siRNA. An siRNA may comprise a sequence that is complementary to an mRNA sequence that encodes a gene or protein of interest. In some embodiments, the siRNA may be an immunomodulatory siRNA.

In some embodiments, a polynucleotide is an shRNA or a vector or plasmid encoding the same. An shRNA may be produced inside a target cell upon delivery of an appropriate construct to the nucleus. Constructs and mechanisms relating to shRNA are well known in the relevant arts.

A polynucleotide may include a first region of linked nucleosides encoding a polypeptide of interest (e.g., a coding region), a first flanking region located at the 5'-terminus of the first region (e.g., a 5'-UTR), a second flanking region located at the 3'-terminus of the first region (e.g., a 3'-UTR), at least one 5'-cap region, and a 3'-stabilizing region. In some embodiments, a polynucleotide further includes a poly-A region or a Kozak sequence (e.g., in the 5'-UTR). In some cases, polynucleotides may contain one or more intronic nucleotide sequences capable of being excised from the polynucleotide. In some embodiments, a polynucleotide (e.g., an mRNA) may include a 5'cap structure, a chain terminating nucleotide, a stem loop, a polyA sequence, and/or a polyadenylation signal. Any one of the regions of a nucleic acid may include one or more alternative components (e.g., an alternative nucleoside). For example, the 3'-stabilizing region may contain an alternative nucleoside such as an L-nucleoside, an inverted thymidine, or a 2'-O-methyl nucleoside and/or the coding region, 5'-UTR, 3'-UTR, or cap region may include an alternative nucleoside such as a 5-substituted uridine (e.g., 5-methoxyuridine), a 1-substituted pseudouridine (e.g., 1-methyl pseudouridine or 1-ethyl-pseudouridine), and/or a 5-substituted cytidine (e.g., 5-methyl-cytidine). In some embodiments, a polynucleotide contains only naturally occurring nucleosides.

In some cases, a polynucleotide is greater than 30 nucleotides in length. In another embodiment, the poly nucleotide molecule is greater than 35 nucleotides in length. In another embodiment, the length is at least 40 nucleotides. In another embodiment, the length is at least 45 nucleotides. In another embodiment, the length is at least 55 nucleotides. In another embodiment, the length is at least 50 nucleotides. In another embodiment, the length is at least 60 nucleotides. In another embodiment, the length is at least 80 nucleotides. In another embodiment, the length is at least 90 nucleotides. In another embodiment, the length is at least 100 nucleotides. In another embodiment, the length is at least 120 nucleotides. In another embodiment, the length is at least 140 nucleotides. In another embodiment, the length is at least 160 nucleotides. In another embodiment, the length is at least 180 nucleotides. In another embodiment, the length is at least 200 nucleotides. In another embodiment, the length is at least 250 nucleotides. In another embodiment, the length is at least 300 nucleotides. In another embodiment, the length is at least 350 nucleotides. In another embodiment, the length is at least 400 nucleotides. In another embodiment, the length is at least 450 nucleotides. In another embodiment, the length is at least 500 nucleotides. In another embodiment, the length is at least 600 nucleotides. In another embodiment, the length is at least 700 nucleotides. In another embodiment, the length is at least 800 nucleotides. In another embodiment, the length is at least 900 nucleotides. In another embodiment, the length is at least 1000 nucleotides. In another embodiment, the length is at least 1100 nucleotides. In another embodiment, the length is at least 1200 nucleotides. In another embodiment, the length is at least 1300 nucleotides. In another embodiment, the length is at least 1400 nucleotides. In another embodiment, the length is at least 1500 nucleotides. In another embodiment, the length is at least 1600 nucleotides. In another embodiment, the length is at least 1800 nucleotides. In another embodiment, the length is at least 2000 nucleotides. In another embodiment, the length is at least 2500 nucleotides. In another embodiment, the length is at least 3000 nucleotides. In another embodiment, the length is at least 4000 nucleotides. In another embodiment, the length is at least 5000 nucleotides, or greater than 5000 nucleotides.

In some embodiments, a polynucleotide molecule, formula, composition or method associated therewith comprises one or more polynucleotides comprising features as described in WO2002/098443, WO2003/051401, WO2008/052770, WO2009/127230, WO2006/122828, WO2008/083949, WO2010/088927, WO2010/037539, WO2004/004743, WO2005/016376, WO2006/024518, WO2007/095976, WO2008/014979, WO2008/077592, WO2009/030481, WO2009/095226, WO2011/069586, WO2011/026641, WO2011/144358, WO2012/019780, WO2012/013326, WO2012/089338, WO2012/113513, WO2012/116811, WO2012/116810, WO2013/113502, WO2013/113501, WO2013/113736, WO2013/143698, WO2013/143699, WO2013/143700, WO2013/120626, WO2013/120627, WO2013/120628, WO2013/120629, WO2013/174409, WO2014/127917, WO2015/024669, WO2015/024668, WO2015/024667, WO2015/024665, WO2015/024666, WO2015/024664, WO2015/101415, WO2015/101414, WO2015/024667, WO2015/062738, WO2015/101416, all of which are incorporated by reference herein.

In some embodiments, a polynucleotide comprises one or more microRNA binding sites. In some embodiments, a microRNA binding site is recognized by a microRNA in a non-target organ. In some embodiments, a microRNA binding site is recognized by a microRNA in the liver. In some embodiments, a microRNA binding site is recognized by a microRNA in hepatic cells.

In certain embodiments, an RNA of the present disclosure comprises one or more phosphonate modifications selected from a phosphorothioate linkage (PS), phosphorodithioate linkage (PS2), methylphosphonate linkage (MP), methoxypropylphosphonate linkage (MOP), 5'-(E)-vinylphosphonate linkage (5'-(E)-VP), 5'-Methyl Phosphonate linkage (5'-MP), (S)-5'-C-methyl with phosphate linkage, 5'-phosphorothioate linkage (5'-PS), and a peptide nucleic acid linkage (PNA). In certain embodiments, an RNA of the present disclosure comprises one or more ribose modifications selected from a 2'-O-methyl (2'-OMe), 2'-O-methoxyethyl (2'-O-MOE), 2'-deoxy-2'-fluoro (2'-F), 2'-arabino-fluoro (2'-Ara-F), 2'-O-benzyl, 2'-O-methyl-4-pyridine (2'-O—CH2Py(4)), Locked nucleic acid (LNA), (S)-cET-BNA, tricyclo-DNA (tcDNA), PMO, Unlocked Nucleic Acid (UNA) and glycol nucleic acid (GNA). In certain embodiments, the RNA comprises a Locked Nucleic Acid (LNA) comprising a methyl bridge, an ethyl bridge, a propyl bridge, a butyl bridge or an optionally substituted variant of any of the aforementioned. In certain embodiments, an RNA of the present disclosure comprises one or more modified bases selected from a pseudouridine (W), 2'thiouridine (s2U), N6'-methyladenosine ($m^6A$), 5'methylcytidine ($m^5C$), 5'fluoro2'-deoxyuridine, N-ethylpiperidine 7'-EAA triazole modified adenine, N-ethylpiperidine 6'triazole modified adenine, 6'pheynlpyrrolo-cytosine (PhpC), 2', 4'-difluorotoluyl ribonucleoside (rF), and 5'-nitroindole.

B. Single-Stranded DNA Payloads

In various embodiments, the LNPs of the present disclosure may comprise a payload having at least one single stranded DNA. In certain embodiments, the single stranded DNA is a linear single stranded DNA. In certain embodiments, the single stranded DNA is a circular single stranded DNA. In certain embodiments, the payload further comprises a nucleobase editing system, such as an enzyme or polynucleotide encoding an enzyme capable of independently or co-dependently editing, modifying, or altering a target polynucleotide sequence or a target transcript comprising a nucleic acid sequence.

In certain embodiments, the circular single stranded DNA (CiSSD) payload is one described in PCT Publication WO2020142730A1, which is incorporated by reference herein in its entirety. In certain embodiments, the CiSSD is a donor template for use as part of a nucleobase editing system for targeted genome modification. In certain embodiments, the CiSSD comprises a DNA insert, a 5' homology arm, and a 3' homology arm. In some embodiments, the DNA insert is located between the 5' homology arm and the 3' homology arm. Homology arms as used herein refer to a series of nucleotides that are complementary to a series of nucleotides in an endogenous DNA sequence in the target region. The homology arms flanking the DNA insert allow for specific insertion of the DNA insert in the target region. A target region is a nucleic acid sequence where a desired insertion or modification occurs.

In certain embodiments, the DNA insert is at least 1 nucleotide. In certain embodiments, the DNA insert is at least about 0.5 kb, 2 kb, 2.5 kb, 5 kb, 10 kb, 20 kb, 40 kb, 80 kb, 100 kb, 150 kb, or 200 kb. In certain embodiments, the length of the DNA insert is about 0.5 kb to 5 kb, about 1 kb to 5 kb, about 1 kb to 10 kb, about 1.6 kb to 5 kb, about 1.6 kb to 10 kb, about 2 kb to 5 kb, about 2 kb to 20 kb, about 2.5 kb to 5 kb, about 2.5 kb to 10 kb, about 2.5 kb to 20 kb, and about 5 kb to 100 kb. In some embodiments, the DNA insert size may range from about 1 kb to about 3 kb, about 3 kb to about 6 kb, about 6 kb to about 9 kb, about 9 kb to about 12 kb, about 12 kb to about 15 kb, about 15 kb to about 18 kb, or about 18 kb to about 21 kb.

In some embodiments, the DNA insert may comprise a nucleotide sequence that encodes a maker or a reporter, e.g., a fluorescent marker, an antibiotic marker, or any suitable marker. A "marker" or "reporter" as used herein means a feature that allows for identification and selection of a desired cell, e.g., by fluorescence or antibiotic resistance. For example, the insert may include a nucleotide sequence encoding a reporter (e.g, GFP, RFP, or any suitable reporter) or a recombinase. For example, the reporter is an N-terminal GFP fusion reporter.

In some embodiments, the DNA insert may comprise a nucleotide sequence that encodes a transcription unit, wherein each transcription unit can produce a cellular product (e.g, protein or RNA). In some embodiments, the DNA insert may comprise a nucleotide sequence that encodes a protein, e.g, an immunomodulatory protein (e.g, a cytokine), an antibody, a chimeric antigen receptor (CAR), a growth factor, a T cell receptor, or another protein.

In certain embodiments, the CiSSD comprises a DNA insert that can be inserted at a nucleotide break in a target region of genomic DNA. In some embodiments, the break is a double stranded break (DSB). In certain embodiments, the break is a single stranded DNA break or a nick. Precision gene editing techniques, e.g, CRISPR, create a break near a desired sequence change (target sequence). CRISPR can be applied to produce deletions, disruptions, insertions, replacements, and repairs. The components of template donors for these different modifications is generally the same, consisting of three basic elements: a 5' homology arm, a DNA insert, and a 3' homology arm. CRISPR-based gene editing can generate gene knockouts by disrupting the gene sequence, however, efficiency for inserting exogenous DNA (knock-in) or replacement of genomic sequences is very poor using current methods. In certain embodiments, CiSSDs may be used with CRISPR by generating a knock-in modification. Double-stranded breaks can be introduced by any suitable mechanism, including, for example, by gene-editing systems using CRISPR, zinc finger nuclease, TALEN nuclease (Transcription Activator-Like Effector Nuclease), or meganuclease as described previously. Briefly, the CRISPR genome editing system generates a targeted DSB using the CRISPR programmable DNA endonuclease that can be targeted to a specific DNA sequence (target sequence) by a small "guide" RNA (crRNA). Guide RNAs for use in CRISPR-based modification (z.e., crRNAs and tracrRNAs) may be generated by any suitable method. In certain embodiments, crRNAs and tracrRNAs may be chemically synthesized. In other embodiments, a single guide RNA (sgRNA) may be constructed and synthesized by in vitro transcription.

In certain embodiments, an LNP of the present disclosure comprises a CiSSD disclosed herein and further comprises a precision gene editing system component such as a CRISPR, zinc finger nuclease, TALEN nuclease (Transcription Activator-Like Effector Nuclease), or meganuclease, or any other nucleobase editing system known in the art.

In certain embodiments, the single stranded DNA (SSD) payload is one described in PCT Publication WO2020232286A1, which is incorporated by reference herein in its entirety.

In certain embodiments, the SSD comprises an engineered initiator sequence and an engineered terminator sequence from a filamentous bacteriophage, and a DNA sequence of interest, wherein the DNA sequence of interest is located 3' to the engineered initiator sequence and 5' to the engineered terminator sequence. In certain embodiments, the SSD comprises a selectable marker.

In certain embodiments, the single stranded DNA (SSD) payload is made by a method described in PCT Publication WO2020232286A1. In certain embodiments, the SSD is made by a method comprising: (a) culturing a host cell of claim 11 under conditions suitable for producing a ssDNA from the DNA sequence of interest in the engineered nucleic acid and the plurality of bacteriophage proteins from the nucleic acid helper plasmid; (b) allowing the ssDNA and the plurality of bacteriophage proteins to assemble into an engineered phage; and (c) collecting the engineered phage. In certain embodiments, the method further comprises extracting the SSD from the engineered phage.

In certain embodiments, at least 90% of the SSD is the same length as the DNA sequence of interest. In certain embodiments, at least 95% of the ssDNA is the same length as the DNA sequence of interest. In certain embodiments, the SSD is between 100 and 20,000 nucleotides in length. In certain embodiments, the ssDNA is circular.

In certain embodiments, the single stranded DNA (SSD) payload is one described in PCT Publication WO2022011082A1, which is incorporated by reference herein in its entirety. In certain embodiments, the SSD comprises a first sequence from a filamentous bacteriophage, the first sequence having both initiator and terminator functions; a second sequence that is identical to the first sequence; and a single-strand DNA sequence of interest that is located between the first sequence and the second sequence. In certain embodiments, the SSD further comprises a selectable marker. In certain embodiments, the SSD is circular. In certain embodiments, the SSD is linear.

In certain embodiments, the single stranded DNA (SSD) payload is made by a method described in PCT Publication WO2022011082A1. In certain embodiments, the method comprises culturing a host cell under conditions suitable for producing the single-stranded DNA from the single-strand DNA sequence of interest in the isolated nucleic acid and producing the bacteriophage proteins from the nucleic acid helper plasmid; allowing the single-stranded DNA and bacteriophage proteins to assemble into an engineered phage; and collecting the engineered phage. In certain embodiments, the host cell comprises an isolated nucleic acid that includes: a first sequence from a filamentous bacteriophage, the first sequence having both initiator and terminator functions; a second sequence that is identical to the first sequence; and a single-strand DNA sequence of interest that is located between the first sequence and the second sequence, and a nucleic acid helper plasmid for expressing bacteriophage proteins capable of assembling a single-strand DNA into a bacteriophage. In certain embodiments, the method further comprises extracting the SSD from the engineered phage.

In certain embodiments, at least 90% of the SSD is the same length as the DNA sequence of interest. In certain embodiments, at least 95% of the ssDNA is the same length as the DNA sequence of interest. In certain embodiments, the SSD is between 100 and 20,000 nucleotides in length. In certain embodiments, the SSD is circular.

In certain embodiments, the single stranded DNA (SSD) payload is one described in PCT Publication WO2021055616A1, which is incorporated by reference herein in its entirety.

C. Linear mRNA Payloads

In various embodiments, the LNP-based pharmaceutical compositions described herein, e.g., LNP-based gene editing systems, may include one or more linear mRNA molecules or linear mRNA payloads. In various embodiments, the mRNA payloads may encode one or more components of the herein described gene editing systems. For example, an mRNA payload may encode an amino acid sequence-programmable DNA binding domain (e.g., TALENS and zinc finger-binding domains) or a nucleic acid sequence-programmable DNA binding domain (e.g., CRISPR Cas9, CRISPR Cas12a, CRISPR Cas12f, CRISPR Cas13a, CRISPR Cas13b, or TnpB).

mRNA payloads may also encode, depending upon the nature of the gene editing system, one or more effector domains that provide various functionalities that facilitate changes in nucleotide sequence and/or gene expression, such as, but not limited to, single-strand DNA binding proteins, nucleases, endonucleases, exonucleases, deaminases (e.g., cytidine deaminases or adenosine deaminases), polymerases (e.g., reverse transcriptases), integrases, recombinases, etc., and fusion proteins comprising one or more functional domains linked together.

Ribonucleic acid (RNA) is a molecule that is made up of nucleotides, which are ribose sugars attached to nitrogenous bases and phosphate groups. The nitrogenous bases include adenine (A), guanine (G), uracil (U), and cytosine (C). Generally, RNA mostly exists in the single-stranded form but can also exists double-stranded in certain circumstances. The length, form and structure of RNA is diverse depending on the purpose of the RNA. For example, the length of an RNA can vary from a short sequence (e.g., siRNA) to a long sequences (e.g., lncRNA), can be linear (e.g., mRNA) or circular (e.g., oRNA), and can either be a coding (e.g., mRNA) or a non-coding (e.g., lncRNA) sequence.

In various embodiments, the LNP-based gene editing systems, RNA therapeutics and pharmaceutical compositions thereof described herein can be used to deliver a mRNA payload that is a linear mRNA molecule. In embodiments, the mRNA payload may comprise one or more nucleotide sequences that encode a product of interest, such as, but not limited to a component of a gene editing system (e.g., an endonuclease, a prime editor, etc.) and/or a therapeutic protein.

In some embodiments, the RNA payload may be a linear mRNA. As used herein, the term "messenger RNA" (mRNA) refers to any polynucleotide which encodes a protein of interest and which is capable of being translated to produce the encoded protein of interest in vitro, in vivo, in situ or ex vivo.

Generally, a mRNA molecule comprises at least a coding region, a 5' untranslated region (UTR), a 3' UTR, a 5' cap and a poly-A tail. In some aspects, one or more structural and/or chemical modifications or alterations may be included in the RNA which can reduce the innate immune response of a cell in which the mRNA is introduced. As used herein, a "structural" feature or modification is one in which two or more linked nucleotides are inserted, deleted, duplicated, inverted or randomized in a nucleic acid without significant chemical modification to the nucleotides themselves. Because chemical bonds will necessarily be broken and reformed to affect a structural modification, structural modifications are of a chemical nature and hence are chemical modifications. However, structural modifications will result in a different sequence of nucleotides. For example, the polynucleotide "ATCG" may be chemically modified to "AT-5meC-G".

Generally, a coding region of interest in an mRNA used herein may encode a dipeptide, a tripeptide, a tetrapeptide, a pentapeptide, a hexapeptide, a heptapeptide, an octapeptide, a nonapeptide, or a decapeptide. In another embodiment, the mRNA may encode a peptide of 2-30 amino acids, e.g. 5-30, 10-30, 2-25, 5-25, 10-25, or 10-20 amino acids. The mRNA may encode a peptide of at least 10, 11, 12, 13, 14, 15, 17, 20, 25, 26, 27, 28, 29, 30, 31, 32, 33, 34, 35, 36, 37, 38, 39, or 40 amino acids, or a peptide that is no longer than 10, 11, 12, 13, 14, 15, 17, 20, 25, 26, 27, 28, 29, 30, 31, 32, 33, 34, 35, 36, 37, 38, 39, or 40 amino acids.

Generally, the length of the region of the mRNA encoding a product of interest is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the mRNA has a total length that spans from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000 nucleotides).

In some embodiments, the region or regions flanking the region encoding the product of interest may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

In some embodiments, the mRNA comprises a tailing sequence which can range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides and 160 nucleotides are functional.

In some embodiments, the mRNA comprises a capping sequence which comprises a single cap or a series of nucleotides forming the cap. The capping sequence may be from 1 to 10, e.g. 2-9, 3-8, 4-7, 1-5, 5-10, or at least 2, or 10 or fewer nucleotides in length. In some embodiments, the capping sequence is absent.

In some embodiments, the mRNA comprises a region comprising a start codon. The region comprising the start codon may range from 3 to 40, e.g., 5-30, 10-20, 15, or at least 4, or 30 or fewer nucleotides in length.

In some embodiments, the mRNA comprises a region comprising a stop codon. The region comprising the stop codon may range from 3 to 40, e.g., 5-30, 10-20, 15, or at least 4, or 30 or fewer nucleotides in length.

In some embodiments, the mRNA comprises a region comprising a restriction sequence. The region comprising the restriction sequence may range from 3 to 40, e.g., 5-30, 10-20, 15, or at least 4, or 30 or fewer nucleotides in length.

Untranslated Regions (UTRs)

In various embodiments, the mRNA payloads of the LNP-based nucleobase editing systems, RNA therapeutics and pharmaceutical compositions thereof described herein, may comprise at least one untranslated region (UTR) which flanks the region encoding the product of interest and/or is incorporated within the mRNA molecule. UTRs are transcribed by not translated. The mRNA payloads can include 5' UTR sequences and 3' UTR sequences, as well as internal UTRs.

The RNA payloads of the present disclosure may comprise one or more regions or parts which act or function as an untranslated region. Where nucleic acids are designed to encode at least one polypeptide of interest, the nucleic acid may comprise one or more of these untranslated regions (UTRs). Wild-type untranslated regions of a nucleic acid are transcribed but not translated. In mRNA, the 5' UTR starts at the transcription start site and continues to the start codon but does not include the start codon; whereas, the 3' UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the RNA payload molecules (e.g., linear and circular mRNA molecules) of the present disclosure to, among other things, enhance the stability of the molecule. The specific features can also be incorporated to ensure controlled down-regulation of the transcript in case they are misdirected to undesired organs sites. A variety of 5'UTR and 3'UTR sequences are known and available in the art.

In various embodiments, the mRNA payloads of the LNP-based nucleobase editing systems, RNA therapeutics and pharmaceutical compositions thereof described herein, may comprise at least one UTR that may be selected from any UTR sequence listed in Tables 19 or 20 of U.S. Pat. No. 10,709,779, which is incorporated herein by reference.

5' UTR Regions

In various embodiments, the mRNA payloads of the LNP-based gene editing systems, RNA therapeutics and pharmaceutical compositions thereof described herein, may comprise at least one 5' UTR.

A 5' UTR is region of an mRNA that is directly upstream (5') from the start codon (the first codon of an mRNA transcript translated by a ribosome). A 5' UTR does not encode a protein (is non-coding). Natural 5'UTRs have features that play roles in translation initiation. They harbor signatures like Kozak sequences which are commonly known to be involved in the process by which the ribosome initiates translation of many genes. Kozak sequences have the consensus CCR(A/G)CCAUGG (SEQ ID NO: 1471), where R is a purine (adenine or guanine) three bases upstream of the start codon (AUG), which is followed by another 'G'. 5'UTR also have been known to form secondary structures which are involved in elongation factor binding. 5' UTR sequences are also known to be important for ribosome recruitment to the mRNA and have been reported to play a role in translation (Hinnebusch A, et al., (2016) Science, 352:6292: 1413-6). In addition, 5' UTR sequences may confer increased half-life, increased expression and/or increased activity of a polypeptide encoded by the RNA payload described herein.

In various embodiments, the RNA payload constructs contemplated herein may include 5'UTRs that are found in nature and those that are not. For example, the 5'UTRs can be synthetic and/or can be altered in sequence with respect to a naturally occurring 5'UTR. Such altered 5'UTRs can include one or more modifications relative to a naturally occurring 5'UTR, such as, for example, an insertion, deletion, or an altered sequence, or the substitution of one or more nucleotide analogs in place of a naturally occurring nucleotide.

The 5' UTR starts at the transcription start site and continues to the start codon but does not include the start codon; whereas, the 3'UTR starts immediately following the stop codon and continues until the transcriptional termination signal. While not wishing to be bound by theory, the UTRs may have a regulatory role in terms of translation and stability of the nucleic acid.

Natural 5' UTRs usually include features which have a role in translation initiation as they tend to include Kozak sequences which are commonly known to be involved in the process by which the ribosome initiates translation of many genes. Kozak sequences have the consensus CCR(A/G) CCAUGG (SEQ ID NO:1471), where R is a purine (adenine or guanine) three bases upstream of the start codon (AUG), which is followed by another 'G'. 5'UTR also have been known to form secondary structures which are involved in elongation factor binding.

In an embodiment, the 5' UTR comprises a sequence provided in Table X or a sequence having at least 80%, 85%, 90%, 95%, 96%, 97%, 98%, 99% or 100% sequence identity to a 5' UTR sequence provided in Table X (SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344, SEQ ID NO: 1345, SEQ ID NO: 1346, SEQ ID NO: 1347, SEQ ID NO: 1348, SEQ ID NO: 1349, SEQ ID NO: 1350, SEQ ID NO: 1351, SEQ ID NO: 1352, SEQ ID NO: 1353, SEQ ID NO: 1354, SEQ ID NO: 1355, SEQ ID NO: 1356, SEQ ID NO: 1357, SEQ ID NO: 1358, SEQ ID NO: 1359, SEQ ID NO: 1360, SEQ ID NO: 1361, SEQ ID NO: 1362, SEQ ID NO: 1363, SEQ ID NO: 1364, SEQ ID NO: 1365, or SEQ ID NO: 1366), or a variant or a fragment thereof (e.g., a fragment that lacks the first one, two, three, four, five, or six nucleotides of the 5' UTR sequence provided in Table X). In an embodiment, the 5' UTR comprises a sequence with at least 80%, 85%, 90%, 95%, 96%, 97%, 98%, 99% or 100% identity to SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344, SEQ ID NO: 1345, SEQ ID NO: 1346, SEQ ID NO: 1347, SEQ ID NO: 1348, SEQ ID NO: 1349, SEQ ID NO: 1350, SEQ ID NO: 1351, SEQ ID NO: 1352, SEQ ID NO: 1353, SEQ ID NO: 1354, SEQ ID NO: 1355, SEQ ID NO: 1356, SEQ ID NO: 1357, SEQ ID NO: 1358, SEQ ID NO: 1359, SEQ ID NO: 1360, SEQ ID NO: 1361, SEQ ID NO: 1362, SEQ ID NO: 1363, SEQ ID NO: 1364, SEQ ID NO: 1365, or SEQ ID NO: 1366.

TABLE X

Exemplary nucleotide sequences of 5' UTRs

| 5' UTR Nucleotide Sequence | Sequence Identifier |
|---|---|
| ggaaaucgca aaauuugcuc uucgcguuag auuucuuuua guuuucucgc aacuagcaag cuuuuuguuc ucgccgccgc c | SEQ ID NO: 1338 |
| ggaaaucgca aaauuugcuc uucgcguuag auuucuuuua guuuucucgc aacuagcaag cuuuuuguuc ucgccgccgc c | SEQ ID NO: 1339 |
| ggaaaucgca aaauuuucuu uucgcguuag auuucuuuua guuuucuuuc aacuagcaag cuuuuuguuc ucgccgccgc c | SEQ ID NO: 1340 |
| ggaaaucgca aaauuuuugc ucuuuuucgc guuagauuuc uuuuaguuuu cuykcaacua gcaagcuuuu uguucucgcc rcc | SEQ ID NO: 1341 |
| ggaaauccccc acaaccgccu cauauccagg cucaagaaua gagcucagug uuuuguuguu uaaucauucc gacguguuuu gcgauauucg cgcaaagcag ccagucgcgc gcuugcuuuu aaguagaguu guuuuuccac ccguuugcca ggcaucuuua auuuaacaua uuuuuauuuu ucaggcuaac cuacgccgcc acc | SEQ ID NO: 1342 |
| ggaaauaaga gagaaaagaa gaguaagaag aaauauaaga ucucccugag cuucagggag ccccggcgcc gccacc | SEQ ID NO: 1343 |
| ggaaaccccc caccccgua agagagaaaa gaagaguaag aagaaauaua agaucucccu gagcuucagg gagcccggc ccgccacc | SEQ ID NO: 1344 |
| ggagaacuuc cgcuuccguu ggcgcaagcg cuuucauuuu uucugcuacc gugacuaag | SEQ ID NO: 1345 |
| ggaaauaaga gagaaaagaa gaguaagaag aaauauaaga gccacc | SEQ ID NO: 1346 |
| ggaaauaaga gagaaaagaa gaguaagaag aaauauaaga ccccggcgcc gccacc | SEQ ID NO: 1347 |
| ggaaacuuua uuuaguguua cuuuauuuuc uguuuauuug uguuucuuca gugguuugu ucuaauuucc uuggccgcc | SEQ ID NO: 1348 |
| ggaaaaucug uauuagguug gcguguucuu uggucgguug uuaguauugu uguugauucg uuuguggucg guugccgcc | SEQ ID NO: 1349 |

TABLE X-continued

Exemplary nucleotide sequences of 5' UTRs

| 5' UTR Nucleotide Sequence | Sequence Identifier |
|---|---|
| ggaaaauuau uaacaucuug guauucucga uaaccauucg uuggauuuua uuguauucgu aguuuggguu ccugccgcc | SEQ ID NO: 1350 |
| ggaaauuauu auuauuucua gcuacaauuu aucauuguau uauuuuagcu auucaucauu auuuacuugg ugaucaaca | SEQ ID NO: 1351 |
| ggaaauaggu uguuaaccaa guucaagccu aauaagcuug gauucggug acuugcuuca ccguuggcgg gcaccgauc | SEQ ID NO: 1352 |
| ggaaaucgua gagagucgua cuuaguacau aucgacuauc ggggacacc aucaagauua uaaaccaggc caga | SEQ ID NO: 1353 |
| ggaaacccgc ccaagcgacc ccaacauauc agcaguugcc caaucccaac ucccaacaca auccccaagc aacgccgcc | SEQ ID NO: 1354 |
| ggaaagcgau ugaaggcguc uuuucaacua cucgauuaag guugggauc gucugggac uuggaaauuu guuguuucc | SEQ ID NO: 1355 |
| ggaaacuaau cgaaauaaaa gagccccgua cucuuuuauu ucuauuaggu uaggagccuu agcauuugua ucuuaggua | SEQ ID NO: 1356 |
| ggaaauguga uuuccagcaa cuucuuuuga auauauugaa uuccuaauuc aaagcgaaca aaucuacaag ccauauacc | SEQ ID NO: 1357 |
| ggaaaucgua gagagucgua cuuacguggu cgccauugca uagcgcgcga aagcaacagg aacaagaacg cgcc | SEQ ID NO: 1358 |
| ggaaaucgua gagagucgua cuuagaauaa acagagucgg gucgacuugu cucugauacu acgacgucac aauc | SEQ ID NO: 1359 |
| ggaaaauuug ccuucggagu ugcguauccu gaacugccca gccuccugau auacaacugu uccgcuuauu cgggccgcc | SEQ ID NO: 1360 |
| ggaaaucuga gcaggaaucc uuugugcauu gaagacuuua gauuccucuc ugcgguagac gugcacuuau aaguauuug | SEQ ID NO: 1361 |
| ggaaagcgau ugaaggcguc uuuucaacua cucgauuaag guugggauc gucgugggac uuggaaauuu guugccacc | SEQ ID NO: 1362 |
| ggaaaauuuu agccuggaac guuagauaac uguccuguug ucuuuauaua cuuggucccc aaguaguuug ucuuccaaa | SEQ ID NO: 1363 |
| ggaaauuuuu uuuugauauu auaagaguuu uuuuugaua uuaagaaaau uuuuuuuuga uauuagaaga guaagaagaa auauaagacc ccggcgccgc cacc | SEQ ID NO: 1364 |
| ggaaauaaga gagaaaagaa gaguaagaag aaauauaaga gccaaaaaaa aaaaacc | SEQ ID NO: 1365 |
| ggaaaucucc cugagcuuca gggaguaaga gagaaagaa gaguaagaag aaauauaaga ccccggcgcc gccacc | SEQ ID NO: 1366 |

In some embodiments of the disclosure, a 5' UTR is a heterologous UTR, i.e., is a UTR Found in nature associated with a different mRNA. In another embodiment, a 5' UTR is a synthetic UTR, i.e., does not occur in nature. Synthetic UTRs include UTRs that have been mutated to improve their properties, e.g., which increase gene expression as well as those which are completely synthetic. Exemplary 5' UTRs include Xenopus or human derived alpha-globin or beta-globin (e.g., U.S. Pat. Nos. 8,278,063 and 9,012,219), human cytochrome b-245 polypeptide, and hydroxysteroid (17b) dehydrogenase, and Tobacco etch virus. CMV immediate-early 1 (IE1) gene (see US20140206753 and WO2013/185069), the sequence GGGAUCCUACC (SEQ ID NO: 1384) (see WO2014144196) may also be used. In another embodiment, 5' UTR of a TOP gene is a 5' UTR of a TOP gene lacking the 5' TOP motif (the oligopyrimidine tract) (e.g., WO/2015101414, WO2015101415, WO/2015/062738, WO2015024667, WO2015024667; 5' UTR element derived from ribosomal protein Large 32 (L32) gene (WO/2015101414, WO2015101415, WO/2015/062738)), 5' UTR element derived from the 5'UTR of an hydroxysteroid (17-β) dehydrogenase 4 gene (HSD17B4) (WO2015024667), or a 5' UTR element derived from the 5' UTR of ATP5A1 (WO2015024667) can be used. In one embodiment, an internal ribosome entry site (IRES) is used as a substitute for a 5' UTR.

In some embodiments, a 5' UTR of the present disclosure comprises a sequence selected from SEQ ID NO: 1382 (GGGAAAUAAG AGAGAAAAGA AGAGUAAGAA GAAAUAUAAG AGCCACC), and SEQ ID NO: 1383 (GGGAAATAAG AGAGAAAAGA AGAGTAAGAA GAAATATAAG AGCCACC).

3' UTR Regions

In various embodiments, the mRNA payloads of the LNP-based base editing systems, RNA therapeutics and pharmaceutical compositions thereof described herein, may comprise at least one 3' UTR. 3' UTRs may be heterologous or synthetic.

A 3' UTR is region of an mRNA that is directly downstream (3') from the stop codon (the codon of an mRNA transcript that signals a termination of translation). A 3' UTR does not encode a protein (is non-coding). Natural or wild type 3' UTRs are known to have stretches of adenosines and uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA(U/A)(U/A) (SEQ ID NO:1474) nonamers. Molecules containing this type of AREs include GM-CSF and TNF-α. Class III ARES are less well defined. These U rich regions do not contain an AUUUA motif c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

3' UTRs are known to have stretches of adenosines and uridines embedded in them. These AU rich signatures are particularly prevalent in genes with high rates of turnover. Based on their sequence features and functional properties, the AU rich elements (AREs) can be separated into three classes (Chen et al., 1995): Class I AREs contain several dispersed copies of an AUUUA motif within U-rich regions. C-Myc and MyoD contain class I AREs. Class II AREs possess two or more overlapping UUAUUUA(U/A)(U/A) (SEQ ID NO:1474) nonamers. Molecules containing this type of AREs include GM-CSF and TNF-a. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of the mRNA payloads described herein. For example, one or more copies of an ARE can be introduced to make mRNA less stable and thereby curtail translation and decrease production of the resultant protein. Alternatively, AREs can be identified and removed or mutated to increase the intracellular stability and thus increase translation and production of the resultant protein.

In some embodiments, the introduction of features often expressed in genes of target organs the stability and protein production of the mRNA can be enhanced in a specific organ and/or tissue. As a non-limiting example, the feature can be a UTR. As another example, the feature can be introns or portions of introns sequences.

Those of ordinary skill in the art will understand that 5' UTRs that are heterologous or synthetic may be used with any desired 3' UTR sequence. For example, a heterologous 5' UTR may be used with a synthetic 3' UTR with a heterologous 3' UTR.

Non-UTR sequences may also be used as regions or subregions within an RNA payload construct. For example, introns or portions of introns sequences may be incorporated into regions of nucleic acid of the disclosure. Incorporation of intronic sequences may increase protein production as well as nucleic acid levels.

Combinations of features may be included in flanking regions and may be contained within other features. For example, the polypeptide coding region of interest in an mRNA payload may be flanked by a 5' UTR which may contain a strong Kozak translational initiation signal and/or a 3' UTR which may include an oligo(dT) sequence for templated addition of a poly-A tail. 5' UTR may comprise a first polynucleotide fragment and a second polynucleotide fragment from the same and/or different genes such as the 5' UTRs described in US Patent Application Publication No. 20100293625 and PCT/US2014/069155, herein incorporated by reference in its entirety It should be understood that any UTR from any gene may be incorporated into the regions of an RNA payload molecule (e.g., a linear mRNA). Furthermore, multiple wild-type UTRs of any known gene may be utilized. It is also within the scope of the present disclosure to provide artificial UTRs which are not variants of wild type regions. These UTRs or portions thereof may be placed in the same orientation as in the transcript from which they were selected or may be altered in orientation or location. Hence a 5' or 3' UTR may be inverted, shortened, lengthened, made with one or more other 5' UTRs or 3' UTRs. As used herein, the term "altered" as it relates to a UTR sequence, means that the UTR has been changed in some way in relation to a reference sequence. For example, a 3' UTR or 5' UTR may be altered relative to a wild-type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In some embodiments, a double, triple or quadruple UTR such as a 5' UTR or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present disclosure to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In some embodiments, flanking regions are selected from a family of transcripts whose proteins share a common function, structure, feature or property. For example, polypeptides of interest may belong to a family of proteins which are expressed in a particular cell, tissue or at some time during development. The UTRs from any of these genes may be swapped for any other UTR of the same or different family of proteins to create a new polynucleotide. As used herein, a "family of proteins" is used in the broadest sense to refer to a group of two or more polypeptides of interest which share at least one function, structure, feature, localization, origin, or expression pattern.

The untranslated region may also include translation enhancer elements (TEE). As a non-limiting example, the TEE may include those described in US Application No. 20090226470, herein incorporated by reference in its entirety, and those known in the art.

5' Capping

In various embodiments, the mRNA payloads of the LNP-based base editing systems, RNA therapeutics and pharmaceutical compositions thereof described herein, may comprise a 5' cap structure.

The 5' cap structure of an mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

Modifications to mRNA may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, MA) may be used with a-thio-guanosine nucleotides according to the manufacturer's instructions to create a phosphorothioate linkage in the 5'-ppp-5' cap.

Additional modified guanosine nucleotides may be used such as a-methyl-phosphonate and seleno-phosphate nucleotides.

Additional modifications include, but are not limited to, 2'-O-methylation of the ribose sugars of 5'-terminal and/or 5'-anteterminal nucleotides of the mRNA (as mentioned above) on the 2'-hydroxyl group of the sugar ring. Multiple distinct 5'-cap structures can be used to generate the 5'-cap of a nucleic acid molecule, such as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/or linked to a nucleic acid molecule.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine ($m^7$G-3'mppp-G; which may equivalently be designated 3' O-Me-m7G(5')ppp(5')G). The 3'-0 atom of the other, unmodified, guanine becomes linked to the 5'-terminal nucleotide of the capped nucleic acid molecule (e.g. an mRNA). The N7- and 3'-O-methylated guanine provides the terminal moiety of the capped nucleic acid molecule (e.g. mRNA).

Another exemplary cap is mCAP, which is similar to ARCA but has a 2'-O-methyl group on guanosine (i.e., N7,2'-O-dimethyl-guanosine-5'-triphosphate-5'-guanosine, $m^7$Gm-ppp-G).

While cap analogs allow for the concomitant capping of a nucleic acid molecule in an in vitro transcription reaction, up to 20% of transcripts can remain uncapped. This, as well as the structural differences of a cap analog from an endogenous 5'-cap structures of nucleic acids produced by the endogenous, cellular transcription machinery, may lead to reduced translational competency and reduced cellular stability.

mRNA may also be capped post-transcriptionally, using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures are those which, among other things, have enhanced binding of cap binding proteins, increased half-life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5*)ppp(5*)N,pN2p (cap 0), 7mG(5*)ppp(5*)NlmpNp (cap 1), and 7mG(5*)-ppp(5')NlmpN2mp (cap 2).

In some embodiments, the 5' terminal caps may include endogenous caps or cap analogs.

In some embodiments, a 5' terminal cap may comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

IRES Sequences

In various embodiments, the mRNA payloads of the LNP-based gene editing systems, RNA therapeutics and pharmaceutical compositions thereof described herein, may comprise one or more IRES sequences.

In some embodiments, the mRNA may contain an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. An mRNA that contains more than one functional ribosome binding site may encode several peptides or polypeptides that are translated independently by the ribosomes. Non-limiting examples of IRES sequences that can be used include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

In some embodiments, the IRES is from Taura syndrome virus, *Triatoma* virus, Theiler's encephalomyelitis virus, Simian Virus 40, *Solenopsis invicta* virus 1, *Rhopalosiphum padi* virus, Reticuloendotheliosis virus, Human poliovirus 1, *Plautia stali* intestine virus, Kashmir bee virus, Human rhinovirus 2, Homalodisca coagulata virus-1, Human Immunodeficiency Virus type 1, Homalodisca coagulata virus-1, Himetobi P virus, Hepatitis C virus, Hepatitis A virus, Hepatitis GB virus, Foot and mouth disease virus, Human enterovirus 71, Equine rhinitis virus, Ectropis obliqua picorna-like virus, Encephalomyocarditis virus, *Drosophila* C Virus, Human coxsackievirus B3, Crucifer tobamovirus, Cricket paralysis virus, Bovine viral diarrhea virus 1, Black Queen Cell Virus, Aphid lethal paralysis virus, Avian encephalomyelitis virus, Acute bee paralysis virus, Hibiscus chlorotic ringspot virus, Classical swine fever virus, Human FGF2, Human SFTPA1, Human AML1/RUNX1, *Drosophila* antennapedia, Human AQP4, Human AT1R, Human BAG-1, Human BCL2, Human BiP, Human c-IAP1, Human c-myc, Human eIF4G, Mouse NDST4L, Human LEF1, Mouse HIF1 alpha, Human n.myc, Mouse Gtx, Human p27kip1, Human PDGF2/c-sis, Human p53, Human Pim-1, Mouse Rbm3, *Drosophila* reaper, Canine Scamper, *Drosophila* Ubx, Human UNR, Mouse UtrA, Human VEGF-A, Human XIAP, *Drosophila* hairless, *S. cerevisiae* TFIID, *S. cerevisiae* YAP1, tobacco etch virus, turnip crinkle virus, EMCV-A, EMCV-B, EMCV-Bf, EMCV-Cf, EMCV pEC9, Picobirnavirus, HCV QC64, Human Cosavirus E/D, Human Cosavirus F, Human Cosavirus JMY, Rhinovirus NAT001, HRV14, HRV89, HRVC-02, HRV-A21, Salivirus A SH1, Salivirus FHB, Salivirus NG-J1, Human Parechovirus 1, Crohivirus B, Yc-3, Rosavirus M-7, Shanbavirus A, Pasivirus A, Pasivirus A 2, Echovirus E14, Human Parechovirus 5, Aichi Virus, Hepatitis A Virus HA16, Phopivirus, CVA10, Enterovirus C, Enterovirus D, Enterovirus J, Human Pegivirus 2, GBV-C GT110, GBV-C K1737, GBV-C Iowa, Pegivirus A 1220, Pasivirus A 3, Sapelovirus, Rosavirus B, Bakunsa Virus, Tremovirus A, Swine Pasivirus 1, PLV-CHN, Pasivirus A, Sicinivirus, Hepacivirus K, Hepacivirus A, BVDV1, Border Disease Virus, BVDV2, CSFV—PK15C, SF573 Dicistrovirus, Hubei Picorna-like Virus, CRPV, Salivirus A BNS, Salivirus A BN2, Salivirus A 02394, Salivirus A GUT, Salivirus A CH, Salivirus A SZ1, Salivirus FHB, CVB3, CVB1, Echovirus 7, CVBS, EVA71, CVA3, CVA12, EV24 or an aptamer to eIF4G.

Poly-A Tails and 3' Stabilizing Regions

In various embodiments, the mRNA payloads of the LNP-based gene editing systems, RNA therapeutics and pharmaceutical compositions thereof described herein, may comprise a poly-A tail.

During RNA processing, a long chain of adenine nucleotides (poly-A tail) may be added to a polynucleotide such as an mRNA molecules in order to increase stability. Immediately after transcription, the 3' end of the transcript may be cleaved to free a 3' hydroxyl. Then poly-A polymerase adds a chain of adenine nucleotides to the free 3' hydroxyl end. The process, called polyadenylation, adds a poly-A tail of a certain length.

In some embodiments, the length of a poly-A tail is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides) and no more than about 50, 100, 200, 300, 400, 500, 600, 700, 800, 900, 1000, 2000, or 3000 nucleotides in length. In some embodiments, the mRNA includes a poly-A tail from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In some embodiments, the poly-A tail is designed relative to the length of the overall mRNA. This design may be based on the length of the region coding for a target of interest, the length of a particular feature or region (such as a flanking region), or based on the length of the ultimate product expressed from the mRNA.

In this context the poly-A tail may be 10, 20, 30, 40, 50, 60, 70, 80, 90, or 100% greater in length than the mRNA or feature thereof. The poly-A tail may also be designed as a fraction of mRNA to which it belongs. In this context, the poly-A tail may be 10, 20, 30, 40, 50, 60, 70, 80, or 90% or more of the total length of the construct or the total length of the construct minus the poly-A tail. Further, engineered binding sites and conjugation of mRNA for poly-A binding protein may enhance expression.

Additionally, multiple distinct mRNA may be linked together to the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In some embodiments, the mRNA are designed to include a polyA-G Quartet. The G-quartet is a cyclic hydrogen bonded array of four guanine nucleotides that can be formed by G-rich sequences in both DNA and RNA. In this embodiment, the G-quartet is incorporated at the end of the poly-A tail.

Stop Codons

In various embodiments, the mRNA payloads of the LNP-based gene editing systems, RNA therapeutics and pharmaceutical compositions thereof described herein, may comprise one or more translation stop codons. Translational stop codons, UAA, UAG, and UGA, are an important component of the genetic code and signal the termination of translation of an mRNA. During protein synthesis, stop codons interact with protein release factors and this interaction can modulate ribosomal activity thus having an impact translation (Tate W P, et al., (2018) Biochem Soc Trans, 46(6):1615-162).

A stop element as used herein, refers to a nucleic acid sequence comprising a stop codon. The stop codon can be selected from TGA, TAA and TAG in the case of DNA, or from UGA, UAA and UAG in the case of RNA. In an embodiment, a stop element comprises two consecutive stop codons. In an embodiment, a stop element comprises three consecutive stop codons. In an embodiment, a stop element comprises four consecutive stop codons. In an embodiment, a stop element comprises five consecutive stop codons.

In some embodiments, the mRNA may include one stop codon. In some embodiments, the mRNA may include two stop codons. In some embodiments, the mRNA may include three stop codons. In some embodiments, the mRNA may include at least one stop codon. In some embodiments, the mRNA may include at least two stop codons. In some embodiments, the mRNA may include at least three stop codons. As non-limiting examples, the stop codon may be selected from TGA, TAA and TAG.

In other embodiments, the stop codon may be selected from one or more of the following stop elements of Table Y:

TABLE Y

Additional stop elements of linear mRNA

| Nucleotide sequence (5' to 3') | Sequence Identifier |
|---|---|
| UGAUAAUAG | SEQ ID NO: 1367 |
| UAAUAGUAA | SEQ ID NO: 1368 |
| UAAGUCUAA | SEQ ID NO: 1369 |
| UAAAGCUAA | SEQ ID NO: 1370 |
| UAAGUCUCC | SEQ ID NO: 1371 |
| UAAGGCUAA | SEQ ID NO: 1372 |
| UAAGCCCCUCCGGGG | SEQ ID NO: 1373 |
| UAAAGCUCCCCGGGG | SEQ ID NO: 1374 |
| UAAGCCCCU | SEQ ID NO: 1375 |
| UAAAGCUCC | SEQ ID NO: 1376 |
| UAAAGCUCC | SEQ ID NO: 1377 |
| UAGGGUUAA | SEQ ID NO: 1378 |
| UAAGCACCC | SEQ ID NO: 1379 |
| UGAUAGUAA | SEQ ID NO: 1380 |
| UAAAGCGCU | SEQ ID NO: 1381 |

In some embodiments, the mRNA includes the stop codon TGA and one additional stop codon. In a further embodiment the addition stop codon may be TAA.

MicroRNA Binding Sites and Other Regulatory Elements

In various embodiments, the mRNA payloads of the LNP-based gene editing systems, RNA therapeutics and pharmaceutical compositions thereof described herein, may comprise one or more regulatory elements, including, but not limited to microRNA (miRNA) binding sites, structured mRNA sequences and/or motifs, artificial binding sites to bind to endogenous nucleic acid binding molecules, and combinations thereof.

Chemically Unmodified Nucleotides

In some embodiments, the mRNA payloads of the LNP-based gene editing systems, RNA therapeutics and pharmaceutical compositions thereof described herein are not chemically modified and comprises the standard ribonucleotides consisting of adenosine, guanosine, cytosine and uridine. In some embodiments, nucleotides and nucleosides of the present disclosure comprise standard nucleoside residues such as those present in transcribed RNA (e.g. A, G, C, or U). In some embodiments, nucleotides and nucleosides of the present disclosure comprise standard deoxyribonucleosides such as those present in DNA (e.g. dA, dG, dC, or dT).

Chemically Modified Nucleotides

In some embodiments, the mRNA payloads of the LNP-based gene editing systems, RNA therapeutics and pharmaceutical compositions thereof described herein comprise, in some embodiments, comprises at least one chemical modification.

The terms "chemical modification" and "chemically modified" refer to modification with respect to adenosine (A), guanosine (G), uridine (U), thymidine (T) or cytidine (C) ribonucleosides or deoxyribnucleosides in at least one of their position, pattern, percent or population. Generally, these terms do not refer to the ribonucleotide modifications in naturally occurring 5'-terminal mRNA cap moieties. With respect to a polypeptide, the term "modification" refers to a modification relative to the canonical set 20 amino acids. Polypeptides, as provided herein, are also considered "modified" of they contain amino acid substitutions, insertions or a combination of substitutions and insertions.

Polynucleotides (e.g., RNA polynucleotides, such as mRNA polynucleotides), in some embodiments, comprise various (more than one) different modifications. In some embodiments, a particular region of a polynucleotide contains one, two or more (optionally different) nucleoside or nucleotide modifications. In some embodiments, a modified RNA polynucleotide (e.g., a modified mRNA polynucleotide), introduced to a cell or organism, exhibits reduced degradation in the cell or organism, respectively, relative to an unmodified polynucleotide. In some embodiments, a modified RNA polynucleotide (e.g., a modified mRNA polynucleotide), introduced into a cell or organism, may exhibit reduced immunogenicity in the cell or organism, respectively (e.g., a reduced innate response).

Modifications of polynucleotides include, without limitation, those described herein. Polynucleotides (e.g., RNA polynucleotides, such as mRNA polynucleotides) may comprise modifications that are naturally-occurring, non-naturally-occurring or the polynucleotide may comprise a combination of naturally-occurring and non-naturally-occurring modifications. Polynucleotides may include any useful modification, for example, of a sugar, a nucleobase, or an internucleoside linkage (e.g., to a linking phosphate, to a phosphodiester linkage or to the phosphodiester backbone).

Polynucleotides (e.g., RNA polynucleotides, such as mRNA polynucleotides), in some embodiments, comprise non-natural modified nucleotides that are introduced during synthesis or post-synthesis of the polynucleotides to achieve desired functions or properties. The modifications may be present on an internucleotide linkages, purine or pyrimidine bases, or sugars. The modification may be introduced with chemical synthesis or with a polymerase enzyme at the terminal of a chain or anywhere else in the chain. Any of the regions of a polynucleotide may be chemically modified.

The present disclosure provides for modified nucleosides and nucleotides of a polynucleotide (e.g., RNA polynucleotides, such as mRNA polynucleotides). A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A "nucleotide" refers to a nucleoside, including a phosphate group. Modified nucleotides may by synthesized by any useful method, such as, for example, chemically, enzymatically, or recombinantly, to include one or more modified or non-natural nucleosides. Polynucleotides may comprise a region or regions of linked nucleosides. Such regions may have variable backbone linkages. The linkages may be standard phosphodiester linkages, in which case the polynucleotides would comprise regions of nucleotides.

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker may be incorporated into polynucleotides of the present disclosure.

In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of pseudouridine (W), N1-methylpseudouridine ($m^1\psi$), N1-ethylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, polynucleotides (e.g., RNA polynucleotides, such as mRNA polynucleotides) include a combination of at least two (e.g., 2, 3, 4 or more) of the aforementioned modified nucleobases.

In some embodiments, modified nucleobases in polynucleotides (e.g., RNA polynucleotides, such as mRNA polynucleotides) are selected from the group consisting of 1-methyl-pseudouridine ($m^1\psi$), 5-methoxy-uridine ($mo^5U$), 5-methyl-cytidine ($m^5C$), pseudouridine ($\psi$), α-thio-guanosine and α-thio-adenosine. In some embodiments, polynucleotides includes a combination of at least two (e.g., 2, 3, 4 or more) of the aforementioned modified nucleobases.

In some embodiments, polynucleotides (e.g., RNA polynucleotides, such as mRNA polynucleotides) comprise pseudouridine (ψ) and 5-methyl-cytidine ($m^5C$). In some embodiments, polynucleotides (e.g., RNA polynucleotides, such as mRNA polynucleotides) comprise 1-methyl-pseudouridine ($m^1\psi$). In some embodiments, polynucleotides (e.g., RNA polynucleotides, such as mRNA polynucleotides) comprise 1-methyl-pseudouridine ($m^1\psi$) and 5-methyl-cytidine ($m^5C$). In some embodiments, polynucleotides (e.g., RNA polynucleotides, such as mRNA polynucleotides) comprise 2-thiouridine ($s^2U$). In some embodiments, polynucleotides (e.g., RNA polynucleotides, such as mRNA polynucleotides) comprise 2-thiouridine and 5-methyl-cytidine ($m^5C$). In some embodiments, polynucleotides (e.g., RNA polynucleotides, such as mRNA polynucleotides) comprise methoxy-uridine (moSU). In some embodiments, polynucleotides (e.g., RNA polynucleotides, such as mRNA polynucleotides) comprise 5-methoxy-uridine ($mo^5U$) and 5-methyl-cytidine ($m^5C$). In some embodiments, polynucleotides (e.g., RNA polynucleotides, such as mRNA polynucleotides) comprise 2'-O-methyl uridine. In some embodiments polynucleotides (e.g., RNA polynucleotides, such as mRNA polynucleotides) comprise 2'-O-methyl uridine and 5-methyl-cytidine ($m^5C$). In some embodiments, polynucleotides (e.g., RNA polynucleotides, such as mRNA polynucleotides) comprise N6-methyl-adenosine ($m^6A$). In some embodiments, polynucleotides (e.g., RNA polynucleotides, such as mRNA polynucleotides) comprise N6-methyl-adenosine ($m^6A$) and 5-methyl-cytidine (mC).

In some embodiments, polynucleotides (e.g., RNA polynucleotides, such as mRNA polynucleotides) are uniformly modified (e.g., fully modified, modified throughout the entire sequence) for a particular modification. For example, a polynucleotide can be uniformly modified with 5-methyl-cytidine ($m^5C$), meaning that all cytosine residues in the mRNA sequence are replaced with 5-methyl-cytidine ($m^5C$). Similarly, a polynucleotide can be uniformly modified for any type of nucleoside residue present in the sequence by replacement with a modified residue such as those set forth above.

Exemplary nucleobases and nucleosides having a modified cytosine include N4-acetylcytidine (ac4C), 5-methyl-cytidine (m5C), 5-halo-cytidine (e.g., 5-iodo-cytidine), 5-hydroxymethylcytidine (hm5C), 1-methyl-pseudoisocytidine, 2-thio-cytidine (s2C), and 2-thio-5-methyl-cytidine.

In some embodiments, a modified nucleobase is a modified uridine. Exemplary nucleobases and In some embodiments, a modified nucleobase is a modified cytosine. nucleosides having a modified uridine include 5-cyano uridine, and 4'-thio uridine.

The polynucleotides of the present disclosure may be partially or fully modified along the entire length of the molecule. For example, one or more or all or a given type of nucleotide (e.g., purine or pyrimidine, or any one or more or all of A, G, U, C) may be uniformly modified in a polynucleotide of the invention, or in a given predetermined sequence region thereof (e.g., in the mRNA including or excluding the polyA tail). In some embodiments, all nucleotides X in a polynucleotide of the present disclosure (or in a given sequence region thereof) are modified nucleotides, wherein X may any one of nucleotides A, G, U, C, or any one of the combinations A+G, A+U, A+C, G+U, G+C, U+C, A+G+U, A+G+C, G+U+CorA+G+C.

The polynucleotide may contain from about 1% to about 100% modified nucleotides (either in relation to overall nucleotide content, or in relation to one or more types of nucleotide, i.e., any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%). It will be understood that any remaining percentage is accounted for by the presence of unmodified A, G, U, or C.

The polynucleotides may contain at a minimum 1% and at maximum 100% modified nucleotides, or any intervening percentage, such as at least 5% modified nucleotides, at least 10% modified nucleotides, at least 25% modified nucleotides, at least 50% modified nucleotides, at least 80% modified nucleotides, or at least 90% modified nucleotides.

For example, the polynucleotides may contain a modified pyrimidine such as a modified uracil or cytosine. In some embodiments, at least 5%, at least 10%, at least 25%, at least 50%, at least 80%, at least 90% or 100% of the uracil in the polynucleotide is replaced with a modified uracil (e.g., a 5-substituted uracil). The modified uracil can be replaced by a compound having a single unique structure, or can be replaced by a plurality of compounds having different structures (e.g., 2, 3, 4 or more unique structures). In some embodiments, at least 5%, at least 10%, at least 25%, at least 50%, at least 80%, at least 90% or 100% of the cytosine in the polynucleotide is replaced with a modified cytosine (e.g., a 5-substituted cytosine). The modified cytosine can be replaced by a compound having a single unique structure, or can be replaced by a plurality of compounds having different structures (e.g., 2, 3, 4 or more unique structures).

D. Circular mRNA Payloads

In various embodiments, the LNP-based pharmaceutical compositions described herein, e.g., LNP-based gene editing systems, may include one or more circular mRNA molecules or "oRNAs." In various embodiments, the circular mRNA payloads may encode one or more components of the herein described gene editing systems or other therapeutic protein of interest. For example, a circular mRNA payload may encode an amino acid sequence-programmable DNA binding domain (e.g., TALENS and zinc finger-binding domains) or a nucleic acid sequence-programmable DNA binding domain (e.g., CRISPR Cas9, CRISPR Cas12a, CRISPR Cas12f, CRISPR Cas13a, CRISPR Cas13b, or TnpB).

The circular mRNA payloads may also encode, depending upon the nature of the gene editing system, one or more effector domains that provide various functionalities that facilitate changes in nucleotide sequence and/or gene expression, such as, but not limited to, single-strand DNA binding proteins, nucleases, endonucleases, exonucleases, deaminases (e.g., cytidine deaminases or adenosine deaminases), polymerases (e.g., reverse transcriptases), integrases, recombinases, etc., and fusion proteins comprising one or more functional domains linked together.

Circular RNA described herein are polyribonucleotides that form a continuous structure through covalent or non-covalent bonds. Due to the circular structure, oRNAs have improved stability, increased half-life, reduced immunogenicity, and/or improved functionality (e.g., of a function described herein) compared to a corresponding linear RNA.

In some embodiments, an oRNA binds a target. In some embodiments, an oRNA binds a substrate. In some embodiments, an oRNA binds a target and binds a substrate of the target. In some embodiments, an oRNA binds a target and mediates modulation of a substrate of the target. In some embodiments, an oRNA brings together a target and its substrate to mediate modification of the substrate, e.g., post-translational modification. In some embodiments, an oRNA brings together a target and its substrate to mediate a cellular process (e.g., alters protein degradation or signal transduction) involving the substrate. In some embodiments, a target is a target protein and a substrate is a substrate protein.

In some embodiments, an oRNA comprises a conjugation moiety for binding to chemical compound. The conjugation moiety can be a modified polyribonucleotide. The chemical compound can be conjugated to the oRNA by the conjugation moiety. In some embodiments, the chemical compound binds to a target and mediates modulation of a substrate of the target. In some embodiments, an oRNA binds a substrate of a target and a chemical compound conjugated to the oRNA by the conjugation moiety binds the target to bring together the target and its substrate to mediate modification of the substrate, e.g., post-translational modification. In some embodiments, an oRNA binds a substrate of a target and a chemical compound conjugated to the oRNA by the conjugation moiety binds the target to bring together the target and its substrate to mediate modification of the substrate to mediate a cellular process (e.g., alters protein degradation or signal transduction) involving the substrate. In some embodiments, a target is a target protein and a substrate is a substrate protein.

In some embodiments, the oRNA may be non-immunogenic in a mammal (e.g., a human, non-human primate, rabbit, rat, and mouse).

In some embodiments, the oRNA may be capable of replicating or replicates in a cell from an aquaculture animal (e.g., fish, crabs, shrimp, oysters etc.), a mammalian cell, a cell from a pet or zoo animal (e.g., cats, dogs, lizards, birds, lions, tigers and bears etc.), a cell from a farm or working animal (e.g., horses, cows, pigs, chickens etc.), a human cell, cultured cells, primary cells or cell lines, stem cells, progenitor cells, differentiated cells, germ cells, cancer cells (e.g., tumorigenic, metastatic), non-tumorigenic cells (e.g., normal cells), fetal cells, embryonic cells, adult cells, mitotic cells, non-mitotic cells, or any combination thereof.

In one aspect, provided herein is a pharmaceutical composition comprising: a circular RNA comprising, in the following order, a 3' group I intron fragment, an Internal Ribosome Entry Site (IRES), an expression sequence encoding a polypeptide (e.g., a nucleobase editing system or component thereof), and a 5' group I intron fragment, and a transfer vehicle comprising at least one of (i) an ionizable lipid, (ii) a structural lipid, and (iii) a PEG-modified lipid, wherein the transfer vehicle is capable of delivering the circular RNA polynucleotide to a cell (e.g., a human cell, such as an immune cell present in a human subject), such that the polypeptide is translated in the cell.

In some embodiments, the pharmaceutical composition is formulated for intravenous administration to the human subject in need thereof. In some embodiments, the 3' group I intron fragment and 5' group I intron fragment are *Anabaena* group I intron fragments.

In certain embodiments, the 3' intron fragment and 5' intron fragment are defined by the L9a-5 permutation site in the intact intron. In certain embodiments, the 3' intron fragment and 5' intron fragment are defined by the L8-2 permutation site in the intact intron.

In some embodiments, the IRES is from Taura syndrome virus, Tiiatoma virus, Theiler's encephalomyelitis virus, Simian Virus 40, *Solenopsis invicta* virus 1, *Rhopalosiphum padi* virus, Reticuloendotheliosis virus, Human poliovirus 1, *Plautia* stall intestine virus, Kashmir bee virus, Human rhinovirus 2, Homalodisca coagulata virus-1, Human Immunodeficiency Virus type 1, Homalodisca coagulata virus-1, Himetobi P virus, Hepatitis C virus, Hepatitis A virus, Hepatitis GB virus, Foot and mouth disease virus, Human enterovirus 71, Equine rhinitis virus, Ectropis obliqua picoma-like virus, Encephalomyocarditis virus, *Drosophila* C Virus, Human coxsackievirus B3, Crucifer tobamovirus, Cricket paralysis virus, Bovine viral diarrhea virus 1, Black Queen Cell Virus, Aphid lethal paralysis virus, Avian encephalomyelitis virus, Acute bee paralysis virus, Hibiscus chlorotic ringspot virus, Classical swine fever virus, Human FGF2, Human SFTPA1, Human AML1/RUNX1, *Drosophila* antennapedia, Human AQP4, Human AT1R, Human BAG-1, Human BCL2, Human BiP, Human c-IAP1, Human c-myc, Human eIF4G, Mouse NDST4L, Human LEF1, Mouse HIF1 alpha, Human n.myc, Mouse Gtx, Human p27kip1, Human PDGF2/c-sis, Human p53, Human Pim-1, Mouse Rbm3, *Drosophila* reaper, Canine Scamper, *Drosophila* Ubx, Human UNR, Mouse UtrA, Human VEGF-A, Human XIAP, *Drosophila* hairless, *S. cerevisiae* TFIID, *S. cerevisiae* YAP1, tobacco etch virus, turnip crinkle virus, EMCV-A, EMCV-B, EMCV-Bf, EMCV-Cf, EMCV pEC9, Picobirnavirus, HCV QC64, Human Cosavirus E/D, Human Cosavirus F, Human Cosavirus JMY, Rhinovirus NAT001, HRV14, HRV89, HRVC-02, HRV-A21, Salivirus A SHI, Salivirus FHB, Salivirus NG-J1, Human Parechovirus 1, Crohivirus B, Yc-3, Rosavirus M-7, Shanbavirus A, Pasivirus A, Pasivirus A 2, Echovirus E14, Human Parechovirus 5, Aichi Virus, Hepatitis A Virus HA 16, Phopivirus, CVA10, Enterovirus C, Enterovirus D, Enterovirus J, Human Pegivirus 2, GBV-C GT110, GBV-C K1737, GBV-C Iowa, Pegivirus A 1220, Pasivirus A 3, Sapelovirus, Rosavirus B, Bakunsa Virus, Tremovirus A, Swine Pasivirus 1, PLV-CHN, Pasivirus A, Sicinivirus, Hepacivirus K, Hepacivirus A, BVDV1, Border Disease Virus, BVDV2, CSFV—PK15C, SF573 Dicistravirus, Hubei Picoma-like Virus, CRPV, Salivirus A BN5, Salivirus A BN2, Salivirus A 02394, Salivirus A GUT, Salivirus A CH, Salivirus A SZ1, Salivirus FHB, CVB3, CVB1, Echovirus 7, CVB5, EVA71, CVA3, CVA12, EV24 or an aptamer to eIF4G.

In some embodiments, the IRES comprises a CVB3 IRES or a fragment or variant thereof. In some embodiments, the pharmaceutical composition comprises a first internal spacer between the 3' group I intron fragment and the IRES, and a second internal spacer between the expression sequence and the 5' group I intron fragment. In certain embodiments, the first and second internal spacers each have a length of about 10 to about 60 nucleotides.

In some embodiments, the circular mRNA comprises a nucleotide sequence encoding a polypeptide of interest, such as a nucleobase editing system or therapeutic protein (e.g., a CAR or TCR complex protein).

In some embodiments, the LNP-based nucleobase editing systems, RNA therapeutics and pharmaceutical compositions described herein further comprise a targeting moiety. In certain embodiments, the targeting moiety mediates receptor-mediated endocytosis or direct fusion of the delivery vehicle (LNPs) into selected cells of a selected cell population or tissue in the absence of cell isolation or purification. In certain embodiments, the targeting moiety is capable of binding to a protein selected from the group CD3, CD4, CD8, CDS, CD7, PD-1, 4-1BB, CD28, C1q, and CD2. In certain embodiments, the targeting moiety comprises an antibody specific for a macrophage, dendritic cell, NK cell, NKT, or T cell antigen. In certain embodiments, the targeting moiety comprises a scFv, nanobody, peptide, minibody, polynucleotide aptamer, heavy chain variable region, light chain variable region or fragment thereof.

In some embodiments, the LNP-based nucleobase editing systems, RNA therapeutics and pharmaceutical compositions described herein are administered in an amount effective to treat a disease in the human subject (e.g., wherein the disease can be cancer, muscle disorder, or CNS disorder, etc.). In some embodiments, the LNP-based nucleobase editing systems, RNA therapeutics and pharmaceutical compositions have an enhanced safety profile when compared to a pharmaceutical composition comprising T cells or vectors comprising exogenous DNA encoding the same polypeptide.

In some embodiments, the LNP-based nucleobase editing systems and pharmaceutical compositions thereof are administered in an amount effective to induce a desire precise edit in a genome. In some embodiments, the LNP-based nucleobase editing systems and pharmaceutical compositions have an enhanced safety profile when compared to state of the art gene editing delivery compositions.

In another aspect, the present disclosure provides a circular RNA comprising, in the following order, a 3' group I intron fragment, an Internal Ribosome Entry Site (IRES), an expression sequence encoding a polypeptide (e.g., a nucleobase editing system or component thereof), and a 5' group I intron fragment.

In some embodiments, the 3' group I intron fragment and 5' group I intron fragment are *Anabaena* group I intron fragments. In certain embodiments, the 3' intron fragment and 5' intron fragment are defined by the L9a-5 permutation site in the intact intron. In certain embodiments, the 3' intron fragment and 5' intron fragment are defined by the L8-2 permutation site in the intact intron. In certain embodiments, the IRES comprises a CVB3 IRES or a fragment or variant thereof.

In some embodiments, the circular RNA comprises a first internal spacer between the 3' group I intron fragment and the IRES, and a second internal spacer between the expression sequence and the 5' group I intron fragment. In certain embodiments, the first and second internal spacers each have a length of about 10 to about 60 nucleotides.

In some embodiments, the circular RNA payload of the LNP-based nucleobase editing systems, RNA therapeutics and pharmaceutical compositions described herein consists of natural nucleotides. In some embodiments, the circular RNA further comprises a second expression sequence encoding a therapeutic protein. In some embodiments, the therapeutic protein comprises a checkpoint inhibitor. In certain embodiments, the therapeutic protein comprises a cytokine.

In some embodiments, the circular RNA payload of the LNP-based nucleobase editing systems, RNA therapeutics and pharmaceutical compositions described herein consists of natural nucleotides.

In some embodiments, the circular RNA payload LNP-based nucleobase editing systems, RNA therapeutics and pharmaceutical compositions described herein comprises a nucleotide sequence that is codon optimized, either partially or fully. In some embodiments, the circular RNA is optimized to lack at least one microRNA binding site present in an equivalent pre-optimized polynucleotide. In some embodiments, the circular RNA is optimized to lack at least one endonuclease susceptible site present in an equivalent pre-optimized polynucleotide. In some embodiments, the circular RNA is optimized to lack at least one RNA-editing susceptible site present in an equivalent pre-optimized polynucleotide.

In some embodiments, the circular RNA payload of the LNP-based nucleobase editing systems, RNA therapeutics and pharmaceutical compositions described herein has an in vivo functional half-life in humans greater than that of an equivalent linear RNA having the same expression sequence. In some embodiments, the circular RNA has a length of about 100 nucleotides to about 10 kilobases. In some embodiments, the circular RNA has a functional half-life of at least about 20 hours. In some embodiments, the circular RNA has a duration of therapeutic effect in a human cell of at least about 20 hours. In some embodiments, the circular RNA has a duration of therapeutic effect in a human cell greater than or equal to that of an equivalent linear RNA comprising the same expression sequence. In some embodiments, the circular RNA has a functional half-life in a human cell greater than or equal to that of an equivalent linear RNA comprising the same expression sequence.

In some embodiments, the circular RNA payload of the LNP-based nucleobase editing systems, RNA therapeutics and pharmaceutical compositions described herein has a half-life of at least that of a linear counterpart. In some embodiments, the oRNA has a half-life that is increased over that of a linear counterpart. In some embodiments, the half-life is increased by about 5%, 10%, 15%, 20%, 25%, 30%, 35%, 40%, 45%, 50%, or greater. In some embodiments, the oRNA has a half-life or persistence in a cell for at least about 1 hour to about 30 days, or at least about 2 hours, 6 hours, 12 hours, 18 hours, 24 hours (1 day), 2 days, 3, days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 60 days, or longer or any time therebetween. In some embodiments, the oRNA has a half-life or persistence in a cell for no more than about 10 mins to about 7 days, or no more than about 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 24 hours (1 day), 36 hours (1.5 days), 48 hours (2 days), 60 hours (2.5 days), 72 hours (3 days), 4 days, 5 days, 6 days, or 7 days.

In some embodiments, the circular RNA payload of the LNP-based nucleobase editing systems, RNA therapeutics and pharmaceutical compositions described herein has a half-life or persistence in a cell while the cell is dividing. In some embodiments, the oRNA has a half-life or persistence in a cell post division.

In certain embodiments, the circular RNA payload of the LNP-based nucleobase editing systems, RNA therapeutics and pharmaceutical compositions described herein has a half-life or persistence in a dividing cell for greater than about 10 minutes to about 30 days, or at least about 10 minutes, 15 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 24 hours (1 day), 2 days, 3, days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 60 days, or longer or any time therebetween.

In some embodiments, the circular RNA payload of the LNP-based nucleobase editing systems, RNA therapeutics and pharmaceutical compositions described herein modulates a cellular function, e.g., transiently or long term. In certain embodiments, the cellular function is stably altered, such as a modulation that persists for at least about 1 hour to about 30 days, or at least about 2 hours, 6 hours, 12 hours, 18 hours, 24 hours (1 day), 2 days, 3, days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 60 days, or longer. In certain embodiments, the cellular function is transiently altered, e.g., such as a modulation that persists for no more than about 30 mins to about 7 days, or no more than about 30 minutes, 45 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 24 hours (1 day), 36 hours (1.5 days), 48 hours (2 days), 60 hours (2.5 days), 72 hours (3 days), 4 days, 5 days, 6 days, or 7 days.

In some embodiments, the circular RNA payload of the LNP-based nucleobase editing systems, RNA therapeutics and pharmaceutical compositions described herein is at least about 20 nucleotides, at least about 30 nucleotides, at least about 40 nucleotides, at least about 50 nucleotides, at least about 75 nucleotides, at least about 100 nucleotides, at least about 200 nucleotides, at least about 300 nucleotides, at least about 400 nucleotides, at least about 500 nucleotides, at least about 1,000 nucleotides, at least about 2,000 nucleotides, at least about 5,000 nucleotides, at least about 6,000 nucleotides, at least about 7,000 nucleotides, at least about 8,000 nucleotides, at least about 9,000 nucleotides, at least about 10,000 nucleotides, at least about 12,000 nucleotides, at least about 14,000 nucleotides, at least about 15,000 nucleotides, at least about 16,000 nucleotides, at least about 17,000 nucleotides, at least about 18,000 nucleotides, at least about 19,000 nucleotides, or at least about 20,000 nucleotides. In some embodiments, the oRNA may be of a sufficient size to accommodate a binding site for a ribosome.

In some embodiments, the maximum size of the circular RNA payload of the LNP-based nucleobase editing systems, RNA therapeutics and pharmaceutical compositions described herein may be limited by the ability of packaging and delivering the RNA to a target. In some embodiments, the size of the oRNA is a length sufficient to encode polypeptides, and thus, lengths of at least 20,000 nucleotides, at least 15,000 nucleotides, at least 10,000 nucleotides, at least 7,500 nucleotides, or at least 5,000 nucleotides, at least 4,000 nucleotides, at least 3,000 nucleotides, at least 2,000 nucleotides, at least 1,000 nucleotides, at least 500 nucleotides, at least 400 nucleotides, at least 300 nucleotides, at least 200 nucleotides, at least 100 nucleotides may be useful.

In some embodiments, the circular RNA payload of the LNP-based nucleobase editing systems, RNA therapeutics and pharmaceutical compositions described herein comprises one or more elements described elsewhere herein. In some embodiments, the elements may be separated from one another by a spacer sequence or linker. In some embodiments, the elements may be separated from one another by 1 nucleotide, 2 nucleotides, about 5 nucleotides, about 10 nucleotides, about 15 nucleotides, about 20 nucleotides, about 30 nucleotides, about 40 nucleotides, about 50 nucleotides, about 60 nucleotides, about 80 nucleotides, about 100 nucleotides, about 150 nucleotides, about 200 nucleotides, about 250 nucleotides, about 300 nucleotides, about 400 nucleotides, about 500 nucleotides, about 600 nucleotides, about 700 nucleotides, about 800 nucleotides, about 900 nucleotides, about 1000 nucleotides, up to about 1 kb, at least about 1000 nucleotides.

In some embodiments, one or more elements are contiguous with one another, e.g., lacking a spacer element.

In some embodiments, one or more elements is conformationally flexible. In some embodiments, the conformational flexibility is due to the sequence being substantially free of a secondary structure.

In some embodiments, the circular RNA payload of the LNP-based nucleobase editing systems, RNA therapeutics and pharmaceutical compositions described herein comprises a secondary or tertiary structure that accommodates a binding site for a ribosome, translation, or rolling circle translation.

In some embodiments, the circular RNA payload of the LNP-based nucleobase editing systems, RNA therapeutics and pharmaceutical compositions described herein comprises particular sequence characteristics. For example, the oRNA may comprise a particular nucleotide composition. In some such embodiments, the oRNA may include one or more purine rich regions (adenine or guanosine). In some such embodiments, the oRNA may include one or more purine rich regions (adenine or guanosine). In some embodiments, the oRNA may include one or more AU rich regions or elements (AREs). In some embodiments, the oRNA may include one or more adenine rich regions.

In some embodiments, the circular RNA payload of the LNP-based nucleobase editing systems, RNA therapeutics and pharmaceutical compositions described herein comprises one or more modifications described elsewhere herein.

In some embodiments, the circular RNA payload of the LNP-based nucleobase editing systems, RNA therapeutics and pharmaceutical compositions described herein comprises one or more expression sequences and is configured for persistent expression in a cell of a subject in vivo. In some embodiments, the oRNA is configured such that expression of the one or more expression sequences in the cell at a later time point is equal to or higher than an earlier time point. In such embodiments, the expression of the one or more expression sequences can be either maintained at a relatively stable level or can increase over time. The expression of the expression sequences can be relatively stable for an extended period of time. For instance, in some cases, the expression of the one or more expression sequences in the cell over a time period of at least 7, 8, 9, 10, 12, 14, 16, 18, 20, 22, 23 or more days does not decrease by 50%, 45%, 40%, 35%, 30%, 25%, 20%, 15%, 10%, or 5%. In some cases, in some cases, the expression of the one or more expression sequences in the cell is maintained at a level that does not vary by more than 50%, 45%, 40%, 35%, 30%, 25%, 20%, 15%, 10%, or 5% for at least 7, 8, 9, 10, 12, 14, 16, 18, 20, 22, 23 or more days.

Regulatory Elements

In some embodiments, the circular RNA payload of the LNP-based nucleobase editing systems, RNA therapeutics and pharmaceutical compositions described herein comprises one or more regulatory elements. As used herein, a "regulatory element" is a sequence that modifies expression of an expression sequence, e.g., a nucleotide sequence encoding a nucleobase editing system or a therapeutic protein, i.e., a coding region of interest (CROI). The regulatory element may include a sequence that is located adjacent to a coding region of interest encoded on the circular RNA payload. The regulatory element may be operatively linked to a nucleotide sequence of the circular RNA that encodes a coding region of interest (e.g., a nucleobase editing system or therapeutic polypeptide).

In some embodiments, a regulatory element may increase an amount of expression of a coding region of interest encoded on the circular RNA payload as compared to an amount expressed when no regulatory element exists.

In some embodiments, a regulatory element may comprise a sequence to selectively initiates or activates translation of a coding sequence of interest encoded on the circular RNA payload.

In some embodiments, a regulatory element may comprise a sequence to initiate degradation of the oRNA or the payload or cargo. Non-limiting examples of the sequence to initiate degradation includes, but is not limited to, riboswitch aptazyme and miRNA binding sites.

In some embodiments, a regulatory element can modulate translation of a coding region of interest encoded on the oRNA. The modulation can create an increase (enhancer) or decrease (suppressor) in the expression of the coding region of interest. The regulatory element may be located adjacent to the CROI (e.g., on one side or both sides of the CROI).

Translation Initiation Sequence

In some embodiments, a translation initiation sequence functions as a regulatory element. In some embodiments, the translation initiation sequence comprises an AUG/ATG codon. In some embodiments, a translation initiation sequence comprises any eukaryotic start codon such as, but not limited to, AUG/ATG, CUG/CTG, GUG/GTG, UUG/TTG, ACG, AUC/ATC, AUU, AAG, AUA/ATA, or AGG. In some embodiments, a translation initiation sequence comprises a Kozak sequence. In some embodiments, translation begins at an alternative translation initiation sequence, e.g., translation initiation sequence other than AUG/ATG codon, under selective conditions, e.g., stress induced conditions. As a non-limiting example, the translation of the circular polyribonucleotide may begin at alternative translation initiation sequence, such as ACG. As another non-limiting example, the circular polyribonucleotide translation may begin at alternative translation initiation sequence, CUG/CTG. As another non-limiting example, the translation may begin at alternative translation initiation sequence, GUG/GTG. As yet another non-limiting example, the translation may begin at a repeat-associated non-AUG (RAN) sequence such as an alternative translation initiation sequence that includes short stretches of repetitive RNA e.g. CGG, GGGGCC, CAG, or CTG.

In some embodiments, the oRNA encodes a polypeptide or peptide and may comprise a translation initiation sequence. The translation initiation sequence may comprise, but is not limited to a start codon, a non-coding start codon, a Kozak sequence or a Shine-Dalgarno sequence. The translation initiation sequence may be located adjacent to the payload or cargo (e.g., on one side or both sides of the coding region of interest).

In some embodiments, the translation initiation sequence provides conformational flexibility to the oRNA. In some embodiments, the translation initiation sequence is within a substantially single stranded region of the oRNA.

The oRNA may include more than 1 start codon such as, but not limited to, at least 2, at least 3, at least 4, at least 5, at least 6, at least 7, at least 8, at least 9, at least 10, at least 11, at least 12, at least 13, at least 14, at least 15 or more than 15 start codons. Translation may initiate on the first start codon or may initiate downstream of the first start codon.

In some embodiments, the oRNA may initiate at a codon which is not the first start codon, e.g., AUG. Translation of the circular polyribonucleotide may initiate at an alternative translation initiation sequence, such as, but not limited to, ACG, AGG, AAG, CUG/CTG, GUG/GTG, AUA/ATA, AUU/ATT, UUG/TTG. In some embodiments, translation begins at an alternative translation initiation sequence under selective conditions, e.g., stress induced conditions. As a non-limiting example, the translation of the oRNA may begin at alternative translation initiation sequence, such as ACG. As another non-limiting example, the oRNA translation may begin at alternative translation initiation sequence, CUG/CTG. As yet another non-limiting example, the oRNA translation may begin at alternative translation initiation sequence, GTG/GUG. As yet another non-limiting example, the oRNA may begin translation at a repeat-associated non-AUG (RAN) sequence, such as an alternative translation initiation sequence that includes short stretches of repetitive RNA e.g. CGG, GGGGCC, CAG, CTG.

IRES Sequences

In some embodiments, the oRNA described herein comprises an internal ribosome entry site (TRES) element capable of engaging an eukaryotic ribosome. In some embodiments, the IRES element is at least about 5 nucleotides, at least about 8 nucleotides, at least about 9 nucleotides, at least about 10 nucleotides, at least about 15 nucleotides, at least about 20 nucleotides, at least about 25 nucleotides, at least about 30 nucleotides, at least about 40 nucleotides, at least about 50 nucleotides, at least about 100 nucleotides, at least about 200 nucleotides, at least about 250 nucleotides, at least about 350 nucleotides, or at least about 500 nucleotides. In one embodiment, the IRES element is derived from the DNA of an organism including, but not limited to, a virus, a mammal, and a *Drosophila*. Such viral DNA may be derived from, but is not limited to, picornavirus complementary DNA (cDNA), with encephalomyocarditis virus (EMCV) cDNA and poliovirus cDNA. In one embodiment, *Drosophila* DNA from which an IRES element is derived includes, but is not limited to, an Antennapedia gene from *Drosophila melanogaster*.

In some embodiments, the IRES element is at least partially derived from a virus, for instance, it can be derived from a viral IRES element, such as ABPV_IGRpred, AEV, ALPV_IGRpred, BQCV_IGRpred, BVDV1_1-385, BVDV1_29-391, CrPV_5NCR, CrPV_IGR, crTMV_I-REScp, crTMV_IRESmp75, crTMV_IRESmp228, crTMV_IREScp, crTMV_IREScp, CSFV, CVB3, DCV_IGR, EMCV-R, EoPV_5NTR, ERAV 245-961, ERBV 162-920, EV71_1-748, FeLV-Notch2, FMDV_type_C, GBV-A, GBV-B, GBV-C, gypsy_env, gypsyD5, gypsyD2, HAV_HM175, HCV type_1a, HiPV_IGRpred, HIV-1, HoCV1_IGRpred, HRV-2, IAPV_IGRpred, idefix, KBV_IGRpred, LINE-1_ORF1_-101_to_-1, LINE-1_ORF1-302_to_-202, LINE-1_ORF2-138_to_-86, LINE-1_ORF1_-44 to_-1, PSIV_IGR, PV_type1_Mahoney, PV_type3_Leon, REV-A, RhPV_5NCR, RhPV_IGR, SINV1_IGRpred, SV40_661-830, TMEV, TMV_UI_IRESmp228, TRV_5NTR, TrV_IGR, or TSV_IGR. In some embodiments, the TRES element is at least partially derived from a cellular TRES, such as AML1/RUNX1, Antp-D, Antp-DE, Antp-CDE, Apaf-1, Apaf-1, AQP4, AT1R_var1, AT1R_var2, AT1R_var3, ATIR_var4, BAG1_p36delta236 nt, BAG1_p36, BCL2, BiP_-222_-3, c-IAP1_285-1399, c-IAP1_1313-1462, c-jun, c-myc, Cat-1224, CCND1, DAPS, eIF4G, eIF4GI-ext, eIF4GII, eIF4GII-long, ELG1, ELH, FGF1A, FMR1, Gtx-133-141, Gtx-1-166, Gtx-1-120, Gtx-1-196, hairless, HAP4, HIF1a, hSNM1, Hsp101, hsp70, hsp70, Hsp90, IGF2_leader2, Kv1.4_1.2, L-myc, LamB1_-335_-1, LEF1, MNT_75-267, MNT_36-160, MTG8a, MYB, MYT2_997-1152, n-MYC, NDST1, NDST2, NDST3, NDST4L, NDST4S, NRF_-653_-17, NtHSF1, ODC1, p27kip1, 03_128-269, PDGF2/c-sis, Pim-1, PITSLRE_p58, Rbm3, reaper, Scamper, TFIID, TIF4631, Ubx_1-966, Ubx_373-961, UNR, Ure2, UtrA, VEGF-A-133-1, XIAP 5-464, XIAP_305-466, or YAP1.

In another embodiment, the TRES is an TRES sequence from Coxsackievirus B3 (CVB3), the protein coding region encodes Guassia luciferase (Gluc) and the spacer sequences are polyA-C.

In some embodiments, the TRES, if present, is at least about 50 nucleotides in length. In one embodiment, the vector comprises an IRES that comprises a natural sequence. In one embodiment, the vector comprises an TRES that comprises a synthetic sequence.

An IRES may act as the sole ribosome binding site, or may serve as one of multiple ribosome binding sites of an mRNA. A polynucleotide containing more than one functional ribosome binding site may encode several peptides or polypeptides that are translated independently by the ribosomes (e.g., multicistronic mRNA). When polynucleotides are provided with an IRES, further optionally provided is a second translatable region. Examples of IRES sequences that can be used according to the present disclosure include without limitation, those from picornaviruses (e.g., FMDV), pest viruses (CFFV), polio viruses (PV), encephalomyocarditis viruses (ECMV), foot- and mouth disease viruses (FMDV), hepatitis C viruses (HCV), classical Swine fever viruses (CSFV), murine leukemia virus (MLV), simian immune deficiency viruses (SIV) or cricket paralysis viruses (CrPV).

Termination Element

In some embodiments, the oRNA includes one or more coding regions of interest (i.e., also referred to as product expression sequences) which encode polypeptides of interest, including but not limited to nucleobase editing system and therapeutic proteins. In various embodiments, the product expression sequences may or may not have a termination element.

In some embodiments, the oRNA includes one or more product expression sequences that lack a termination element, such that the oRNA is continuously translated.

Exclusion of a termination element may result in rolling circle translation or continuous expression of the encoded peptides or polypeptides as the ribosome will not stall or fall-off. In such an embodiment, rolling circle translation expresses continuously through the product expression sequence.

In some embodiments, one or more product expression sequences in the oRNA comprise a termination element.

In some embodiments, not all of the product expression sequences in the oRNA comprise a termination element. In such instances, the product expression sequence may fall off the ribosome when the ribosome encounters the termination element and terminates translation.

Rolling Circle Translation

In some embodiments, once translation of the oRNA is initiated, the ribosome bound to the oRNA does not disengage from the oRNA before finishing at least one round of translation of the oRNA. In some embodiments, the oRNA as described herein is competent for rolling circle translation. In some embodiments, during rolling circle translation, once translation of the oRNA is initiated, the ribosome bound to the oRNA does not disengage from the oRNA before finishing at least 2 rounds, at least 3 rounds, at least 4 rounds, at least 5 rounds, at least 6 rounds, at least 7 rounds, at least 8 rounds, at least 9 rounds, at least 10 rounds, at least 11 rounds, at least 12 rounds, at least 13 rounds, at least 14 rounds, at least 15 rounds, at least 20 rounds, at least 30 rounds, at least 40 rounds, at least 50 rounds, at least 60 rounds, at least 70 rounds, at least 80 rounds, at least 90 rounds, at least 100 rounds, at least 150 rounds, at least 200 rounds, at least 250 rounds, at least 500 rounds, at least 1000 rounds, at least 1500 rounds, at least 2000 rounds, at least 5000 rounds, at least 10000 rounds, at least $10^5$ rounds, or at least $10^6$ rounds of translation of the oRNA.

In some embodiments, the rolling circle translation of the oRNA leads to generation of polypeptide that is translated from more than one round of translation of the oRNA. In some embodiments, the oRNA comprises a stagger element, and rolling circle translation of the oRNA leads to generation of polypeptide product that is generated from a single round of translation or less than a single round of translation of the oRNA.

Circularization

In one embodiment, a linear RNA may be cyclized, or concatemerized. In some embodiments, the linear RNA may be cyclized in vitro prior to formulation and/or delivery. In some embodiments, the linear RNA may be cyclized within a cell.

In some embodiments, the mechanism of cyclization or concatemerization may occur through at least 3 different routes: 1) chemical, 2) enzymatic, and 3) ribozyme catalyzed. The newly formed 5'-/3'-linkage may be intramolecular or intermolecular.

In the first route, the 5'-end and the 3'-end of the nucleic acid contain chemically reactive groups that, when close together, form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphorodiester linkage. In an example reaction, ^g of a nucleic acid molecule is incubated at 37° C. for 1 hour with 1-10 units of T4 RNA ligase (New England Biolabs, Ipswich, MA) according to the manufacturer's protocol. The ligation reaction may occur in the presence of a split oligonucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

In some embodiments, the oRNA is made via circularization of a linear RNA.

In some embodiments, the following elements are operably connected to each other and, in some embodiments, arranged in the following sequence: a.) a 5' homology arm, b.) a 3' group I intron fragment containing a 3' splice site dinucleotide, c.) a protein coding or noncoding region, d.) a 5' group I intron fragment containing a 5' splice site dinucleotide, and e.) a 3' homology arm. In certain embodiments said vector allows production of a circular RNA that is translatable and/or biologically active inside eukaryotic cells. In some embodiments, the biologically active RNA is, for example, an miRNA sponge, or long noncoding RNA.

In some embodiments, the following elements are operably connected to each other and arranged in the following sequence: a.) a 5' homology arm, b.) a 3' group I intron fragment containing a 3' splice site dinucleotide, c.) optionally, a 5' spacer sequence, d.) optionally, an internal ribosome entry site (IRES), e.) a protein coding or noncoding region, f.) optionally, a 3' spacer sequence, g.) a 5' group I intron fragment containing a 5' splice site dinucleotide, and h.) a 3' homology arm. In certain embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) a 5' spacer sequence, d.) an internal ribosome entry site (IRES), e.) a protein coding or noncoding region, f.) a 5' group I intron fragment containing a 5' splice site dinucleotide, and g.) a 3' homology arm. In some embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) a 5' spacer sequence, d.) a protein coding or noncoding region, e.) a 3' spacer sequence, f.) a 5' group I intron fragment containing a 5' splice site dinucleotide, and g.) a 3' homology arm. In some embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) an internal ribosome entry site (IRES), d.) a protein coding or noncoding region, e.) a 3' spacer sequence, f) a 5' group I intron fragment containing a 5' splice site dinucleotide, and g.) a 3' homology arm. In some embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) a protein coding or noncoding region, d.) a 3' spacer sequence, e.) a 5' group I intron fragment containing a 5' splice site dinucleotide, and f) a 3' homology arm. In some embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) a 5' spacer sequence, d.) a protein coding or noncoding region, e.) a 5' group I intron fragment containing a 5' splice site dinucleotide, and f.) a 3' homology arm. In some embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) an internal ribosome entry site (IRES), d.) a protein coding or noncoding region, e.) a 5' group I intron fragment containing a 5' splice site dinucleotide, and f) a 3' homology arm. In some embodiments, said vector allows production of a circular RNA that is translatable and/or biologically active inside eukaryotic cells.

In some embodiments, the following elements are operably connected to each other and arranged in the following sequence: a.) a 5' homology arm, b.) a 3' group I intron fragment containing a 3' splice site dinucleotide, c.) a 5' spacer sequence, d.) an internal ribosome entry site (IRES), e.) a protein coding or noncoding region, f) a 3' spacer sequence, g.) a 5' group I intron fragment containing a 5' splice site dinucleotide, and h.) a 3' homology arm. In some embodiments, said vector allowing production of a circular RNA that is translatable and/or biologically active inside eukaryotic cells.

In one embodiment, the 3' group I intron fragment and/or the 5' group I intron fragment is from a Cyanobacterium *Anabaena* sp. pre-tRNA-Leu gene or T4 phage Td gene.

In one embodiment, the 3' group I intron fragment and/or the 5' group I intron fragment is from a Cyanobacterium *Anabaena* sp. pre-tRNA-Leu gene.

In one embodiment, the protein coding region encodes a protein of eukaryotic or prokaryotic origin. In another embodiment, the protein coding region encodes human protein or non-human protein. In some embodiments, the protein coding region encodes one or more antibodies. For example, in some embodiments, the protein coding region encodes human antibodies. In one embodiment, the protein coding region encodes a protein selected from hFIX, SP-B, VEGF-A, human methylmalonyl-CoA mutase (hMUT), CFTR, cancer self-antigens, and additional gene editing enzymes like Cpf1, zinc finger nucleases (ZFNs) and transcription activator-like effector nucleases (TALENs). In another embodiment, the protein coding region encodes a protein for therapeutic use. In one embodiment, the human antibody encoded by the protein coding region is an anti-HIV antibody. In one embodiment, the antibody encoded by the protein coding region is a bispecific antibody. In one embodiment, the bispecific antibody is specific for CD19 and CD22. In another embodiment, the bispecific antibody is specific for CD3 and CLDN6. In one embodiment, the protein coding region encodes a protein for diagnostic use. In one embodiment, the protein coding region encodes *Gaussia* luciferase (Gluc), Firefly luciferase (Fluc), enhanced green fluorescent protein (eGFP), human erythropoietin (hEPO), or Cas9 endonuclease.

In one embodiment, the 5' homology arm is about 5-50 nucleotides in length. In another embodiment, the 5' homology arm is about 9-19 nucleotides in length. In some embodiments, the 5' homology arm is at least 5, 6, 7, 8, 9, 10, 11, 12, 13, 14, 15, 16, 17, 18 or 19 nucleotides in length. In some embodiments, the 5' homology arm is no more than 50, 45, 40, 35, 30, 25 or 20 nucleotides in length. In some embodiments, the 5' homology arm is 5, 6, 7, 8, 9, 10, 11, 12, 13, 14, 15, 16, 17, 18 or 19 nucleotides in length.

In one embodiment, the 3' homology arm is about 5-50 nucleotides in length. In another embodiment, the 3' homology arm is about 9-19 nucleotides in length. In some embodiments, the 3' homology arm is at least 5, 6, 7, 8, 9, 10, 11, 12, 13, 14, 15, 16, 17, 18 or 19 nucleotides in length. In some embodiments, the 3' homology arm is no more than 50, 45, 40, 35, 30, 25 or 20 nucleotides in length. In some embodiments, the 3' homology arm is 5, 6, 7, 8, 9, 10, 11, 12, 13, 14, 15, 16, 17, 18 or 19 nucleotides in length.

In one embodiment, the 5' spacer sequence is at least 10 nucleotides in length. In another embodiment, the 5' spacer sequence is at least 15 nucleotides in length. In a further embodiment, the 5' spacer sequence is at least 30 nucleotides in length. In some embodiments, the 5' spacer sequence is at least 7, 8, 9, 10, 11, 12, 13, 14, 15, 16, 17, 18, 19, 20, 25 or 30 nucleotides in length. In some embodiments, the 5' spacer sequence is no more than 100, 90, 80, 70, 60, 50, 45, 40, 35 or 30 nucleotides in length. In some embodiments the 5' spacer sequence is between 20 and 50 nucleotides in length. In certain embodiments, the 5' spacer sequence is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides in length. In one embodiment, the 5' spacer sequence is a polyA sequence. In another embodiment, the 5' spacer sequence is a polyA-C sequence.

In one embodiment, the 3' spacer sequence is at least 10 nucleotides in length. In another embodiment, the 3' spacer sequence is at least 15 nucleotides in length. In a further embodiment, the 3' spacer sequence is at least 30 nucleotides in length. In some embodiments, the 3' spacer sequence is at least 7, 8, 9, 10, 11, 12, 13, 14, 15, 16, 17, 18, 19, 20, 25 or 30 nucleotides in length. In some embodiments, the 3' spacer sequence is no more than 100, 90, 80, 70, 60, 50, 45, 40, 35 or 30 nucleotides in length. In some embodiments the 3' spacer sequence is between 20 and 50 nucleotides in length. In certain embodiments, the 3' spacer sequence is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides in length. In one embodiment, the 3' spacer sequence is a polyA sequence. In another embodiment, the 5' spacer sequence is a polyA-C sequence.

Extracellular Circularization

In some embodiments, the linear RNA is cyclized, or concatemerized using a chemical method to form an oRNA. In some chemical methods, the 5'-end and the 3'-end of the nucleic acid (e.g., a linear RNA) includes chemically reactive groups that, when close together, may form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a linear RNA will undergo a nucleophilic attack on the 5'-NHS-ester moiety forming a new 5'-/3'-amide bond.

In one embodiment, a DNA or RNA ligase may be used to enzymatically link a 5'-phosphorylated nucleic acid molecule (e.g., a linear RNA) to the 3'-hydroxyl group of a nucleic acid (e.g., a linear nucleic acid) forming a new phosphorodiester linkage. In an example reaction, a linear RNA is incubated at 37 C for 1 hour with 1-10 units of T4 RNA ligase according to the manufacturer's protocol. The ligation reaction may occur in the presence of a linear nucleic acid capable of base-pairing with both the 5'- and 3'-region in juxtaposition to assist the enzymatic ligation reaction. In one embodiment, the ligation is splint ligation where a single stranded polynucleotide (splint), like a single stranded RNA, can be designed to hybridize with both termini of a linear RNA, so that the two termini can be juxtaposed upon hybridization with the single-stranded splint. Splint ligase can thus catalyze the ligation of the juxtaposed two termini of the linear RNA, generating an oRNA.

In one embodiment, a DNA or RNA ligase may be used in the synthesis of the oRNA. As a non-limiting example, the ligase may be a circ ligase or circular ligase.

In one embodiment, either the 5'- or 3'-end of the linear RNA can encode a ligase ribozyme sequence such that during in vitro transcription, the resultant linear RNA includes an active ribozyme sequence capable of ligating the 5'-end of the linear RNA to the 3'-end of the linear RNA. The ligase ribozyme may be derived from the Group I Intron, Hepatitis Delta Virus, Hairpin ribozyme or may be selected by SELEX (systematic evolution of ligands by exponential enrichment).

In one embodiment, a linear RNA may be cyclized or concatemerized by using at least one non-nucleic acid moiety. In one aspect, the at least one non-nucleic acid moiety may react with regions or features near the 5' terminus and/or near the 3' terminus of the linear RNA in order to cyclize or concatermerize the linear RNA. In another aspect, the at least one non-nucleic acid moiety may be located in or linked to or near the 5' terminus and/or the 3' terminus of the linear RNA. The non-nucleic acid moieties contemplated may be homologous or heterologous. As a non-limiting example, the non-nucleic acid moiety may be a linkage such as a hydrophobic linkage, ionic linkage, a biodegradable linkage and/or a cleavable linkage. As another non-limiting example, the non-nucleic acid moiety is a ligation moiety. As yet another non-limiting example, the non-nucleic acid moiety may be an oligonucleotide or a peptide moiety, such as an aptamer or a non-nucleic acid linker as described herein.

In one embodiment, a linear RNA may be cyclized or concatemerized due to a non-nucleic acid moiety that causes an attraction between atoms, molecular surfaces at, near or linked to the 5' and 3' ends of the linear RNA. As a non-limiting example, one or more linear RNA may be cyclized or concatemerized by intermolecular forces or intramolecular forces. Non-limiting examples of intermolecular forces include dipole-dipole forces, dipole-induced dipole forces, induced dipole-induced dipole forces, Van der Waals forces, and London dispersion forces. Non-limiting examples of intramolecular forces include covalent bonds, metallic bonds, ionic bonds, resonant bonds, agnostic bonds, dipolar bonds, conjugation, hyperconjugation and antibonding.

In one embodiment, the linear RNA may comprise a ribozyme RNA sequence near the 5' terminus and near the 3' terminus. The ribozyme RNA sequence may covalently link to a peptide when the sequence is exposed to the remainder of the ribozyme. In one aspect, the peptides covalently linked to the ribozyme RNA sequence near the 5' terminus and the 3' terminus may associate with each other causing a linear RNA to cyclize or concatemerize. In another aspect, the peptides covalently linked to the ribozyme RNA near the 5' terminus and the 3' terminus may cause the linear RNA to cyclize or concatemerize after being subjected to ligated using various methods known in the art such as, but not limited to, protein ligation.

In some embodiments, the linear RNA may include a 5' triphosphate of the nucleic acid converted into a 5' monophosphate, e.g., by contacting the 5' triphosphate with RNA 5' pyrophosphohydrolase (RppH) or an ATP diphosphohydrolase (apyrase). Alternately, converting the 5' triphosphate of the linear RNA into a 5' monophosphate may occur by a two-step reaction comprising: (a) contacting the 5' nucleotide of the linear RNA with a phosphatase (e.g., Antarctic Phosphatase, Shrimp Alkaline Phosphatase, or Calf Intestinal Phosphatase) to remove all three phosphates; and (b) contacting the 5' nucleotide after step (a) with a kinase (e.g., Polynucleotide Kinase) that adds a single phosphate.

In some embodiments, RNA may be circularized using the methods described in WO2017222911 and WO2016197121, the contents of each of which are herein incorporated by reference in their entirety.

In some embodiments, RNA may be circularized, for example, by back splicing of a non-mammalian exogenous intron or splint ligation of the 5' and 3' ends of a linear RNA. In one embodiment, the circular RNA is produced from a recombinant nucleic acid encoding the target RNA to be made circular. As a non-limiting example, the method comprises: a) producing a recombinant nucleic acid encoding the target RNA to be made circular, wherein the recombinant nucleic acid comprises in 5' to 3'order: i) a 3'portion of an exogenous intron comprising a 3' splice site, ii) a nucleic acid sequence encoding the target RNA, and iii) a 5' portion of an exogenous intron comprising a 5' splice site; b) performing transcription, whereby RNA is produced from the recombinant nucleic acid; and c) performing splicing of the RNA, whereby the RNA circularizes to produce a oRNA.

While not wishing to be bound by theory, circular RNAs generated with exogenous introns are recognized by the immune system as "non-self" and trigger an innate immune response. On the other hand, circular RNAs generated with endogenous introns are recognized by the immune system as "self" and generally do not provoke an innate immune response, even if carrying an exon comprising foreign RNA.

Accordingly, circular RNAs can be generated with either an endogenous or exogenous intron to control immunological self/non-self discrimination as desired. Numerous intron sequences from a wide variety of organisms and viruses are known and include sequences derived from genes encoding proteins, ribosomal RNA (rRNA), or transfer RNA (tRNA).

Circular RNAs can be produced from linear RNAs in a number of ways. In some embodiments, circular RNAs are produced from a linear RNA by backsplicing of a downstream 5' splice site (splice donor) to an upstream 3' splice site (splice acceptor). Circular RNAs can be generated in this manner by any nonmammalian splicing method. For example, linear RNAs containing various types of introns, including self-splicing group I introns, self-splicing group II introns, spliceosomal introns, and tRNA introns can be circularized. In particular, group I and group II introns have the advantage that they can be readily used for production of circular RNAs in vitro as well as in vivo because of their ability to undergo self-splicing due to their autocatalytic ribozyme activity.

In some embodiments, circular RNAs can be produced in vitro from a linear RNA by chemical or enzymatic ligation of the 5' and 3' ends of the RNA. Chemical ligation can be performed, for example, using cyanogen bromide (BrCN) or ethyl-3-(3'-dimethylaminopropyl) carbodiimide (EDC) for activation of a nucleotide phosphomonoester group to allow phosphodiester bond formation. See e.g., Sokolova (1988) FEBS Lett 232: 153-155; Dolinnaya et al. (1991) Nucleic Acids Res., 19:3067-3072; Fedorova (1996) Nucleosides Nucleotides Nucleic Acids 15: 1 137-1 147; herein incorporated by reference. Alternatively, enzymatic ligation can be used to circularize RNA. Exemplary ligases that can be used include T4 DNA ligase (T4 Dn1), T4 RNA ligase 1 (T4 Rn1 1), and T4 RNA ligase 2 (T4 Rn1 2).

In some embodiments, splint ligation using an oligonucleotide splint that hybridizes with the two ends of a linear RNA can be used to bring the ends of the linear RNA together for ligation. Hybridization of the splint, which can be either a DNA or a RNA, orientates the 5'-phosphate and 3' —OH of the RNA ends for ligation. Subsequent ligation can be performed using either chemical or enzymatic techniques, as described above. Enzymatic ligation can be performed, for example, with T4 DNA ligase (DNA splint required), T4 RNA ligase 1 (RNA splint required) or T4 RNA ligase 2 (DNA or RNA splint). Chemical ligation, such as with BrCN or EDC, in some cases is more efficient than enzymatic ligation if the structure of the hybridized splint-RNA complex interferes with enzymatic activity.

In some embodiments, the oRNA may further comprise an internal ribosome entry site (IRES) operably linked to an RNA sequence encoding a polypeptide. Inclusion of an IRES permits the translation of one or more open reading frames from a circular RNA. The IRES element attracts a eukaryotic ribosomal translation initiation complex and promotes translation initiation. See, e.g., Kaufman et al., Nuc. Acids Res. (1991) 19:4485-4490; Gurtu et al., Biochem. Biophys. Res. Comm. (1996) 229:295-298; Rees et al., BioTechniques (1996) 20: 102-110; Kobayashi et al., BioTechniques (1996) 21:399-402; and Mosser et al., BioTechniques 1997 22 150-161).

In some embodiments, the circularization efficiency of the circularization methods provided herein is at least about 10%, at least about 15%, at least about 20%, at least about 25%, at least about 30%, at least about 35%, at least about 40%, at least about 45%, at least about 50%, at least about 60%, at least about 70%, at least about 80%, at least about 90%, at least about 95%, or 100%. In some embodiments, the circularization efficiency of the circularization methods provided herein is at least about 40%.

Splicing Element

In some embodiments, the oRNA includes at least one splicing element. The splicing element can be a complete splicing element that can mediate splicing of the oRNA or the spicing element can be a residual splicing element from a completed splicing event. For instance, in some cases, a splicing element of a linear RNA can mediate a splicing event that results in circularization of the linear RNA, thereby the resultant oRNA comprises a residual splicing element from such splicing-mediated circularization event. In some cases, the residual splicing element is not able to mediate any splicing. In other cases, the residual splicing element can still mediate splicing under certain circumstances. In some embodiments, the splicing element is adjacent to at least one expression sequence. In some embodiments, the oRNA includes a splicing element adjacent each expression sequence. In some embodiments, the splicing element is on one or both sides of each expression sequence, leading to separation of the expression products, e.g., peptide(s) and or polypeptide(s).

In some embodiments, the oRNA includes an internal splicing element that when replicated the spliced ends are joined together. Some examples may include miniature introns (<100 nt) with splice site sequences and short inverted repeats (30-40 nt) such as AluSq2, AluJr, and AluSz, inverted sequences in flanking introns, Alu elements in flanking introns, and motifs found in (suptable4 enriched motifs) cis-sequence elements proximal to backsplice events such as sequences in the 200 bp preceding (upstream of) or following (downstream from) a backsplice site with flanking exons. In some embodiments, the oRNA includes at least one repetitive nucleotide sequence described elsewhere herein as an internal splicing element. In such embodiments, the repetitive nucleotide sequence may include repeated sequences from the Alu family of introns. See, e.g., U.S. Pat. No. 11,058,706.

In some embodiments, the oRNA may include canonical splice sites that flank head-to-tail junctions of the oRNA.

In some embodiments, the oRNA may include a bulge-helix-bulge motif, comprising a 4-base pair stem flanked by two 3-nucleotide bulges. Cleavage occurs at a site in the bulge region, generating characteristic fragments with terminal 5'-hydroxyl group and 2', 3'-cyclic phosphate. Circularization proceeds by nucleophilic attack of the 5'-OH group onto the 2', 3'-cyclic phosphate of the same molecule forming a 3', 5'-phosphodiester bridge.

In some embodiments, the oRNA may include a sequence that mediates self-ligation. Non-limiting examples of sequences that can mediate self-ligation include a self-circularizing intron, e.g., a 5' and 3' slice junction, or a self-circularizing catalytic intron such as a Group I, Group II or Group III Introns. Non-limiting examples of group I intron self-splicing sequences may include self-splicing permuted intron-exon sequences derived from T4 bacteriophage gene td, and the intervening sequence (IVS) rRNA of Tetrahymena.

Other Circularization Methods

In some embodiments, linear RNA may include complementary sequences, including either repetitive or nonrepetitive nucleic acid sequences within individual introns or across flanking introns. In some embodiments, the oRNA includes a repetitive nucleic acid sequence. In some embodiments, the repetitive nucleotide sequence includes poly CA or poly UG sequences. In some embodiments, the oRNA includes at least one repetitive nucleic acid sequence that hybridizes to a complementary repetitive nucleic acid sequence in another segment of the oRNA, with the hybridized segment forming an internal double strand. In some embodiments, repetitive nucleic acid sequences and complementary repetitive nucleic acid sequences from two separate oRNA that hybridize to generate a single oRNA, with the hybridized segments forming internal double strands. In some embodiments, the complementary sequences are found at the 5' and 3' ends of the linear RNA. In some embodiments, the complementary sequences include about 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, or more paired nucleotides.

In some embodiments, chemical methods of circularization may be used to generate the oRNA. Such methods may include, but are not limited to click chemistry (e.g., alkyne- and azide-based methods, or clickable bases), olefin metathesis, phosphoramidate ligation, hemiaminal-imine crosslinking, base modification, and any combination thereof. In some embodiments, enzymatic methods of circularization may be used to generate the oRNA. In some embodiments, a ligation enzyme, e.g., DNA or RNA ligase, may be used to generate a template of the oRNA or complement, a complementary strand of the oRNA, or the oRNA.

Any of the circular polynucleotides as taught in for example U.S. Provisional Application No. 61/873,010 filed Sep. 3, 2013 or U.S. Pat. No. 10,709,779, may be used herein. The contents of these references are incorporated herein by reference in their entirety. In addition, any of the circular RNAs, methods for making circular RNAs, circular RNA compositions that are described in the following publications are contemplated herein and are incorporated by reference in their entireties are part of the instant specification: U.S. Pat. Nos. 11,352,640, 11,352,641, 11,203,767, 10,683,498, 5,773,244, and 5,766,903; US Application Publications US 2022/0177540, US 2021/0371494, US 2022/0090137, US 2019/0345503, and US 2015/0299702; and PCT Application Publications WO 2021/226597, WO 2019/236673, WO 2017/222911, WO2016/187583, WO2014/082644 and WO 1997/007825.

H. Pharmaceutical Compositions

The present disclosure relates to pharmaceutical compositions comprising novel Cas12a (or Cas Type V) editing systems. In some embodiments, the Cas12a (or Cas Type V) editing system comprising one or more polypeptides and cognate guide RNA are formulated as part of a lipid nanoparticle. In some embodiments, a lipid nanoparticle comprises an ionizable lipid, a structural lipid, a PEGylated lipid, and a phospholipid.

In various aspects of the invention, the Cas12a (or Cas Type V) genome editing system is delivered as polynucleotides. For instance, in one embodiment, the Cas12a (or Cas Type V) nuclease and the gRNA are delivered as polynucleotides and encoded by one or more plasmids (Lauritsen, I., Porse, A., Sommer, M. O. A. et al. A versatile one-step CRISPR-Cas9 based approach to plasmid-curing. *Microb Cell Fact* 16, 135 (2017). https://doi.org/10.1186/s12934-017-0748-z; Wasels, Frangois et al. "A two-plasmid inducible CRISPR/Cas9 genome editing tool for *Clostridium acetobutylicum.*" *Journal of microbiological methods* vol. 140 (2017): 5-11) doi:10.1016/j.mimet.2017.06.010). In other embodiments, the Cas12a nuclease is encoded in a mRNA and the gRNA is encoded as an in vitro transcribed synthetic oligonucleotide (Yang, Hui et al. "One-step generation of mice carrying reporter and conditional alleles by CRISPR/Cas-mediated genome engineering." *Cell* vol. 154,6 (2013): 1370-9. doi:10.1016/j.cell.2013.08.022). In other aspects, the Cas12a nuclease protein and a synthetic gRNA oligonucleotide (Suresh, Bharathi et al. "Cell-Penetrating Peptide-Mediated Delivery of Cas9 Protein and Guide RNA for Genome Editing." *Methods in molecular biology* (Chfton, N.J.) vol. 1507 (2017): 81-94. doi:10.1007/978-1-4939-6518-2_7) or alternatively as an Cas12a nuclease protein gRNA RNP complex (Gasiunas, Giedrius et al. "Cas9-crRNA ribonucleoprotein complex mediates specific DNA cleavage for adaptive immunity in bacteria." *Proceedings of the National Academy of Sciences of the United States of America* vol. 109,39 (2012): E2579-86. doi: 10.1073/pnas.1208507109).

The pharmaceutical compositions described herein (e.g., LNP compositions comprising a Cas12a gene editing system or components thereof) may be delivered as described in PCT Publication WO2012135805, which is incorporated herein by reference in its entirety, or by another method known or described herein.

In various aspects, the present disclosure provides methods comprising administering a pharmaceutical composition (e.g., LNP formulation comprising a Cas12a gene editing system) to a subject in need thereof. The pharmaceutical composition may be administered to a subject using any amount and any route of administration which may be effective for preventing, treating, diagnosing, or imaging a disease, disorder, and/or condition. The exact amount required will vary from subject to subject, depending on factors such as, but not limited to, the species, age, and general condition of the subject, the severity of the disease, the particular composition, its mode of administration, its mode of activity, and the like. The pharmaceutical composition may be administered to animals, such as mammals (e.g., humans, domesticated animals, cats, dogs, monkeys, mice, rats, etc.). The payload of the pharmaceutical composition is a polynucleotide.

In some embodiments, pharmaceutical, prophylactic, diagnostic, or imaging compositions thereof are administered to humans.

In some embodiments, the herein disclosed pharmaceutical compositions (e.g., LNPs comprising a Cas12a (or Cas Type V) gene editing system) are administered by one or more of a variety of routes, including, but not limited to, local, oral, intravenous, intramuscular, intra-arterial, intramedullary, intrathecal, subcutaneous, intraventricular, transdermal, interdermal, rectal, intravaginal, intraperitoneal, topical (e.g., by powders, ointments, creams, gels, lotions, and/or drops), mucosal, nasal, buccal, enteral, vitreal, intratumoral, sublingual; by intratracheal instillation, bronchial instillation, and/or inhalation; as an oral spray, nasal spray, and/or aerosol, and/or through a portal vein catheter.

In some embodiments, the herein disclosed pharmaceutical compositions (e.g., LNPs comprising a Cas12a (or Cas Type V) gene editing system) are administered by systemic intravenous injection.

In some embodiments, the herein disclosed pharmaceutical compositions (e.g., LNPs comprising a Cas12a (or Cas Type V) gene editing system) are administered intravenously and/or orally. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

In specific embodiments, the herein disclosed pharmaceutical compositions (e.g., LNPs comprising a Cas12a gene editing system) may be administered in a way which allows the genome editing system to cross the blood-brain barrier, vascular barrier, or other epithelial barrier.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose, any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

Dosage forms for local, topical and/or transdermal administration of a pharmaceutical composition may include ointments, pastes, creams, lotions, gels, powders, solutions, sprays, inhalants and/or patches. Additionally, the present disclosure contemplates the use of transdermal patches, which often have the added advantage of providing controlled delivery of a compound to the body. Such dosage forms may be prepared, for example, by dissolving and/or dispensing the compound in the proper medium. Alternatively or additionally, rate may be controlled by either providing a rate controlling membrane and/or by dispersing the compound in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 1% to about 10% (w/w) active ingredient, although the concentration of active ingredient may be as high as the solubility limit of the active ingredient in the solvent. Formulations for topical administration may further comprise one or more of the additional ingredients described herein.

A pharmaceutical composition may be prepared, packaged, and/or sold in a formulation suitable for ophthalmic administration. Such formulations may, for example, be in the form of eye drops including, for example, a 0.1/1.0% (w/w) solution and/or suspension of the active ingredient in an aqueous or oily liquid excipient. Such drops may further comprise buffering agents, salts, and/or one or more of any additional ingredients described herein. Other ophthalmically-administrable formulations which are useful include those which comprise the active ingredient in microcrystalline form and/or in a liposomal preparation. Ear drops and/or eye drops are contemplated as being within the scope of this disclosure.

In general, the most appropriate route of administration will depend upon a variety of factors including the nature of the genome editing system to be delivered (e.g., its stability in the environment of the gastrointestinal tract, bloodstream, etc), the condition of the patient (e.g., whether the patient is able to tolerate particular routes of administration), etc. The present disclosure encompasses the delivery of the genome editing system by any appropriate route taking into consideration likely advances in the sciences of drug delivery.

[00308] In certain embodiments, pharmaceutical compositions in accordance with the present disclosure may be administered at dosage levels sufficient to deliver from about 0.0001 mg/kg to about 100 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic or prophylactic effect. The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administration is employed, split dosing regimens such as those described herein may be used.

According to the present disclosure, administration of the genome editing system in split-dose regimens may produce higher levels of proteins in mammalian subjects. As used herein, a "split dose" is the division of single unit dose or total daily dose into two or more doses. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the genome editing system of the present disclosure are administered to a subject in split doses. In some embodiments, the genome editing system is formulated in buffer only or in a formulation described herein.

The herein disclosed pharmaceutical compositions (e.g., LNPs comprising a Cas12a gene editing system) of the present disclosure may be used or administered in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Pharmaceutical compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body.

It will further be appreciated that therapeutically, prophylactically, diagnostically, or imaging active agents utilized in combination may be administered together in a single pharmaceutical composition or administered separately in different pharmaceutical compositions. In general, it is expected that agents utilized in combination with be utilized at levels that do not exceed the levels at which they are utilized individually. In some embodiments, the levels utilized in combination will be lower than those utilized individually. In one embodiment, the combinations, each or together may be administered according to the split dosing regimens described herein.

The particular combination of therapies (therapeutics or procedures) to employ in a combination regimen will take into account compatibility of the desired therapeutics and/or procedures and the desired therapeutic effect to be achieved. It will also be appreciated that the therapies employed may achieve a desired effect for the same disorder (for example, a pharmaceutical composition useful for treating cancer in accordance with the present disclosure may be administered concurrently with a chemotherapeutic agent), or they may achieve different effects (e.g., control of any adverse effects).

Pharmaceutical compositions containing LNPs disclosed herein are formulated for administration intramuscularly, transarterially, intraocularly, vaginally, rectally, intraperitoneally, intravenously, intranasally, subcutaneously, endoscopically, transdermally, intramuscularly, intraventricularly, intradermally, intrathecally, topically (e.g. by powders, ointments, creams, gels, lotions, and/or drops), mucosally, nasal, enterally, intratumorally, by intratracheal instillation, bronchial instillation, and/or inhalation; nasal spray and/or aerosol, and/or through a portal vein catheter.

The pharmaceutical compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the pharmaceutical compositions, and the like. In some embodiments, the pharmaceutical composition is formulated for extended release. In specific embodiments, the genome editing systems of the present disclosure and/or pharmaceutical, prophylactic, diagnostic, or imaging compositions thereof, may be administered in a way which allows the genome editing system to cross the blood-brain barrier, vascular barrier, or other epithelial barrier.

In some aspects of the present disclosure, the genome editing system of the present disclosure are spatially retained within or proximal to a target tissue. Provided are methods of providing a pharmaceutical composition to a target tissue of a mammalian subject by contacting the target tissue (which contains one or more target cells) with the pharmaceutical composition under conditions such that the pharmaceutical composition, in particular the genome editing system component(s) of the pharmaceutical composition, is substantially retained in the target tissue, meaning that at least 10, 20, 30, 40, 50, 60, 70, 80, 85, 90, 95, 96, 97, 98, 99, 99.9, 99.99 or greater than 99.99% of the pharmaceutical composition is retained in the target tissue. Advantageously, retention is determined by measuring the amount of a component of the genome editing system present in the pharmaceutical composition that enters one or more target cells. For example, at least 1, 5, 10, 20, 30, 40, 50, 60, 70, 80, 85, 90, 95, 96, 97, 98, 99, 99.9, 99.99 or greater than 99.99% of the genome editing system administered to the subject are present intracellularly at a period of time following administration.

Aspects of the present disclosure are directed to methods of providing a pharmaceutical composition to a target tissue or organ of a mammalian subject, by contacting the target tissue (containing one or more target cells) or organ (containing one or more target cells) with the pharmaceutical composition under conditions such that the pharmaceutical composition is substantially retained in the target tissue or organ. The pharmaceutical composition contains an effective amount of a genome editing system of the present disclosure.

Pharmaceutical compositions which may be administered intramuscularly and/or subcutaneously may include, but are not limited to, polymers, copolymers, and gels. The polymers, copolymers and/or gels may further be adjusted to modify release kinetics by adjusting factors such as, but not limited to, molecular weight, particle size, payload and/or ratio of the monomers. As a nonlimiting example, formulations administered intramuscularly and/or subcutaneously may include a copolymer such as poly(lactic-co-glycolic acid).

Localized delivery of the pharmaceutical compositions described herein may be administered by methods such as, but not limited to, topical delivery, ocular delivery, transdermal delivery, and the like. The pharmaceutical composition may also be administered locally to a part of the body not normally available for localized delivery such as, but not limited to, when a subject's body is open to the environment during treatment. The pharmaceutical composition may further be delivered by bathing, soaking and/or surrounding the body part with the pharmaceutical composition.

However, the present disclosure encompasses the delivery of a genome editing system disclosed herein, and/or pharmaceutical, prophylactic, diagnostic, or imaging compositions thereof, by any appropriate route taking into consideration likely advances in the sciences of drug delivery.

In some embodiments, an LNP composition includes an ionizable lipid, a phospholipid, a PEG lipid, and a structural lipid. In certain embodiments, the lipid component of the nanoparticle composition includes about 30 mol % to about 60 mol % ionizable lipid, about 0 mol % to about 30 mol % phospholipid, about 18.5 mol % to about 48.5 mol % structural lipid, and about 0 mol % to about 10 mol % of PEG lipid, provided that the total mol % does not exceed 100%. In some embodiments, the lipid component of the nanoparticle composition includes about 35 mol % to about 55 mol % ionizable lipid, about 5 mol % to about 25 mol % phospholipid, about 30 mol % to about 40 mol % structural lipid, and about 0 mol % to about 10 mol % of PEG lipid. In a particular embodiment, the lipid component includes about 50 mol % ionizable lipid, about 10 mol % phospholipid, about 38.5 mol % structural lipid, and about 1.5 mol % of PEG lipid. In another particular embodiment, the lipid component includes about 40 mol % ionizable lipid, about 20 mol % phospholipid, about 38.5 mol % structural lipid, and about 1.5 mol % of PEG lipid. In another particular embodiment, the lipid component includes about 48.5 mol % ionizable lipid, about 10 mol % phospholipid, about 40 mol % structural lipid, and about 1.5 mol % of PEG lipid. In another particular embodiment, the lipid component includes about 48.5 mol % ionizable lipid, about 10 mol % phospholipid, about 39 mol % structural lipid, and about 2.5 mol % of PEG lipid. In some embodiments, the phospholipid may be DOPE or DSPC. In other embodiments, the PEG lipid may be PEG-DMG and/or the structural lipid may be cholesterol. The amount of a genome editing system payload in a nanoparticle composition may depend on the size, composition, desired target and/or application, or other properties of the nanoparticle composition as well as on the properties of the genome editing system. For example, the amount of genome editing system useful in a nanoparticle composition may depend on the size, sequence, and other characteristics of the genome editing system. The relative amounts of genome editing system and other elements (e.g., lipids) in a nanoparticle composition may also vary. In some embodiments, the wt/wt ratio of the lipid component to an enzyme in a nanoparticle composition is about 5:1 to about 60:1, such as 5:1, 6:1, 7:1, 8:1, 9:1, 10:1, 11:1, 12:1, 13:1, 14:1, 15:1, 16:1, 17:1, 18:1, 19:1, 20:1, 25:1, 30:1, 35:1, 40:1, 45:1, 50:1, and 60:1. The amount of a enzyme in a nanoparticle composition may, for example, be measured using absorption spectroscopy (e.g., ultraviolet-visible spectroscopy).

In some embodiments, an LNP composition containing a genome editing system of the present disclosure, comprising a genome editing system is formulated to provide a specific E:P ratio. The E:P ratio of the composition refers to the molar ratio of nitrogen atoms in one or more lipids to the number of phosphate groups in an RNA. In general, a lower E:P ratio is preferred. The one or more enzymes, lipids, and amounts thereof may be selected to provide an E:P ratio from about 2:1 to about 30:1, such as 2:1, 3:1, 4:1, 5:1, 6:1, 7:1, 8:1, 9:1, 10:1, 12:1, 14:1, 16:1, 18:1, 20:1, 22:1, 24:1, 26:1, 28:1, or 30:1. In certain embodiments, the E:P ratio is about 2:1 to about 8:1. In other embodiments, the E:P ratio is from about 5:1 to about 8:1. For example, the E:P ratio may be about 5.0:1, about 5.5:1, about 5.67:1, about 6.0:1, about 6.5:1, or about 7.0:1.

The characteristics of an LNP (or "nanoparticles") composition may depend on the components thereof. For example, a nanoparticle composition including cholesterol as a structural lipid may have different characteristics than a nanoparticle composition that includes a different structural lipid. Similarly, the characteristics of a nanoparticle composition may depend on the absolute or relative amounts of its components. For instance, a nanoparticle composition including a higher molar fraction of a phospholipid may have different characteristics than a nanoparticle composition including a lower molar fraction of a phospholipid. Characteristics may also vary depending on the method and conditions of preparation of the nanoparticle composition. Nanoparticle compositions may be characterized by a variety of methods. For example, microscopy (e.g., transmission electron microscopy or scanning electron microscopy) may be used to examine the morphology and size distribution of a nanoparticle composition. Dynamic light scattering or potentiometry (e.g., potentiometric titrations) may be used to measure Zeta potentials. Dynamic light scattering may also be utilized to determine particle sizes. Instruments such as the Zetasizer Nano ZS (Malvern Instruments Ltd, Malvern, Worcestershire, UK) may also be used to measure multiple characteristics of a nanoparticle composition, Such as particle size, polydispersity index, and Zeta potential.

The mean size of an LNP composition may be between 10s of nm and 100s of nm, e.g., measured by dynamic light scattering (DLS). For example, the mean size is about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the mean size of a nanoparticle composition is about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 nm, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In certain embodiments, the mean size of a nanoparticle composition is about 70 nm to about 100 nm. In a particular embodiment, the mean size may be about 80 nm. In other embodiments, the mean size may be about 100 nm.

A LNP composition may be relatively homogenous. A polydispersity index may be used to indicate the homogeneity of a nanoparticle composition, e.g., the particle size distribution of the nanoparticle compositions. A small (e.g., less than 0.3) polydispersity index generally indicates a narrow particle size distribution. A nanoparticle composition may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25.

The Zeta potential of a LNP composition may be used to indicate the electrokinetic potential of the composition. For example, the Zeta potential may describe the surface charge of a nanoparticle composition. Nanoparticle compositions with relatively low charges, positive or negative, are generally desirable, as more highly charged species may interact undesirably with cells, tissues, and other elements in the body. In some embodiments, the Zeta potential of a nanoparticle composition is about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV, to about +20 mV, from about 0 mV to about +15 mV, from about 0 mV to about +10 mV, from about 0 mV to about +5 mV, from about +5 mV to about +20 mV, from about +5 mV, to about +15 mV, or from about +5 mV to about +10 mV.

The efficiency of encapsulation of an LNP payload describes the amount of payload that is encapsulated or otherwise associated with a nanoparticle composition after preparation, relative to the initial amount provided. The encapsulation efficiency is desirably high (e.g., close to 100%). The encapsulation efficiency may be measured, for example, by comparing the amount of payload in a solution containing the nanoparticle composition before and after breaking up the nanoparticle composition with one or more organic solvents or detergents. Fluorescence may be used to measure the amount of free payload in a solution. For the nanoparticle compositions described herein, the encapsulation efficiency of a therapeutic and/or prophylactic may be at least 50%, for example 50%, 55%, 60%. 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In certain embodiments, the encapsulation efficiency may be at least 90%.

Lipids and their method of preparation are disclosed in, e.g., U.S. Pat. Nos. 8,569,256, 5,965,542 and U.S. Patent Publication Nos. 2016/0199485, 2016/0009637, 2015/0273068, 2015/0265708, 2015/0203446, 2015/0005363, 2014/0308304, 2014/0200257, 2013/086373, 2013/0338210, 2013/0323269, 2013/0245107, 2013/0195920, 2013/0123338, 2013/0022649, 2013/0017223, 2012/0295832, 2012/0183581, 2012/0172411, 2012/0027803, 2012/0058188, 2011/0311583, 2011/0311582, 2011/0262527, 2011/0216622, 2011/0117125, 2011/0091525, 2011/0076335, 2011/0060032, 2010/0130588, 2007/0042031, 2006/0240093, 2006/0083780, 2006/0008910, 2005/0175682, 2005/017054, 2005/0118253, 2005/0064595, 2004/0142025, 2007/0042031, 1999/009076 and PCT Pub. Nos. WO 99/39741, WO 2017/117528, WO 2017/004143, WO 2017/075531, WO 2015/199952, WO 2014/008334, WO 2013/086373, WO 2013/086322, WO 2013/016058, WO 2013/086373, WO2011/141705, and WO 2001/07548 and Semple et. al, Nature Biotechnology, 2010, 28, 172-176, the full disclosures of which are herein incorporated by reference in their entirety for all purposes.

An LNP-based nucleobase editing systems, RNA therapeutics and pharmaceutical compositions may include any substance useful in pharmaceutical compositions. For example, the nanoparticle composition may include one or more pharmaceutically acceptable excipients or accessory ingredients such as, but not limited to, one or more solvents, dispersion media, diluents, dispersion aids, suspension aids, granulating aids, disintegrants, fillers, glidants, liquid vehicles, binders, surface active agents, isotonic agents, thickening or emulsifying agents, buffering agents, lubricating agents, oils, preservatives, and other species. Excipients such as waxes, butters, coloring agents, coating agents, flavorings, and perfuming agents may also be included. Pharmaceutically acceptable excipients are well known in the art (see for example Remington's The Science and Practice of Pharmacy, 21 Edition, A. R. Gennaro: Lippincott, Williams & Wilkins, Baltimore, Md., 2006).

The LNP-based nucleobase editing systems, RNA therapeutics and pharmaceutical compositions thereof described herein may be administered by any delivery route which results in a therapeutically effective outcome. These include, but are not limited to, enteral (into the intestine), gastroenteral, epidural (into the dura mater), oral (by way of the mouth), transdermal, intracerebral (into the cerebrum), intracerebroventricular (into the cerebral ventricles), epicutaneous (application onto the skin), intradermal (into the skin itself), subcutaneous (under the skin), nasal administration (through the nose), intravenous (into a vein), intravenous bolus, intravenous drip, intra-arterial (into an artery), intramuscular (into a muscle), intracardiac (into the heart), intraosseous infusion (into the bone marrow), intrathecal (into the spinal canal), intraparenchymal (into brain tissue), intraperitoneal (infusion or injection into the peritoneum), intravesical infusion, intravitreal (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracoronal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis, and spinal.

In some embodiments, compositions may be administered in a way which allows them to cross the blood-brain barrier, vascular barrier, or other epithelial barrier. The originator constructs, benchmark constructs, and targeting systems may be administered in any suitable form, either as a liquid solution or suspension, as a solid form suitable for liquid solution or suspension in a liquid solution. The originator constructs, benchmark constructs, and targeting systems may be formulated with any appropriate and pharmaceutically acceptable excipient.

In some embodiments, the originator constructs, benchmark constructs, and targeting systems may be delivered to a subject via a single route administration.

In some embodiments, the originator constructs, benchmark constructs, and targeting systems may be delivered to a subject via a multi-site route of administration. A subject may be administered at 2, 3, 4, 5, or more than 5 sites.

In some embodiments, a subject may be administered the originator constructs, benchmark constructs, and targeting systems using a bolus infusion.

In some embodiments, a subject may be administered originator constructs, benchmark constructs, and targeting systems using sustained delivery over a period of minutes, hours, or days. The infusion rate may be changed depending on the subject, distribution, formulation or another delivery parameter.

In some embodiments, the originator constructs, benchmark constructs, and targeting systems may be delivered by intramuscular delivery route. Non-limiting examples of intramuscular administration include an intravenous injection or a subcutaneous injection.

In some embodiments, the originator constructs, benchmark constructs, and targeting systems may be delivered by oral administration. Non-limiting examples of oral delivery include a digestive tract administration and a buccal administration.

In some embodiments, the originator constructs, benchmark constructs, and targeting systems may be delivered by intraocular delivery route. A non-limiting example of intraocular delivery include an intravitreal injection.

In some embodiments, the originator constructs, benchmark constructs, and targeting systems may be delivered by intranasal delivery route. Non-limiting examples of intranasal delivery include nasal drops or nasal sprays.

In some embodiments, the originator constructs, benchmark constructs, and targeting systems may be administered to a subject by peripheral injections. Non-limiting examples of peripheral injections include intraperitoneal, intramuscular, intravenous, conjunctival, or joint injection.

In some embodiments, the originator constructs, benchmark constructs, and targeting systems may be delivered by injection into the cerebrospinal fluid. Non-limiting examples of delivery to the cerebrospinal fluid include intrathecal and intracerebroventricular administration.

In some embodiments, the originator constructs, benchmark constructs, and targeting systems may be delivered by systemic delivery. As a non-limiting example, the systemic delivery may be by intravascular administration.

In some embodiments, the originator constructs, benchmark constructs, and targeting systems may be administered to a subject by intracranial delivery.

In some embodiments, the originator constructs, benchmark constructs, and targeting systems may be administered to a subject by intraparenchymal administration.

In some embodiments, the originator constructs, benchmark constructs, and targeting systems may be administered to a subject by intramuscular administration.

In some embodiments, the originator constructs, benchmark constructs, and targeting systems are administered to a subject and transduce muscle of a subject. As a non-limiting example, the originator constructs, benchmark constructs, and targeting systems are administered by intramuscular administration.

In some embodiments, the originator constructs, benchmark constructs, and targeting systems may be administered to a subject by intravenous administration.

In some embodiments, the originator constructs, benchmark constructs, and targeting systems may be administered to a subject by subcutaneous administration.

In some embodiments, the originator constructs, benchmark constructs, and targeting systems may be administered to a subject by topical administration.

In some embodiments, the originator constructs, benchmark constructs, and targeting systems may be delivered by more than one route of administration.

The originator constructs, benchmark constructs, and targeting systems described herein may be co-administered in conjunction with one or more originator constructs, benchmark constructs, targeting systems, or therapeutic agents or moieties.

In some embodiments, pharmaceutical compositions and/or formulations described herein may be administered parenterally. Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose, any bland fixed oil can be employed including synthetic mono- or diglycerides. Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of active ingredients, it is often desirable to slow the absorption of active ingredients from subcutaneous or intramuscular injections. This may be accomplished by the use of liquid suspensions of crystalline or amorphous material with poor water solubility. The rate of absorption of active ingredients depends upon the rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

In some embodiments, pharmaceutical compositions and/or formulations described herein may be formulated for administration topically. The skin may be an ideal target site for delivery as it is readily accessible. Three routes are commonly considered to deliver pharmaceutical compositions and/or formulations described herein to the skin: (i) topical application (e.g. for local/regional treatment and/or cosmetic applications); (ii) intradermal injection (e.g. for local/regional treatment and/or cosmetic applications); and (iii) systemic delivery (e.g. for treatment of dermatologic diseases that affect both cutaneous and extracutaneous regions).

In some embodiments, pharmaceutical compositions and/or formulations described herein may be delivered using a variety of dressings (e.g., wound dressings) or bandages (e.g., adhesive bandages) for conveniently and/or effectively carrying out methods described herein. Typically dressing or bandages may comprise sufficient amounts of pharmaceutical compositions and/or formulations described herein to allow users to perform multiple treatments.

Dosage forms for topical and/or transdermal administration may include ointments, pastes, creams, lotions, gels, powders, solutions, sprays, inhalants and/or patches. Generally, active ingredients are admixed under sterile conditions with pharmaceutically acceptable excipients and/or any needed preservatives and/or buffers. Additionally, contemplated herein is the use of transdermal patches, which often have the added advantage of providing controlled delivery of pharmaceutical compositions and/or formulations described herein to the body. Such dosage forms may be prepared, for example, by dissolving and/or dispensing pharmaceutical compositions and/or formulations described herein in the proper medium. Alternatively, or additionally, rates may be controlled by either providing rate controlling membranes and/or by dispersing pharmaceutical compositions and/or formulations described herein in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 1% to about 10% (w/w) active ingredient, although the concentration of active ingredient may be as high as the solubility limit of the active ingredient in the solvent. Formulations for topical administration may further comprise one or more of the additional ingredients described herein.

In some embodiments, pharmaceutical compositions and/or formulations described herein may be prepared, packaged, and/or sold in formulations suitable for ophthalmic and/or otic administration. Such formulations may, for example, be in the form of eye and/or ear drops including, for example, a 0.1/1.0% (w/w) solution and/or suspension of the active ingredient in aqueous and/or oily liquid excipients. Such drops may further comprise buffering agents, salts, and/or one or more other of any additional ingredients described herein. Other ophthalmically-administrable formulations which are useful include those which comprise active ingredients in microcrystalline form and/or in liposomal preparations. Subretinal inserts may also be used as forms of administration.

In some embodiments, pharmaceutical compositions and/or formulations described herein may be administered orally. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

In some embodiments, pharmaceutical compositions and/or formulations described herein are formulated in depots for extended release.

In some embodiments, pharmaceutical compositions and/or formulations described herein are spatially retained within or proximal to target tissues. Provided are methods of providing pharmaceutical compositions and/or formulations described herein to target tissues of mammalian subjects by contacting target tissues (which comprise one or more target cells) with pharmaceutical compositions and/or formulations described herein under conditions such that they are substantially retained in target tissues, meaning that at least 10, 20, 30, 40, 50, 60, 70, 80, 85, 90, 95, 96, 97, 98, 99, 99.9, 99.99 or greater than 99.99% of the composition is retained in the target tissues. Advantageously, retention is determined by measuring the amount of pharmaceutical compositions and/or formulations described herein that enter one or more target cells. For example, at least 1%, 5%, 10%, 20%, 30%, 40%, 50%, 60%, 70%, 80%, 85%, 90%, 95%, 96%, 97%, 98%, 99%, 99.9% 99.99%, or greater than 99.99% of pharmaceutical compositions and/or formulations described herein administered to subjects are present intracellularly at a period of time following administration. For example, intramuscular injection to mammalian subjects may be performed using aqueous compositions comprising an active ingredient and one or more transfection reagents, and retention is determined by measuring the amount of active ingredient present in muscle cells.

In some embodiments, provided are methods for delivering pharmaceutical compositions and/or formulations described herein to target tissues of mammalian subjects, by contacting target tissues (comprising one or more target cells) with pharmaceutical compositions and/or formulations described herein under conditions such that they are substantially retained in such target tissues. Pharmaceutical compositions and/or formulations described herein comprise enough active ingredient such that the effect of interest is produced in at least one target cell. In some embodiments, pharmaceutical compositions and/or formulations described herein generally comprise one or more cell penetration agents, although "naked" formulations (such as without cell penetration agents or other agents) are also contemplated, with or without pharmaceutically acceptable carriers.

In some embodiments, pharmaceutical compositions and/or formulations described herein may be prepared, packaged, and/or sold in formulations suitable for pulmonary administration. In some embodiments, such administration is via the buccal cavity. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising dry powder reservoirs to which streams of propellant may be directed to disperse such powder. In some embodiments, self-propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally, propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

In some embodiments, pharmaceutical compositions and/or formulations described herein may be administered nasally and/or intranasal. In some embodiments, formulations described herein useful for pulmonary delivery may also be useful for intranasal delivery. In some embodiments, formulations for intranasal administration comprise a coarse powder comprising the active ingredient and having an average particle from about 0.2 μm to 500 μm. Such formulations are administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein.

In some embodiments, pharmaceutical compositions and/or formulations described herein may be administered rectally and/or vaginally. Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

I. Host Cells

One aspect of the disclosure provides an isolated host cell that includes one or more of the compositions described herein, including, but not limited to, a Cas12a (or Cas Type V) gene editing systems or any component thereof. In some embodiments, the host cell is a prokaryotic cell, an archaeal cell, or a eukaryotic host cell. In some embodiments, the eukaryotic host cell is a mammalian cell, such as a human cell, a non-human cell, or a non-human mammalian cell. In some embodiments, the host cell is an artificial cell or genetically modified cell. In some embodiments, the host cell is in vitro, such as a tissue culture cell. In some embodiments, the host cell is within a living host organism.

Cells that may contain any of the compositions described herein. The methods described herein are used to deliver a Cas12a (or Cas Type V) gene editing system described herein into a eukaryotic cell (e.g., a mammalian cell, such as a human cell). In some embodiments, the cell is in vitro (e.g., cultured cell. In some embodiments, the cell is in vivo (e.g., in a subject such as a human subject). In some embodiments, the cell is ex vivo (e.g., isolated from a subject and may be administered back to the same or a different subject).

The present disclosure contemplates the use of any suitable host cell. For example, the cell host can be a mammalian cell. Mammalian cells of the present disclosure include human cells, primate cells (e.g., vero cells), rat cells (e.g., GH3 cells, OC23 cells) or mouse cells (e.g., MC3T3 cells). There are a variety of human cell lines, including, without limitation, human embryonic kidney (HEK) cells, HeLa cells, cancer cells from the National Cancer Institute's 60 cancer cell lines (NCI60), DU145 (prostate cancer) cells, Lncap (prostate cancer) cells, MCF-7 (breast cancer) cells, MDA-MB-438 (breast cancer) cells, PC3 (prostate cancer) cells, T47 D (breast cancer) cells, THP-1 (acute myeloid leukemia) cells, U87 (glioblastoma) cells, SHSY5Y human neuroblastoma cells (cloned from a myeloma) and Saos-2 (bone cancer) cells. In some embodiments, the cells can be human embryonic kidney (HEK) cells (e.g., HEK 293 or HEK 293T cells). In some embodiments, the cells can be stem cells (e.g., human stem cells) such as, for example, pluripotent stem cells (e.g., human pluripotent stem cells including human induced pluripotent stem cells (hiPSCs)).

A stem cell refers to a cell with the ability to divide for indefinite periods in culture and to give rise to specialized cells. A pluripotent stem cell refers to a type of stem cell that is capable of differentiating into all tissues of an organism, but not alone capable of sustaining full organismal development. A human induced pluripotent stem cell refers to a somatic (e.g., mature or adult) cell that has been reprogrammed to an embryonic stem cell-like state by being forced to express genes and factors important for maintaining the defining properties of embryonic stem cells (see, e.g., Takahashi and Yamanaka, Cell 126 (4): 663-76, 2006, incorporated by reference herein). Human induced pluripotent stem cells express stem cell markers and are capable of generating cells characteristic of all three germ layers (ectoderm, endoderm, mesoderm).

Some aspects of this disclosure provide cells comprising any of the compositions disclosed herein, including, but not limited to, Cas12a (or Cas Type V) gene editing systems and components and vector or vector systems encoding the engineered gene editing systems, and any combinations thereof. In some embodiments, a host cell is transiently or non-transiently transfected with one or more delivery systems described herein, including virus-based systems, virus-like particle systems, and non-virus-base delivery, including LNPs and liposomes. In some embodiments, a cell is transfected as it naturally occurs in a subject. In some embodiments, a cell that is transfected is taken from a subject, i.e., ex vivo transfection. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A 172, A20, A253, A431, A-549, ALC, B16, B35, BCP-1 cells, BEAS-2B, bEnd.3, BHK-21, BR 293. BxPC3. C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK 11, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof.

Cell lines are available from a variety of sources known to those with skill in the art (see, e.g., the American Type Culture Collection (ATCC) (Manassas, Va.)). In some embodiments, a cell transfected with one or more retron delivery systems described herein is used to establish a new cell line comprising one or more nucleic acid molecules encoding the recombinant retron-based gene editing systems described herein, or encoding at last a component of said systems (e.g., a recombinant ncRNA or a recombinant retron RT).

It is an object of the invention to deliver the herein described genome editing system into various host cells. Preferably, each of the components of the genome editing system are delivered together. In other embodiments, one or more of the components of the genome editing system are delivered separately. In some embodiments, the gene editing components are delivered as DNA molecule, RNA molecules, proteins, nucleoproteins, or combinations thereof.

Alternatively, provided also are delivery of the genome editing system using plasmids.

Suitable host cell is selected from one or more prokaryotic cells, mammalian cells, human cells or synthetic cells. Various tissue types are selected based on the delivery modality. In various embodiments, the various host cells transformed, transduced or the uptake of the genome editing system produces a site-specific modification of a targeted polynucleotide sequence of a host cell genome.

Exemplary host cells for the methods and compositions of the invention include but are not limited to prokaryotic cells, yeast or fungal cells, archaea cells, plant cells, animal cells or human cells.

In various other aspects, provided are fusion protein comprising an isolated polypeptide encoded by an isolated or recombinant nucleic acid sequence fused to a heterologous amino acid sequence. Preferably, the fusion protein comprises a nuclease-deficient polypeptide.

In preferred aspects, the Cas12a (or Cas Type V) gene editing systems described herein rely on the cells' DNA repair pathways. DNA double-stranded breaks (DSBs) are repaired in cells via the error-prone non-homologous end-joining (NHEJ), or the error-free homologous recombination (HR), the most common form of homology-directed repair (HDR). The DSB repair through NHEJ creates small insertions or deletions (indels), while HDR requires a repair template, which could be a sister chromatid, another homologous region, or an exogenous repair donor. Preferably, the double-stranded breaks (DSBs) created by the Cas12a nuclease makes deletions or insertions at a precise loci in the host cell genome. Accordingly, in some embodiments, the method of modifying a targeted polynucleotide sequence comprises homology-directed repair (HDR). In other embodiments, use of the Cas12a complex for HDR provides an efficiency of HDR of 1, 1.5, 2, 2.5, 3, 3.5, 4, 4.5, 5, 5.5, 6, 6.5, 7, 7.5, 8, 8.5, 9, 9.5, 10 or higher-fold improvement.

In some cases, the method of modifying a targeted polynucleotide sequence comprises non-homologous end joining (NHEJ). In certain cases, use of the Cas12a complex for NHEJ provides an efficiency of 1, 1.5, 2, 2.5, 3, 3.5, 4, 4.5, 5, 5.5, 6, 6.5, 7, 7.5, 8, 8.5, 9, 9.5, 10 or higher-fold improvement.

| Species | Cassettes for CRISPR/Cas9 | | Editing efficiency | Advances in genetic modification using CRISPR/Cas9 | Strategies for improving efficiency | References |
|---|---|---|---|---|---|---|
| | Cas9 protein | gRNA | | | | |
| *Bacillus subtilis* | lacA5'-Cas9-tracRNA-lacA3' | thrC5'-P$_{xylA.sphI+1}$ gRNA-thrC3' | 100 and 85% for single, double gene mutations, and 69% or chromosomal insertion of a 2.9 kb hyaluronic acid (HA) biosynthetic operon | Multiplex knockout | Choose optimal homology lengths (1,000 bp) for editing template, optimize PAM site | Westbrook et al., 2016 |
| | Pgrac-SpCas9 | Para-sgRNA-donor DNA | Point mutation (68%), single-gene deletion in spo0A (100%), and gene insertion (97%) | Traceless, high efficient | Incubation for longer periods to generate iterative DSB | So et al., 2017 |
| *Clostridium autoethanogenum* | Cas9 was introduced into plasmid pLZtet3np and pIPL12 | sgRNA was introduced into plasmid pMTL83157 | Over 50% for gene deletion | Construct a small library of tetracycline-inducible promoters for efficient gene deletion | Construct variants of inducible promoter of control the expression of Cas9. Cas9 protein was adapted to *C. authethanogenum* | Nagaraju et al., 2016 |

-continued

| Species | Cassettes for CRISPR/Cas9 | | Editing efficiency | Advances in genetic modification using CRISPR/Cas9 | Strategies for improving efficiency | References |
| --- | --- | --- | --- | --- | --- | --- |
| | Cas9 protein | gRNA | | | | |
| *Clostridium cellulolyticum* | Optimized SpCas9 was introduced into plasmid pLYC017 | rRNA was introduced into plasmid pCR8/GW/TOPO TA | High editing efficiency (>95%) | High editing efficiency even using short homologous arms (0.2 kb), deliver foreign genes into the genome in a single step without a marker | Generate single-nick triggered homologous recombination and chose optimal homology lengths for editing template. | Xu T. et al., 2015 |
| *Corynebactrerium glutamicum* | Ptac-SD-SPCas9 was introduced into plasmid pXMJ19 | Ptrc-sgRNA was introduced into plasmid pEC-XK99E | Deletion efficiencies were almost 100% for porB, mepA, clpX, and Ncg10911 genes | High editing efficiency even using short homologous arms (0.3 kb) | Choose strong promoters for the expression of Cas9 and sgRNA | Liu J. et al., 2017 |
| *Clostridium ljungdahlii* | $P_{thi}$ SpCas9 | $P_{araE}$-SgRNA | Deletion efficiencies were 100%, >75%, 100%, and >50% for pta, adhEl, ctf, and pyre | More rapid, no added antibiotic resistance gene, scarless, and minimal polar effects | Choose strong promoters for the expression of Cas9 and sgRNA | Park et al., 2019 |
| *Clostridium pasteruianum* | $P_{thi}$-SpCas9 | $P_{sRNA}$-sgRNA | Deletion efficiencies were 100% for cpaAIR | High efficient | Inducible expression of cas9 was recommended to mitigate toxicity for high editing efficiency | Pyne et al., 2016 |
| *Lactobacillus reuteri* | tracrRNA, cas9, and CRISPR arrays derived vrom pCAS9 were introduced into plasmid pNZ9350 | | 100% for genes mutations | High efficient | Employ oligonucleotide-mediated recombineering (RecT) | Jee-Hwan and Jan-Peter, 2014 |
| *Streptomyces albus* | $P_{rpsLp}$-Cas9-$T_{fd}$ | $P_{gapdhp}$-Cas9-$T_{fd}$ | Multiplex gene deletions with editing efficiency ranging from 70 to 100% | Reduce the time and labor needed to perform precise genome manipulation | Choose strong promoters for the expression of Cas9 and gRNA; Cas9 gene was optimized to favor the *Streptomyces* codon bias. | Wang et al., 2016 |
| *Streptomyces coelicolor* | | | | | | Wang et al., 2016 |
| *Streptomyces lividians* | | | | | | Wang et al., 2016 |
| *Streptomyces viridochromogenes* | | | | | | Wang et al., 2016 |

J. Methods of Use

Gene Editing

In some embodiments, the Cas12a (or Cas Type V) gene editing systems described herein (including any described or contemplated format, such as a Cas12a base editor, Cas12a prime editor, or Cas12a retron editor) are used for genome editing at a desired site. In some embodiments, the Cas12a (or Cas Type V) systems include a DNA donor template comprising an edited sequence.

In some embodiments, the DNA donor template has 10-100 or more bp of homologous nucleic acid sequence to the genome on both sides of the desired edit. The desired edit (insertion, deletion, or mutation) is in between the homologous sequence.

In some embodiments, DNA donor template comprise a sequence comprising an intended genome edit flanked by a pair of homology arms responsible for targeting the donor polynucleotide to the target locus to be edited in a cell. The donor polynucleotide typically comprises a 5' homology arm that hybridizes to a 5' genomic target sequence and a 3' homology arm that hybridizes to a 3' genomic target sequence. The homology arms are referred to herein as 5' and 3' (i.e., upstream and downstream) homology arms, which relate to the relative position of the homology arms to the nucleotide sequence comprising the intended edit within the donor polynucleotide. The 5' and 3' homology arms hybridize to regions within the target locus in the genomic DNA to be modified, which are referred to herein as the "5' target sequence" and "3' target sequence," respectively.

The homology arm must be sufficiently complementary for hybridization to the target sequence to mediate homologous recombination between the donor polynucleotide and genomic DNA at the target locus. For example, a homology arm may comprise a nucleotide sequence having at least about 80-100% sequence identity to the corresponding genomic target sequence, including any percent identity within this range, such as at least 80%, 81%, 82%, 83%, 84%, 85%, 86%, 87%, 88%, 89%, 90%, 91%, 92%, 93%, 94%, 95%, 96%, 97%, 98%, 99% or 100% sequence identity thereto, wherein the nucleotide sequence comprising the intended edit can be integrated into the genomic DNA by HDR at the genomic target locus recognized (i.e., having sufficient complementary for hybridization) by the 5' and 3' homology arms.

In some embodiments, the corresponding homologous nucleotide sequences in the genomic target sequence (i.e., the "5' target sequence" and "3' target sequence") flank a specific site for cleavage and/or a specific site for introducing the intended edit. The distance between the specific cleavage site and the homologous nucleotide sequences (e.g., each homology arm) can be several hundred nucleotides. In some embodiments, the distance between a homology arm and the cleavage site is 200 nucleotides or less (e.g., 0, 10, 20, 30, 50, 75, 100, 125, 150, 175, and 200 nucleotides). In most cases, a smaller distance may give rise to a higher gene targeting rate. In some embodiments, the donor polynucleotide is substantially identical to the target genomic sequence, across its entire length except for the sequence changes to be introduced to a portion of the genome that encompasses both the specific cleavage site and the portions of the genomic target sequence to be altered.

A homology arm can be of any length, e.g. 10 nucleotides or more, 15 nucleotides or more, 20 nucleotides or more, 50 nucleotides or more, 100 nucleotides or more, 250 nucleotides or more, 300 nucleotides or more, 350 nucleotides or more, 400 nucleotides or more, 450 nucleotides or more, 500 nucleotides or more, 1000 nucleotides (1 kb) or more, 5000 nucleotides (5 kb) or more, 10000 nucleotides (10 kb) or more, etc. In some instances, the 5' and 3' homology arms are substantially equal in length to one another. However, in some instances the 5' and 3' homology arms are not necessarily equal in length to one another. For example, one homology arm may be 30% shorter or less than the other homology arm, 20% shorter or less than the other homology arm, 10% shorter or less than the other homology arm, 5% shorter or less than the other homology arm, 2% shorter or less than the other homology arm, or only a few nucleotides less than the other homology arm. In other instances, the 5' and 3' homology arms are substantially different in length from one another, e.g. one may be 40% shorter or more, 50% shorter or more, sometimes 60% shorter or more, 70% shorter or more, 80% shorter or more, 90% shorter or more, or 95% shorter or more than the other homology arm.

The DNA donor template may be used in combination with an RNA-guided nuclease, which is targeted to a particular genomic sequence (i.e., genomic target sequence to be modified) by a guide RNA. A target-specific guide RNA comprises a nucleotide sequence that is complementary to a genomic target sequence, and thereby mediates binding of the nuclease-gRNA complex by hybridization at the target site. For example, the gRNA can be designed with a sequence complementary to the sequence of a minor allele to target the nuclease-gRNA complex to the site of a mutation. The mutation may comprise an insertion, a deletion, or a substitution. For example, the mutation may include a single nucleotide variation, gene fusion, translocation, inversion, duplication, frameshift, missense, nonsense, or other mutation associated with a phenotype or disease of interest. The targeted minor allele may be a common genetic variant or a rare genetic variant. In some embodiments, the gRNA is designed to selectively bind to a minor allele with single base-pair discrimination, for example, to allow binding of the nuclease-gRNA complex to a single nucleotide polymorphism (SNP). In particular, the gRNA may be designed to target disease-relevant mutations of interest for the purpose of genome editing to remove the mutation from a gene. Alternatively, the gRNA can be designed with a sequence complementary to the sequence of a major or wild-type allele to target the nuclease-gRNA complex to the allele for the purpose of genome editing to introduces a mutation into a gene in the genomic DNA of the cell, such as an insertion, deletion, or substitution. Such genetically modified cells can be used, for example, to alter phenotype, confer new properties, or produce disease models for drug screening.

In some embodiments, the Cas12a (or Cas Type V) editing systems can comprise one or more additional RNA-guided nuclease used for genome modification is a clustered regularly interspersed short palindromic repeats (CRISPR) system Cas nuclease. Any RNA-guided Cas nuclease capable of catalyzing site-directed cleavage of DNA to allow integration of donor polynucleotides by the HDR mechanism can be used in genome editing, including CRISPR system Class 1, Type I, II, or III Cas nucleases; Class 2, Type II nuclease (such as Cas9); a Class 2, Type V nuclease (such as Cpf1), or a Class 2, Type VI nuclease (such as C2c2). Examples of Cas proteins include Cas1, Cas1B, Cas2, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof.

In some embodiments, a Class 1, type II CRISPR system Cas9 endonuclease is used. Cas9 nucleases from any species, or biologically active fragments, variants, analogs, or derivatives thereof that retain Cas9 endonuclease activity (i.e., catalyze site-directed cleavage of DNA to generate double-strand breaks) may be used to perform genome modification as described herein. The Cas9 need not be physically derived from an organism but may be synthetically or recombinantly produced. Cas9 sequences from a number of bacterial species are well known in the art and listed in the National Center for Biotechnology Information (NCBI) database. See, for example, NCBI entries for Cas9 from: *Streptococcus pyogenes* (WP 002989955, WP_038434062, WP_011528583); *Campylobacter jejuni* (WP_022552435, YP 002344900), *Campylobacter* coil (WP 060786116); *Campylobacter fetus* (WP 059434633); *Corynebacterium ulcerans* (NC_015683, NC_017317); *Corynebacterium diphtheria* (NC_016782, NC_016786); *Enterococcus faecalis* (WP 033919308); *Spiroplasma syrphidicola* (NC 021284); *Prevotella intermedia* (NC 017861); *Spiroplasma taiwanense* (NC 021846); *Streptococcus iniae* (NC 021314); *Belliella baltica* (NC 018010); *Psychroflexus torquisl* (NC O 18721); *Streptococcus thermophilus* (YP 820832), *Streptococcus mutans* (WP 061046374, WP 024786433); *Listeria innocua* (NP 472073); *Listeria monocytogenes* (WP 061665472); *Legionella pneumophila* (WP 062726656); *Staphylococcus aureus* (WP_001573634); *Francisella tularensis* (WP_032729892, WP_014548420), *Enterococcus faecalis* (WP 033919308); *Lactobacillus rhamnosus* (WP 048482595, WP_032965177); and *Neisseria meningitidis* (WP_061704949, YP_002342100); all of which sequences (as entered by the date of filing of this application) are herein incorporated by reference in their entireties. Any of these sequences or a variant thereof comprising a sequence having at least about 70-100% sequence identity thereto, including any percent identity within this range, such as 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% sequence identity thereto, can be used for genome editing, as described herein. See also Fonfara et al. (2014) Nucleic Acids Res. 42(4): 2577-90; Kapitonov et al. (2015) J. Bacterid. 198(5): 797-807, Shmakov et al. (2015) Mol. Cell. 60(3):385-397, and Chylinski et al. (2014) Nucleic Acids Res. 42(10):6091-6105); for sequence comparisons and a discussion of genetic diversity and phylogenetic analysis of Cas9.

The genomic target site will typically comprise a nucleotide sequence that is complementary to the gRNA and may further comprise a protospacer adjacent motif (PAM). In some embodiments, the target site comprises 20-30 base pairs in addition to a 3 or more base pair PAM. Typically, the first nucleotide of a PAM can be any nucleotide, while the two or more other nucleotides will depend on the specific Cas9 protein that is chosen. Exemplary PAM sequences are known to those of skill in the art and include, without limitation, NNG, NGN, NAG, and NGG, wherein N represents any nucleotide. In some embodiments, the allele targeted by a gRNA comprises a mutation that creates a PAM within the allele, wherein the PAM promotes binding of the Cas9-gRNA complex to the allele.

In some embodiments, the gRNA is 5-50 nucleotides, 10-30 nucleotides, 15-25 nucleotides, 18-22 nucleotides, or 19-21 nucleotides in length, or any length between the stated ranges, including, for example, 10, 11, 12, 13, 14, 15, 16, 17, 18, 19, 20, 21, 22, 23, 24, 25, 26, 27, 28, 29, 30, 31, 32, 33, 34, or 35 nucleotides in length. The guide RNA may be a single guide RNA comprising crRNA and tracrRNA sequences in a single RNA molecule, or the guide RNA may comprise two RNA molecules with crRNA and tracrRNA sequences residing in separate RNA molecules.

In another embodiment, the CRISPR nuclease from *Prevotella* and *Francisella* 1 (Cpf1, or Cas12a) is used. Cpf1 is another class II CRISPR/Cas system RNA-guided nuclease with similarities to Cas9 and may be used analogously. Unlike Cas9, Cpf1 does not require a tracrRNA and only depends on a crRNA in its guide RNA, which provides the advantage that shorter guide RNAs can be used with Cpf1 for targeting than Cas9. Cpf1 is capable of cleaving either DNA or RNA. The PAM sites recognized by Cpf1 have the sequences 5'-YTN-3' (where "Y" is a pyrimidine and "N" is any nucleobase) or 5'-TTN-3', in contrast to the G-rich PAM site recognized by Cas9. Cpf1 cleavage of DNA produces double-stranded breaks with a sticky-ends having a 4 or 5 nucleotide overhang. For a discussion of Cpf1, see, e.g., Ledford et al. (2015) Nature. 526 (7571):17-17, Zetsche et al. (2015) Cell. 163 (3):759-771, Murovec et al. (2017) Plant Biotechnol. J. 15(8):917-926, Zhang et al. (2017) Front. Plant Sci. 8:177, Fernandes et al. (2016) Postepy Biochem. 62(3):315-326; herein incorporated by reference.

C2c1 (Cas12b) is another class II CRISPR/Cas system RNA-guided nuclease that may be used. C2c1, similarly to Cas9, depends on both a crRNA and tracrRNA for guidance to target sites. See, e.g., Shmakov et al. (2015) Mol Cell. 60(3):385-397, Zhang et al. (2017) Front Plant Sci. 8:177; herein incorporated by reference.

In yet another embodiment, an engineered RNA-guided FokI nuclease may be used. RNA-guided FokI nucleases comprise fusions of inactive Cas9 (dCas9) and the FokI endonuclease (FokI-dCas9), wherein the dCas9 portion confers guide RNA-dependent targeting on FokI. For a description of engineered RNA-guided FoId nucleases, see, e.g., Havlicek et al. (2017) Mol. Ther. 25(2):342-355, Pan et al. (2016) Sci Rep. 6:35794, Tsai et al. (2014) Nat Biotechnol. 32(6):569-576; herein incorporated by reference.

In other embodiments, any other Cas enzymes and variants described in other sections of the application (all incorporated herein) can be used similarly.

In some embodiments, the RNA-guided nuclease is provided in the form of a protein, optionally where the nuclease is complexed with a gRNA to form a ribonucleoprotein (RNP) complex. In some embodiments, the RNA-guided nuclease is provided by a nucleic acid encoding the RNA-guided nuclease, such as an RNA (e.g., messenger RNA) or DNA (expression vector). In some embodiments, the RNA-guided nuclease and the gRNA are both provided by vectors, such as the vectors and the vector system described in other parts of the application (all incorporated herein by reference). Both can be expressed by a single vector or separately on different vectors. The vectors encoding the RNA-guided nuclease and gRNA may be included in the vector system comprising the Cas12a editing system msr gene, msd gene and ret gene sequences. In some embodiments, the RNA-guided nuclease is fused to the RT and/or the msDNA.

The RNP complex may be administered to a subject or delivered into a cell by methods known in the art, such as those described in U.S. Pat. No. 11,390,884, which is incorporated by reference herein in its entirety. In some embodiments, the endonuclease/gRNA ribonucleoprotein (RNP) complexes are delivered to cells by electroporation. Direct delivery of the RNP complex to a subject or cell eliminates the need for expression from nucleic acids (e.g., transfection of plasmids encoding Cas9 and gRNA). It also eliminates unwanted integration of DNA segments derived from nucleic acid delivery (e.g., transfection of plasmids encoding Cas9 and gRNA). An endonuclease/gRNA ribonucleoprotein (RNP) complex usually is formed prior to administration.

Codon usage may be optimized to further improve production of an RNA-guided nuclease and/or reverse transcriptase (RT) in a particular cell or organism. For example, a nucleic acid encoding an RNA-guided nuclease or reverse transcriptase can be modified to substitute codons having a higher frequency of usage in a yeast cell, a bacterial cell, a human cell, a non-human cell, a mammalian cell, a rodent cell, a mouse cell, a rat cell, or any other host cell of interest, as compared to the naturally occurring polynucleotide sequence. When a nucleic acid encoding the RNA-guided nuclease or reverse transcriptase is introduced into cells, the protein can be transiently, conditionally, or constitutively expressed in the cell.

In some embodiments, the Cas12a editing system used for genome editing with nuclease genome editing systems can further include accessory or enhancer proteins for recombination. Examples of recombination enhancers can include nonhomologous end joining (NHEJ) inhibitors (e.g., inhibitor of DNA ligase IV, a KU inhibitor (e.g., KU70 or KU80), a DNA-PKc inhibitor, or an artemis inhibitor) and homologous directed repair (HDR) promoters, or both, that can enhance or improve more precise genome editing and/or the efficiency of homologous recombination. In some embodiments, the recombination accessory or enhancers can comprise C-terminal binding protein interacting protein (CtIP), cyclinB2, Rad family members (e.g. Rad50, Rad51, Rad52, etc).

CtIP is a transcription factor containing C2H2 zinc fingers that are involved in early steps of homologous recombination. Mammalian CtIP and its orthologs in other eukaryotes promote the resection of DNA double-strand breaks and are essential for meiotic recombination. HDR may be enhanced by using Cas9 nuclease associated (e.g. fused) to an N-terminal domain of CtIP, an approach that forces CtIP to the cleavage site and increases transgene integration by HDR. In some embodiments, an N-terminal fragment of CtIP, called HE for HDR enhancer, may be sufficient for HDR stimulation and requires the CtIP multimerization domain and CDK phosphorylation sites to be active. HDR stimulation by the Cas9-HE fusion depends on the guide RNA used, and therefore the guide RNA will be designed accordingly.

Using the gene editing system described herein, any target gene or sequence in a host cell can be edited or modified for a desired trait, including but not limited to: Myostatin (e.g., GDF8) to increase muscle growth; Pc POLLED to induce hairlessness; KISSIR to induce bore taint; Dead end protein (dnd) to induce sterility; Nano2 and DDX to induce sterility; CD163 to induce PRRSV resistance; RELA to induce ASFV resilience; CD18 to induce Mannheimia (*Pasteurella*) *haemolytica* resilience; NRAMP1 to induce tuberculosis resilience; Negative regulators of muscle mass (e.g., Myostatin) to increase muscle mass.

Epigenetic Editing

In some embodiments, the Cas12a (or Cas Type V) gene editing systems described herein when including an epigenetic modifier domain can be used for genome editing at a desired site. Epigenetic modifications of DNA and histones are known for their multifaceted contributions to transcriptional regulation. As these modifications are faithfully propagated throughout DNA replication, they are considered central players in cellular memory of transcriptional states. Many efforts in the last decade have generated a vast understanding of individual epigenetic modifications and their contribution to transcriptional regulation. Epigenetic editing offers powerful tools to selectively induce epigenetic changes in a genome without altering the sequence of a nucleotide sequence as a means to regulate gene activity. The foundation of epigenetic editing is formed by the ability to generate fusion proteins of epigenetic enzymes or their catalytic domains with programmable DNA-binding platforms such as the clustered regularly interspaced short palindromic repeat (e.g., CRISPR Cas9 or Cas12a) to target these to an endogenous locus of choice. The enzymatic fusion protein then dictates the initial deposited modification while subsequent cross-talk within the local chromatin environment likely influences epigenetic and transcriptional output.

Accordingly, in one aspect, the disclosure provides an epigenetic gene editing system comprising one or more epigenetic enzymes or their catalytic domains combined with a Cas12a programmable nuclease, and an appropriate guide RNA for guiding the Cas12a to a particular target site. In some embodiments, the Cas12a may be fused to the epigenetic enzyme or a catalytic domain thereof. In other embodiments, the Cas12a and the epigenetic enzyme or catalytic domain thereof are not fused but may be co-delivered. In the latter embodiment, the epigenetic enzyme or catalytic domain there may include at targeting moiety to cause it to be co-localized with the Cas12a at the target site defined by the guide RNA.

Epigenetic enzymes include, but are not limited to DNA methyltransferases, histone methyltransferases, and histone deacetylases. In other embodiments, the epigenetic enzyme is histone deacetylase, histone deacetylase, histone methyl transferase, histone demethylase, DNA methyl transferase, DNA demethylase, DNA ligase, other ligases, ubiquitinase, ubiquitin ligase, phosphatase, or a phosphokinase.

In some embodiments, the DNA donor template has 10-100 or more bp of homologous nucleic acid sequence to the genome on both sides of the desired edit. The desired edit (insertion, deletion, or mutation) is in between the homologous sequence.

In still other embodiments, the LNPs may be used to deliver an epigenetic editing system. Epigenetic editors are generally composed of an epigenetic enzyme or their catalytic domain fused with a user-programmable DNA-binding protein, such as CRISPR Cas12a. The user-programmable DNA-binding protein (plus a guide RNA in the case of a nucleic acid programmable DNA binding protein) guides the epigenetic enzyme (e.g., a DNA methyltransferase or DNMT) to a specific site (e.g., a CpG island in a promoter region of a gene) in order to induce a change in promoter activity.

Epigenetic modifications of DNA and histones are known for their multifaceted contributions to transcriptional regulation. As these modifications are faithfully propagated throughout DNA replication, they are considered central players in cellular memory of transcriptional states. Many efforts in the last decade have generated a vast understanding of individual epigenetic modifications and their contribution to transcriptional regulation. Epigenetic editing offers powerful tools to selectively induce epigenetic changes in a genome without altering the sequence of a nucleotide sequence as a means to regulate gene activity. The foundation of epigenetic editing is formed by the ability to generate fusion proteins of epigenetic enzymes or their catalytic domains with programmable DNA-binding platforms such as the clustered regularly interspaced short palindromic repeat (e.g., CRISPR Cas9 or Cas12a) to target these to an endogenous locus of choice. The enzymatic fusion protein then dictates the initial deposited modification while subsequent cross-talk within the local chromatin environment likely influences epigenetic and transcriptional output.

The following published literature discussing epigenetic editing is incorporated herein by reference each in their entireties.

Gjaltema R A F, Rots M G. Advances of epigenetic editing. Curr Opin Chem Biol. 2020 August; 57:75-81. doi: 10.1016/j.cbpa.2020.04.020. Epub 2020 Jun. 30. PMID: 32619853. www.sciencedirect.com/science/article/pii/S1367593120300636?via%3Dihub Kleinstiver B P, Sousa A A, Walton R T, Tak Y E, Hsu J Y, Clement K, Welch M M, Horng J E, Malagon-Lopez J, Scarfo I, Maus M V, Pinello L, Aryee M J, Joung J K.

Engineered CRISPR-Cas12a variants with increased activities and improved targeting ranges for gene, epigenetic and base editing. Nat Biotechnol. 2019 March; 37(3):276-282. doi: 10.1038/s41587-018-0011-0. Epub 2019 Feb. 11. Erratum in: Nat Biotechnol. 2020 July; 38(7):901. PMID: 30742127; PMCID: PMC6401248. www.ncbi.nlm.nih.gov/pmc/articles/PMC6401248/

Rots M G, Jeltsch A. Editing the Epigenome: Overview, Open Questions, and Directions of Future Development. Methods Mol Biol. 2018; 1767:3-18. doi: 10.1007/978-1-4939-7774-1_1. PMID: 29524127.

Liu X S, Jaenisch R. Editing the Epigenome to Tackle Brain Disorders. Trends Neurosci. 2019 December; 42(12): 861-870. doi: 10.1016/j.tins.2019.10.003. Epub 2019 Nov. 7. PMID: 31706628.

Waryah C B, Moses C, Arooj M, Blancafort P. Zinc Fingers, TALEs, and CRISPR Systems: A Comparison of Tools for Epigenome Editing. Methods Mol Biol. 2018; 1767:19-63. doi: 10.1007/978-1-4939-7774-1_2. PMID: 29524128.

Xu X, Hulshoff M S, Tan X, Zeisberg M, Zeisberg E M. CRISPR/Cas Derivatives as Novel Gene Modulating Tools: Possibilities and In Vivo Applications. Int J Mol Sci. 2020 Apr. 25; 21(9):3038. doi: 10.3390/ijms21093038. PMID: 32344896; PMCID: PMC7246536. www.ncbi.nlm.nih.gov/pmc/articles/PMC7246536/

In addition, the following published patent literature relating to epigenetic editing is incorporated herein by reference each in their entireties.

| Publication Number | Title |
|---|---|
| WO2023283359A2 | COMPOSITIONS AND METHODS FOR MODULATING SECRETED FRIZZLED RECEPTOR PROTEIN 1 (SFRP1) GENE EXPRESSION |
| WO2022226139A1 | TISSUE-SPECIFIC NUCLEIC ACID DELIVERY BY MIXED CATIONIC LIPID PARTICLES |
| WO2022132926A1 | TISSUE-SPECIFIC NUCLEIC ACID DELIVERY BY 1,2-DIOLEOYL-3-TRIMETHYLAMMONIUM-PROPANE (DOTAP) LIPID NANOPARTICLES |
| WO2021183720A1 | COMPOSITIONS AND METHODS FOR MODULATING FORKHEAD BOX P3 (FOXP3) GENE EXPRESSION |
| WO2021061815A1 | COMPOSITIONS AND METHODS FOR MODULATING HEPATOCYTE NUCLEAR FACTOR 4-ALPHA (HNF4α) GENE EXPRESSION |
| WO2021061707A1 | COMPOSITIONS AND METHODS FOR MODULATING APOLIPOPROTEIN B (APOB) GENE EXPRESSION |
| WO2021061698A1 | METHODS AND COMPOSITIONS FOR MODULATING FRATAXIN EXPRESSION AND TREATING FRIEDRICH'S ATAXIA |

Diseases and Disorders

Provided herein are methods of treating a disease or disorder, the methods comprising administering to a subject in need thereof a pharmaceutical composition of the present disclosure. In various embodiments of the invention, target genome or epigenetic modifications include cells with monogenic diseases or disorders. Various monogenic diseases include but are not limited to: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; Tay-Sachs Disease; hereditary tyrosinemia I; Influenza; SARS-CoV-2; Alzheimer's disease; Parkinson's disease.

Target sequences related to certain diseases and disorders are known in some cases. Target sequences or target editing sites include disease-associated or causative mutations for one or more of 10,000 monogenic disorders. A list of target sequences can be generated based on the monogenic disorders. Common genetic disorders that may be correctable by the Cas12a (or Cas Type V) gene editing systems described here including but are not limited to: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; and Tay-Sachs Disease. In other embodiments, the disease-associated gene can be associated with a polygenic disorder selected from the group consisting of: heart disease; high blood pressure; Alzheimer's disease; arthritis; diabetes; cancer; and obesity.

The Cas12a (or Cas Type V) gene editing systems disclosed herein may also be used to treat the following genetic disorders by editing a defect in the disease-associated gene, as follows:

| Genetic disease | Disease gene |
|---|---|
| Arenoleukodystrophy (ALD) | ABCD1 |
| Agammaglobulinemia non-Bruton type | IGHM |
| Alport syndrome | COL4A5 |
| Amyloid neuropathy - Andrade disease | TTR |
| Angioneurotic oedema | C1NH |

-continued

| Genetic disease | Disease gene |
|---|---|
| Alpha1-antitrypsin deficiency | SERPINEA 1 |
| Bartter syndrome type 4 | BSND |
| Blepharophimosis - ptosis - epicanthus inversus syndrome (BEPS) | FOXL2 |
| Brugada sindrome - Long QT syndrome-3 | SCN5A |
| Bruton agammaglobulinemia tyrosine kinase | BTK |
| Ceroid lipofuscinosis neuronal type 2 | CLN2 |
| Charcot Marie Tooth type 1A (CMT1A) | PMP22 |
| Charcot Marie Tooth type X (CMTX) | CMTX |
| Chronic granulomatous disease (CGD) | CYBB |
| Cystic Fibrosis (CF) | CFTR |
| Congenital adrenal hyperplasia (CAH) | CYP21A2 |
| Congenital disorder of glycosylation type Ia (CDG Ia) | PMM2 |
| Congenital fibrosis of extraocular muscles 1 (CFEOM1) | KIF21A |
| Crigler-Najjar syndrome | UGT1A1 |
| Deafness, autosomal recessive | CX26 |
| Diamond-Blackfan anemia (DBA) | RPS19 |

-continued

| Genetic disease | Disease gene |
|---|---|
| Duchenne-Becker muscular dystrophy (DMD/DMB) | DMD |
| Duncan disease - X-linked lymphoproliferative syndrome (XLPD) | SH2D1A |
| Ectrodactyly ectodermal dysplasia and cleft lip/palate syndrome (EEC) | p63 |
| Epidermolysis bullosa dystrophica/pruriginosa | COL7A1 |
| Exostoses multiple type I (EXT1) | EXT1 |
| Exostoses multiple type II (EXT2) | EXT2 |
| Facioscapulohumeral muscular dystrophy | FRG1 |
| Factor VII deficiency | F7 |
| Familial Mediterranean Fever (FMF) | MEFV |
| Fanconi anemia A | FANCA |
| Fanconi anemia G | FANCG |
| Fragile-X | FRAXA |
| Gangliosidosis (GM1) | GLB1 |
| Gaucher disease (GD) | GBA |
| Glanzmann thrombasthenia | ITGA2B |
| Glucose-6-phosphate dehydrogenase deficiency | G6PD |
| Glutaric acidemia I | GCDH |
| Haemophilia A | F8 |
| Haemophilia B | F9 |
| Hand-foot-uterus syndrome | HOXD13 |
| Hemophagocytic lymphohistiocytosis familial, type 2 (FHL2) | PRF1 |
| Hypomagnesaemia primary | CLDN16 |
| HYPOPHOSPHATASIA | ALPL |
| Holt-Oram Sindrome (HOS) | TBX5 |
| Homocystinuria | MTHFR |
| Incontinentia pigmenti | NEMO |
| Lesch-Nyhan syndrome | HPRT |
| Limb-girdle muscular dystrophy type 2C (LGMD2C) | SGCG |
| Long QT syndrome-1 | KCNQ1 |
| Mannosidosis Alpha | MAN2B1 |
| Marfan syndrome | FBN1 |
| Methacrylic Aciduria, deficiency of beta-hydroxyisobutyryl-CoA deacylase | HIBCH |
| Mevalonic aciduria | MVK |
| Myotonic dystrophy (DM) | DMPK |
| Myotonic dystrophy type 2 (DM2) | ZNF9 |
| Mucopolysaccharidosis Type I - Hurler syndrome | IDUA |
| Mucopolysaccharidosis Type IIIA - Sanfilippo sindrome A (MPS3A) | SGSH |
| Mucopolysaccharidosis Type IIIB - Sanfilippo sindrome B (MPS3B) | NAGLU |
| Mucopolysaccharidosis Type VI (MPS VI) - Maroteaux-Lamy Syndrome | ARSB |
| Neuronal ceroid lipofuscinosis 1 - Batten's disease (CLN1) | PPT1 |
| Niemann-Pick disease | SMPD1 |
| Noonan syndrome | PTPN11 |
| Pancreatitis, hereditary (PCTT) | PRSS1 |
| Paramyotonia congenita (PMC) | SCN4A |
| Phenylketonuria | PAH |
| Polycystic kidney disease type 1 (PKD1) | PKD1 |
| Polycystic kidney disease type 2 (PKD2) | PKD2 |
| Polycystic kidney and hepatic disease-1 (ARPKD) | PKHD1 |
| Schwartz-Jampel/Stuve-Wiedemann syndrome | LIFR |
| Sickle cell anemia | HBB |
| Synpolydactyly (SPD1) | HOXA13 |
| Smith-Lemli-Opitz syndrome | DHCR7 |
| Spastic paraplegia type 3 | SPG3A |
| Spinal Muscular Atrophy (SMA) | SMN |
| Spinocerebellar ataxia 3 (SCA3) | ATXN3 |
| Spinocerebellar ataxia 7 (SCA7) | ATXN7 |
| Stargardt disease | ABCA4 |
| Tay Sachs (TSD) | HEXA |
| Thalassemia-α mental retardation syndrome | ATRX |
| Thalassemia-β | HBB |
| Torsion dystonia, early onset (EOTD) | DYT1 |
| Tyrosinaemia type 1 | FAH |
| Tuberosclerosis 1 | TSC1 |
| Tuberosclerosis 2 | TSC2 |
| Wiskott-Aldrich Sindrome (WAS) | WAS |

In addition, the Cas12a gene editing systems disclosed herein may also be used to treat the following genetic disorders by editing a defect in the disease-associated gene, or in more than one gene associated with a particular disorders, as follows:

| A<br>Genetic disease | B<br>Disease-associated genes | C<br>Most common of (B) | D<br>Encoded product of (C) | E<br>Accession No. of (C) | F<br>Type of product of (C) |
|---|---|---|---|---|---|
| Adrenal hyperplasia due to 21-hydroxylase deficiency (21-OHD CAH) | CYP21A2 | CYP21A2 (196) | Cytochrome P450 family 21 subfamily A member 2 | P08686 | Enzyme |
| Aicardi-Goutiéres syndrome encephalopathy | ADAR; IFIH1; RNASEH2A; RNASEH2B; RNASEH2C; SAMHD1; TREX1 | RNASEH2B (28) | Ribonuclease H2 subunit B | Q5TBB1 | Enzyme |
| Alpha-1-antitrypsin (A1AT) deficiency (AATD) | SERPINA1 | SERPINA1 (83) | Serpin family A member 1 | P01009 | Enzyme inhibitor |
| Arrhythmogenic right ventricular cardiomyopathy/ dysplasia (ARVC, ARVD) | 13 different genes linked to this disorder, so far. | PKP2 (138) | Plakophilin 2 | Q99959 | Adhesion protein in junctions and intermediate filaments. |
| Autosomal dominant polycystic kidney disease (ADPKD) | BICC1; GANAB; PKD1; PKD2 | PKD1 (1154) | Polycystin 1 | P98161 | Subunit of ion channel complex |
| Brugada syndrome ventricular fibrillation | 22 different genes linked to this disorder, so far. | SCN5A (725) | Sodium voltage-gated channel alpha subunit 5 | Q14524 | Ion channel |
| Catecholaminergic polymorphic ventricular tachycardia (CPVT) | CALM1; CALM2; CALM3; CASQ2; RYR2; TECRL; TRDN | RYR2 (288) | Ryanodine receptor 2 | Q92736 | Ion channel |

-continued

| A<br>Genetic disease | B<br>Disease-associated genes | C<br>Most common of (B) | D<br>Encoded product of (C) | E<br>Accession No. of (C) | F<br>Type of product of (C) |
|---|---|---|---|---|---|
| Charcot-Marie-Tooth[d] disease/Hereditary motor and sensory neuropathy | 75 different genes linked to this disorder, so far. | PMP22 (63) | Peripheral myelin protein 22[d] | Q01453 | Ill-defined role in myelin and Schwann cells |
| Congenital adrenal hyperplasia (CAH) | CYP11B1; CYP17A1; CYP21A2; HSD3B2; POR; STAR | CYP21A2 (214) | Cytochrome P450 family 21 subfamily A member 2 | P08686 | Enzyme |
| Congenital sucrase-isomaltase deficiency (CSID) | SI | SI (23) | Sucrase-isomaltase | P14410 | Enzyme |
| Congenital bilateral absence of vas deferens | CFTR; ADGRG2 | CFTR (120) | Cystic fibrosis transmembrane conductance regulator | Q20BH0 | Ion channel |
| Cystic fibrosis | CFTR; CLCA4; DCTN4; STX1A; TGFB1 | CFTR (1053) | Cystic fibrosis transmembrane conductance regulator | Q20BH0 | Ion channel |
| Cystinuria-lysinuria syndrome/Cystinuria | SLC3A1; SLC7A9 | SLC7A9 (83) | Solute carrier family 7 member 9 | P82251 | Membrane transporter |
| Cytomegalic congenital adrenal hypoplasia (AHC) (subtype of congenital adrenal hypoplasia) | NR0B1 | NR0B1 (112) | Nuclear receptor subfamily 0 group B member 1 | P51843 | Nuclear receptor |
| Dentinogenesis imperfecta (DGI) (all types) | DSPP | DSPP (11) | Dentin sialophosphoprotein | Q9NZW4 | Seeds biomineralization, Dentinogenesis |
| Duchenne muscular dystrophy (DMD) | DMD; LTBP4 | DMD (830) | Dystrophin | P11532 | Structural protein |
| Dysbetalipoproteinemia/ Hyperlipoproteinemia type 3 | APOE | APOE (42) | Apolipoprotein E | P02649 | Lipid carrier, lipoprotein |
| Ehlers-Danlos syndrome | COL1A1; COL5A1; COL5A2 | COL5A1 (106) | Collagen type V alpha 1 chain, collagen type V alpha 2 chain | P20908, P05997 | Structural protein |
| Familial adenomatous polyposis (FAP) | APC; MUTYH | APC (539) | Adenomatous polyposis coli protein | P25054 | Tumor suppressor, regulatory protein |
| Gardner syndrome (subtype of familial adenomatous polyposis) | APC | APC (539) | Adenomatous polyposis coli protein | P25054 | Tumor suppressor, associated with microtublules |
| Familial cerebral cavernous malformation | CCM2; KRIT1; PDCD10 | KRIT1 (80) | Krev interaction trapped protein 1 | O00522 | Regulatory protein |
| Familial hypocalciuric hypercalcemia type 1 (FHH) | CASR | CASR (373) | Calcium sensing receptor | P41180 | G protein-coupled receptor |
| Famililal hypercholesterolemia | APOB; LDLR; LDLRAP1; PCSK | LDLR (1254) | Low density lipoprotein receptor | P01130 | Lipoprotein receptor |
| Familial isolated dilated cardiomyopathy | 45 different genes linked to this disorder, so far. | TTN (672) | Titin | Q8WZ42 | Muscle protein |
| Familial long QT syndrome (LQTS), including Romano-Ward syndrome | 19 different genes linked to this disorder, so far. | KCNQ1 (448) | Potassium voltage-gated channel subfamily Q member 1 | P51787 | Ion Channel |
| Fragile X syndrome/ Martin-bell syndrome | FMR1 | FMR1 (7) | Fragile X mental retardation 1 | Q06787 | Regulator of mRNA biology |
| Glucose-6-phosphate dehydrogenase deficiency | G6PD | G6PD (218) | Glucose-6-phosphate 1 dehydrogenase | P11413 | Enzyme |
| Glycogen storage disease | 27 different genes linked to this disorder, so far. | AGL (117) | Glycogen debranching enzyme | P35573 | Enzyme |
| GM2 gangliosidosis | GM2A; HEXA; HEXB | HEXA (124) | Hexosaminidase subunit alpha | P06865 | Enzyme |
| Hemochromatosis | BMP6; HAMP; HFE; HJV; SLC40A1; TFR2 | HFE (43) | Hereditary hemochromatosis protein | Q30201 | Binds transferrin receptor |

| A<br>Genetic disease | B<br>Disease-associated genes | C<br>Most common of (B) | D<br>Encoded product of (C) | E<br>Accession No. of (C) | F<br>Type of product of (C) |
|---|---|---|---|---|---|
| Hemolytic anemia due to red cell pyruvate kinase deficiency | PKLR | PKLR (237) | Pyruvate kinase | P30613 | Enzyme |
| Hemophilia A and B | F8; F9 | F8 (1898) | Coagulation factor VIII | P00451 | Cofactor for factor IXa |
| Hemophilia A | F8 | F8 (3364) | Coagulation factor VIII | P00451 | Cofactor for factor IXa |
| Hemorrhagic telangiectasia/Osler Weder Rendu disease | ACVRL1; ENG; GDF2; SMAD4 | ENG (187) | Endoglin | P17813 | Regulation of angiogenesis |
| Hereditary angioedema (HAE)/Angioneurotic edema | ANGPT1; F12; PLG; SERPING1 | SERPING1 (252) | Serpin family G member 1 | P05155 | Enzyme inhibitor |
| Hereditary breast and ovarian cancer syndrome | 14 different genes linked to this disorder so far. | BRCA1 (1262) | Breast cancer type 1 susceptibility protein | P38398 | E3 ubiquitin-protein ligase |
| Hereditary fructose intolerance/Fructosemia | ALDOB | ALDOB (32) | Aldolase, fructose-bisphosphate B | P05062 | Enzyme |
| Hereditary xanthinuria/Xanthine stone disease | MOCOS; XDH | MOCOS (8); XDH (17) | Molybdenum cofactor sulfurase, xanthine dehydrogenase | Q9C5X8, P47989 | Enzymes |
| Hypohidrotic ectodermal dysplasia (HED) | 10 different genes linked to this disorder, so far. | EDA (199) | Ectodysplasin A | Q92838 | Cytokine |
| Iminoglycinuria | SLC36A2; SLC6A18; SLC6A19; SLC6A20 | SLC36A2 (1) | Solute carrier family 36 member 2 | Q495M3 | Membrane transporter |
| Li-Fraumeni syndrome sarcoma, breast, leukemia, and adrenal gland (SBLA) syndrome | CDKN2A; CHEK2; MDM2; TP53 | TP53 (417) | Tumor protein p53 | P04637 | Tumor suppressor, gene regulation |
| Long chain 3-hydroxyacyl-CoA dehydrogenase deficiency (LCHAD) | HADHA | HADHA (35) | Hydroxyacyl-CoA dehydrogenase trifunctional multi-enzyme complex subunit alpha | P40939 | Enzyme |
| Lynch syndrome | 11 different genes linked to this disorder so far | MSH2 (34) | DNA mismatch repair protein Msh2 | P43246 | DNA repair, binds DNA, ATPase |
| Marfan syndrome | FBN1; TGFBR2 | FBN1 (1893) | Fibrillin 1 | P35555 | Structural protein, extracellular matrix |
| Maternal phenylketonuria/Phenylketonuric embryopathy | PAH | PAH (690) | Phenylalanine hydroxylase | P00439 | Enzyme |
| Medium chain acyl-CoA dehydrogenase deficiency (MCADD) | ACADM | ACADM (136) | Acyl-CoA dehydrogenase medium chain | P11310 | Enzyme |
| Mucolipidosis type III (ML3) alpha/beta | GNPTAB | GNPTAB (68) | N-acetylglucosamine 1 phosphate transferase, Subunits alpha and beta | Q3T906 | Enzyme |
| Mucopolysaccharidosis type 4A (MPS4A)/Morquio disease type A | GALNS | GALNS (269) | Galactosamine (N-acetyl)-6-sulfatase | P34059 | Enzyme |
| Multiple endocrine neoplasia type 2 | RET | RET (130) | Ret proto-oncogene receptor tyrosine kinase | P07949 | Receptor tyrosine kinase |
| Multiple epiphyseal dysplasia (MED) | COL2A1; COL9A1; COL9A2; COL9A3/collagen type IX alpha 3 chain; COMP; KIF7; MATN3; SLC26A2 | COMP (155) | Cartilage oligomeric matrix protein | P49747 | Structural protein |
| Neurofibromatosis type 1 (NF1)/Von Recklinghausen disease | NF1 | NF1 (1208) | Neurofibromin 1 | P21359 | Regulator of Ras GTPase activity |
| Oculocutaneous albinism (OCA) | LRMDA; MC1R; OCA2; SLC24A5; SLC45A2; TYR; TYRP1 | TYR (352) | Tyrosinase | P14679 | Enzyme |

-continued

| A<br>Genetic disease | B<br>Disease-associated genes | C<br>Most common of (B) | D<br>Encoded product of (C) | E<br>Accession No. of (C) | F<br>Type of product of (C) |
|---|---|---|---|---|---|
| Osteogenesis imperfecta/brittle bone disease | 15 different genes linked to this disorder, so far. | COL1A1 (547); COL1A2 (466) | Collagen type I alpha 1 chain, collagen type I alpha 2 chain | P02452, P08123 | Structural protein |
| Pendred syndrome (PDS)/Deafness with goiter | FOXI1; KCNJ10; SLC26A4 | SLC26A4 (404) | Solute carrier family 26 member 4 | O43511 | Membrane transporter |
| Phenylketonuria (PKU)/Phenylalanine hydroxylase deficiency (PAH deficiency) | PAH | PAH (690) | Phenylalanine hydroxylase | P00439 | Enzyme |
| Proximal spinal muscular atrophy (SMA) | NAIP; SMN1; SMN2 | SMN1 (47) | Survival motor neuron protein | Q16637 | RNA splicing |
| Retinitis Pigmentosa (RP) | 82 different genes linked to this disorder, so far. | RHO (204) | Rhodopsin | P08100 | G-protein coupled receptor |
| Recessive X-linked ichthyosis (XLI) | STS | STS (28) | Steroid sulfatase | P08842 | Enzyme |
| Retinoblastoma (RB bilateral (40% of cases) and unilateral (60% of cases-de novo mutation) | NMYC; RB1 | RB1 (292) | RB transcriptional corepressor 1 | P06400 | Tumor suppressor, cell cycle regulation |
| Rett syndrome | MECP2 | MECP2 (246) | Methyl-CpG binding protein 2 | P51608 | Binds to methylated DNA, gene regulation |
| Sickle cell anemia | HBB | HBB (433) | Hemoglobin subunit beta | P68871 | Oxygen carrier |
| Sotos syndrome/cerebral gigantism | APC2; NSD1; SETD2 | NSD1 (228) | Nuclear receptor binding SET domain protein 1 | Q96L73 | Enzyme |
| Stargardt disease/Fundus flavimaculatus | ABCA4; CNGB3; ELOVL4; PROM1; PRPH2 | ABCA4 (789) | ATP binding cassette subfamily A member 4 | P78363 | Membrane transporter |
| Stickler syndrome/hereditary progressive arthroophthalmopathy | COL11A1; COL2A1; COL11A2; COL9A1; COL9A2; COL9A3; LOXL3 | COL2A1 (335) | Collagen type II alpha 1 chain | P02458 | Structural protein |
| Supravalvular aortic stenosis (SVAS) | ELN | ELN (25) | Elastin | P15502 | Structural protien |
| β-Thalassemia | HBB | HBB (434) | Hemoglobin B chain | P68871 | Oxygen carrier |
| Tibial muscular dystrophy/Upp myopathy | TTN | TTN (53) | Titin | Q8WZ42 | Muscle protein |
| Tuberous sclerosis complex/Bourneville syndrome | TSC1; TSC2 | TSC2 (518) | Tuberin | P49815 | Tumor suppressor, Regulation of mTORC1 signaling |
| Von-Hippel Lindau disease | VHL | VHL (218) | Von Hippel-Lindau tumor suppressor | P40337 | Tumor suppressor, role in E3 ubiquitin ligase complex |
| Von Willebrand disease | VWF | VWF (636) | Von Willebrand factor | P04275 | Collagen binding, chaperone for coagulation factor VIII |
| X-linked adrenoleukodystrophy (ALD) | ABCD1 | ABCD1 (425) | ATP binding cassette subfamily D member 1 | P33897 | Membrane transporter |
| X-linked retinoschisis (XLRS) | RS1 | | | | |

Accordingly, to treat one or more such diseases or disorders, in various aspects of the invention, one or more targeted polynucleotide sequence related to certain diseases and disorders, e.g., a genetic mutation, is contacted by a Cas12a gene editing system disclosed herein; and a guide RNA, wherein the guide RNA comprises a complementary sequence to that of a targeted polynucleotide sequence.

In some embodiments, the guide RNA directs the Cas12a polypeptide to the target site or the targeted polynucleotide sequence; and optionally forms a ribonucleoprotein complex with the polypeptide and the guide RNA.

Additional therapeutic applications for the Cas12a genome editing systems disclosed herein include base editing, prime editing, gene insertions and/or deletions.

Diagnostic applications for the Cas12a genome editing system include probes, diagnostics, theranostics.

The Cas12a editing system comprising the heterologous nucleic acid sequence can be used in a variety of applications, several non-limiting examples of which are described herein. In general, the Cas12a editing system can be used in any suitable organism. In some embodiments, the organism is a eukaryote.

In some embodiments, the organism is an animal. In some embodiments, the animal is a fish, an amphibian, a reptile, a mammal, or a bird. In some embodiments, the animal is a farm animal or agriculture animal. Non-limiting examples of farm and agriculture animals include horses, goats, sheep, swine, cattle, llamas, alpacas, and birds, e.g., chickens, turkeys, ducks, and geese. In some embodiments, the animal is a non-human primate, e.g., baboons, capuchin monkeys, chimpanzees, lemurs, macaques, marmosets, tamarins, spider monkeys, squirrel monkeys, and vervet monkeys. In some embodiments, the animal is a pet. Non-limiting examples of pets include dogs, cats, horses, rabbits, ferrets, gerbils, hamsters, chinchillas, fancy rats, guinea pigs, *canaries*, parakeets, and parrots.

In some embodiments, the organism is a plant. Plants that may be transfected with an Cas12a editing system include monocots and dicots. Particular examples include, but are not limited to, corn (maize), sorghum, wheat, sunflower, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, macadamia, almond, oats, vegetables, ornamentals, and conifers. Vegetables include, but are not limited to, crucifers, peppers, tomatoes, lettuce, green beans, lima beans, peas, and members of the genus *Cucumis* such as cucumber, cantaloupe, and musk melon. Ornamentals include, but are not limited to, azalea, hydrangea, hibiscus, roses, tulips, daffodils, petunias, carnation, poinsettia, and chrysanthemum.

In some embodiments, heterologous nucleic acid sequences can be added to the subject Cas12a editing system to provide a cell with a heterologous nucleic acid encoding a protein or regulatory RNA of interest, a cellular barcode, a donor polynucleotide suitable for use in gene editing, e.g., by homology directed repair (HDR) or recombination-mediated genetic engineering (recombineering), or a CRISPR protospacer DNA sequence for use in molecular recording, as discussed further below. In embodiments relating to Cas12a retron-based gene editing systems, uch heterologous sequences may be inserted, for example, into the msr locus or the msd locus such that the heterologous sequence is transcribed by the retron reverse transcriptase as part of the msDNA product.

In some embodiments, the Cas12a editing systems described herein may be used for research tools, such as kits, functional genomics assays, and generating engineered cell lines and animal models for research and drug screening. The kit may comprise one or more reagents in addition to the Cas12a editing system, such as a buffer, a control reagent, a control vector, a control RNA polynucleotide, a reagent for in vitro production of the polypeptide from DNA, and adaptors for sequencing. A buffer can be, for example, a stabilization buffer, a reconstituting buffer, a diluting buffer, a wash buffer, or a buffer for introducing a polypeptide and/or polynucleotide of the kit into a cell. In some instances, a kit can comprise one or more additional reagents specific for plants. One or more additional reagents for plants can include, for example, soil, nutrients, plants, seeds, spores, *Agrobacterium*, a T-DNA vector, and a pBINAR vector.

Production of Protein or RNA

In some embodiments, the Cas12a (Cas Type V) gene editing systems may comprise one or more additional proteins (e.g., an accessory protein, such as a recombinase) or RNA molecules (e.g., a donor template), or a nucleotide sequence encoding the one or more additional proteins or RNA molecules.

In some embodiments, Cas12a gene editing systems may comprise a nucleic acid molecule encoding a polypeptide of interest. The polypeptide of interest may be any type of protein/peptide including, without limitation, an enzyme, an extracellular matrix protein, a receptor, transporter, ion channel, or other membrane protein, a hormone, a neuropeptide, an antibody, or a cytoskeletal protein, a functional fragment thereof, or a biologically active domain of interest. In some embodiments, the protein is a therapeutic protein, therapeutic antibody for use in treatment of a disease, or a template to fix a mutation or mutated exon in the genome. In other embodiments, the polypeptide of interest is a gene editing accessory protein, e.g., recombinases, invertases, nucleases, polymerases, ligases, deaminases, reverse transcriptases, or epigenetic modifying functions. The polypeptide of interest, e.g., recombinases, invertases, nucleases, polymerases, ligases, deaminases, reverse transcriptases, or epigenetic modifying functions, could be fused to the Cas12a gene editing system or a component thereof (e.g., fused to the Cas12a nuclease).

In other embodiments, the Cas12a gene editing system could also be engineered to include a DNA template.

In still other embodiments, the Cas12a gene editing system could also include a least one additional nucleic acid molecule for modulating a target in the cell, e.g., without limitation, a RNA interference (RNAi) nucleic acid or regulatory RNA such as, but not limited to, a microRNA (miRNA), a small interfering RNA (siRNA), a short hairpin RNA (shRNA), a small nuclear RNA (snRNA), a long non-coding RNA (lncRNA), an antisense nucleic acid, and the like.

Recombineering

Recombineering (recombination-mediated genetic engineering) can be used in modifying chromosomal as well as episomal replicons in cells, for example, to create gene replacements, gene knockouts, deletions, insertions, inversions, or point mutations. Recombineering can also be used to modify a plasmid or bacterial artificial chromosome (BAC), for example, to clone a gene or insert markers or tags.

The Cas12a (Cas Type V) editing systems described herein can be used in recombineering applications to provide linear single-stranded or double-stranded DNA for recombination. Homologous recombination may be mediated by bacteriophage proteins such as RecE/RecT from Rac prophage or Redobd from bacteriophage lambda. The linear DNA should have sufficient homology at the 5' and 3' ends to a target DNA molecule present in a cell (e.g., plasmid, BAC, or chromosome) to allow recombination.

The linear double-stranded or single-stranded DNA molecule used in recombineering (i.e. donor polynucleotide) comprises a sequence having the intended edit to be inserted flanked by two homology arms that target the linear DNA molecule to a target site for homologous recombination. Homology arms for recombineering typically range in length from 13-300 nucleotides, or 20 to 200 nucleotides, including any length within this range such as 13, 14, 15, 16, 17, 18, 19, 20, 22, 24, 26, 28, 30, 32, 34, 36, 38, 40, 42, 44, 46, 48, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, or 200 nucleotides in length. In some embodiments, a homology arm is at least 15, at least 20, at least 30, at least 40, or at least 50 or more nucleotides in length. Homology arms ranging from 40-50 nucleotides in length generally have sufficient targeting efficiency for recombination; however, longer homology arms ranging from 150 to 200 bases or more may further improve targeting efficiency. In some embodiments, the 5' homology arm and the 3' homology arm differ in length. For example, the linear DNA may have about 50 bases at the 5' end and about 20 bases at the 3' end with homology to the region to be targeted.

The bacteriophage homologous recombination proteins can be provided to a cell as proteins or by one or more vectors encoding the recombination proteins, such as the vector or vector system. In some embodiments, one or more vectors encoding the bacteriophage recombination proteins are included in the vector system comprising the Cas12a editing system msr gene, msd gene, and/or ret gene sequences. Additionally, a number of bacterial strains containing prophage recombination systems are available for recombineering, including, without limitation, DY380, containing a defective 1 prophage with recombination proteins exo, bet, and gam; EL250, derived from DY380, which in addition to the recombination genes found in DY380, also contains a tightly controlled arabinose-inducible flpe gene (flpe mediates recombination between two identical frt sites); EL350, also derived from DY380, which in addition to the recombination genes found in DY380, also contains a tightly controlled arabinose-inducible ere gene (ere mediates recombination between two identical loxP sites; SW102, derived from DY380, which is designed for BAC recombineering using a galK positive/negative selection; SW105, derived from EL250, which can also be used for galK positive/negative selection, but like EL250, contain an ara-inducible Flpe gene; and SW106, derived from EL350, which can be used for galK positive/negative selection, but like EL350, contains an ara-inducible Cre gene. Recombineering can be carried out by transfecting bacterial cells of such strains with an Cas12a editing system comprising a heterologous sequence encoding a linear DNA suitable for recombineering. For a discussion of recombineering systems and protocols, see, e.g., Sharan et al. (2009) Nat Protoc. 4(2): 206-223, Zhang et al. (1998) Nature Genetics 20: 123-128, Muyrers et al. (1999) Nucleic Acids Res. 27: 1555-1557, Yu et al. (2000) Proc. Natl. Acad. Sci U.S.A. 97 (11):5978-5983; herein incorporated by reference.

Molecular Recording

In some embodiments, the Cas12a (Cas Type V) editing system comprises a synthetic CRISPR protospacer DNA sequence to allow molecular recording. The endogenous CRISPR Cas1-Cas2 system is normally utilized by bacteria and archaea to keep track of foreign DNA sequences originating from viral infections by storing short sequences (i.e., protospacers) that confer sequence-specific resistance to invading viral nucleic acids within genome-based arrays. These arrays not only preserve the spacer sequences but also record the order in which the sequences are acquired, generating a temporal record of acquisition events.

This system can be adapted to record arbitrary DNA sequences into a genomic CRISPR array in the form of "synthetic protospacers" that are introduced into cells using Cas12a editing systems. Cas12a editing systems carrying the protospacer sequences can be used for integration of synthetic CRISPR protospacer sequences at a specific genomic locus by utilizing the CRISPR system Cas1-Cas2 complex. Molecular recording can be used to keep track of certain biological events by producing a stable genetic memory tracking code. See, e.g., Shipman et al. (2016) Science 353(6298): aafl 175 and International Patent Application Publication No. WO/2018/191525; herein incorporated by reference in their entireties.

In some embodiments, the CRISPR-Cas system is harnessed to record specific and arbitrary DNA sequences into a bacterial genome. The DNA sequences can be produced by an Cas12a editing system within the cell. For example, the Cas12a editing system can be used to produce the protospacers within the cell, which are inserted into a CRISPR array within the cell. The cell may be modified to include one or more engineered returns (or vector systems encoding them) that can produce one or more synthetic protospacers in the cell, wherein the synthetic protospacers are added to the CRISPR array. A record of defined sequences, recorded over many days, and in multiple modalities can be generated.

In some embodiments, the Cas12a editing system comprises an msd protospacer nucleic acid region or an msr protospacer nucleic acid region. In the case of a msr protospacer nucleic acid region, the protospacer sequence is first incorporated into the msr RNA, which is reverse transcribed into protospacer DNA. Double stranded protospacer DNA is produced when two complementary protospacer DNA sequences having complementary sequences hybridize, or when a double-stranded structure (such as a hairpin) is formed in a single stranded protospacer DNA (e.g., a single msDNA can form an appropriate hairpin structure to provide the double stranded DNA protospacer).

In some embodiments, a single stranded DNA produced in vivo from a first Cas12a editing system may be hybridized with a complementary single-stranded DNA produced in vivo from the same retron or a second Cas12a editing system or may form a hairpin structure and then used as a protospacer sequence to be inserted into a CRISPR array as a spacer sequence. The Cas12a editing system(s) should provide sufficient levels of the protospacer sequence within a cell for incorporation into the CRISPR array. The use of protospacers generated within the cell extends the in vivo molecular recording system from only capturing information known to a user, to capturing biological or environmental information that may be previously unknown to a user. For example, an msDNA protospacer sequence in an Cas12a editing system construct may be driven by a promoter that is downstream of a sensor pathway for a biological phenomenon or environmental toxin. The capture and storage of the protospacer sequence in the CRISPR array records the event. If multiple msDNA protospacers are driven by different promoters, the activity of those promoters is recorded (along with anything that may be upstream of the promoters) as well as the relative order of promoter activity (based on the relative position of spacer sequences in the CRISPR array). At any point after the recording has taken place, the CRISPR array may be sequenced to determine whether a given biological or environmental event has taken place and the order of multiple events, given by the presence and relative position of msDNA-derived spacers in the CRISPR array.

In some embodiments, the synthetic protospacer further comprises an AAG PAM sequence at its 5' end. Protospacers including the 5' AAG PAM are acquired by the CRISPR array with greater efficiency than those that do not include a PAM sequence.

In some embodiments, Cas1 and Cas2 are provided by a vector that expresses the Cas1 and Cas2 at a level sufficient to allow the synthetic protospacer sequences produced by Cas12a editing systems to be acquired by a CRISPR array in a cell. Such a vector system can be used to allow molecular recording in a cell that lacks endogenous Cas proteins.

Therapeutic Applications

Also provided herein are methods of diagnosing, prognosing, treating, and/or preventing a disease, state, or condition in or of a subject, using the Cas12a (Cas Type V) editing system of the invention.

Generally, the methods of diagnosing, prognosing, treating, and/or preventing a disease, state, or condition in or of a subject can include modifying a polynucleotide in a subject or cell thereof using a composition, system, or component thereof of the Cas12a editing system as described herein, and/or include detecting a diseased or healthy polynucleotide in a subject or cell thereof using a composition, system, or component thereof of the Cas12a editing system as described herein.

In some embodiments, the method of treatment or prevention can include using a composition, system, or component of the Cas12a editing system to modify a polynucleotide of an infectious organism (e.g. bacterial or virus) within a subject or cell thereof.

In some embodiments, the method of treatment or prevention can include using a composition, system, or component of the Cas12a editing system to modify a polynucleotide of an infectious organism or symbiotic organism within a subject.

In some embodiments, the composition, system, and components of the Cas12a editing system can be used to develop models of diseases, states, or conditions.

In some embodiments, the composition, system, and components of the Cas12a editing system can be used to detect a disease state or correction thereof, such as by a method of treatment or prevention described herein.

In some embodiments, the composition, system, and components of the Cas12a editing system can be used to screen and select cells that can be used, for example, as treatments or preventions described herein.

In some embodiments, the composition, system, and components thereof can be used to develop biologically active agents that can be used to modify one or more biologic functions or activities in a subject or a cell thereof.

In general, the method can include delivering a composition, system, and/or component of the Cas12a editing system to a subject or cell thereof, or to an infectious or symbiotic organism by a suitable delivery technique and/or composition. Once administered, the components can operate as described elsewhere herein to elicit a nucleic acid modification event. In some embodiments, the nucleic acid modification event can occur at the genomic, epigenomic, and/or transcriptomic level. DNA and/or RNA cleavage, gene activation, and/or gene deactivation can occur.

The composition, system, and components of the Cas12a editing system as described elsewhere herein can be used to treat and/or prevent a disease, such as a genetic and/or epigenetic disease, in a subject; to treat and/or prevent genetic infectious diseases in a subject, such as bacterial infections, viral infections, fungal infections, parasite infections, and combinations thereof, to modify the composition or profile of a microbiome in a subject, which can in turn modify the health status of the subject; to modify cells ex vivo, which can then be administered to the subject whereby the modified cells can treat or prevent a disease or symptom thereof, or to treat mitochondrial diseases, where the mitochondrial disease etiology involves a mutation in the mitochondrial DNA.

Also provided is a method of treating a subject, e.g., a subject in need thereof, comprising inducing gene editing by transforming the subject with the polynucleotide encoding one or more components of the composition, system, or complex or any of polynucleotides or vectors described herein of the Cas12a editing system, and administering them to the subject.

Also provided is a method of treating a subject, e.g., a subject in need thereof, comprising inducing transcriptional activation or repression of multiple target gene loci by transforming the subject with the polynucleotides or vectors described herein, wherein said polynucleotide or vector encodes or comprises one or more components of composition, system, complex or component of the Cas12a editing system, and comprising multiple Cas effectors.

Also provided is a method of treating a subject, e.g., a subject in need thereof, comprising inducing gene editing by transforming the subject with the Cas effector(s), and encoding and expressing in vivo the remaining portions of the composition, system, (e.g., RNA, guides), complex or component of the Cas12a editing system. A suitable repair template may also be provided by the Cas12a editing system as described herein elsewhere.

Also provided is a method of treating a subject, e.g., a subject in need thereof, comprising inducing transcriptional activation or repression by transforming the subject with the systems or compositions herein.

Also provided is a method of inducing one or more polynucleotide modifications in a eukaryotic or prokaryotic cell or component thereof (e.g. a mitochondria) of a subject, infectious organism, and/or organism of the microbiome of the subject. The modification can include the introduction, deletion, or substitution of one or more nucleotides at a target sequence of a polynucleotide of one or more cell(s). The modification can occur in vitro, ex vivo, in situ, or in vivo.

In some embodiments, the method of treating or inhibiting a condition or a disease caused by one or more mutations in a genomic locus in a eukaryotic organism or a non-human organism can include manipulation of a target sequence within a coding, non-coding or regulatory element of said genomic locus in a target sequence in a subject or a non-human subject in need thereof comprising modifying the subject or a non-human subject by manipulation of the target sequence and wherein the condition or disease is susceptible to treatment or inhibition by manipulation of the target sequence including providing treatment comprising delivering a composition comprising the particle delivery system or the delivery system or the virus particle of any one of the above embodiment or the cell of any one of the above embodiment.

Also provided herein is the use of any of the above delivery systems, e.g., LNP delivery system in ex vivo or in vivo gene or genome editing; or for use in in vitro, ex vivo or in vivo gene editing.

Also provided herein are particle delivery systems, non-viral delivery systems, and/or the virus particle of any one of the above embodiments or the cell of any one of the above embodiments used in the manufacture of a medicament for in vitro, ex vivo or in vivo gene or genome editing or for use in in vitro, ex vivo or in vivo gene therapy or for use in a method of modifying an organism or a non-human organism by manipulation of a target sequence in a genomic locus associated with a disease or in a method of treating or inhibiting a condition or disease caused by one or more mutations in a genomic locus in a eukaryotic organism or a non-human organism.

In some embodiments, target polynucleotide modification using the subject Cas12a editing system and the associated compositions, vectors, systems and methods comprise addition, deletion, or substitution of 1 nucleotide to about 10,000 nucleotides at each target sequence of said polynucleotide of said cell(s). The modification can include the addition, deletion, or substitution of at least 1, 5, 10, 11, 12, 13, 14, 15, 16, 17, 18, 19, 20, 21, 22, 23, 24, 25, 26, 27, 28, 29, 30, 35, 40, 45, 50, 75, 100, 200, 250, 300, 500, 1000, 1500, 2000, 2500, 3000, 3500, 4000, 5000, 6000, 7000, 8000, 9000, 10,000 or more nucleotides at each target sequence.

In some embodiments, formation of system or complex results in cleavage, nicking, and/or another modification of one or both strands in or near (e.g. within 1, 2, 3, 4, 5, 6, 7, 8, 9, 10, 20, 50, or more base pairs from) the target sequence.

In some embodiments, a method of modifying a target polynucleotide in a cell to treat or prevent a disease can include allowing a composition, system, or component of the subject Cas12a editing system to bind to the target polynucleotide, e.g., to effect cleavage, nicking, or other modification as the composition, system, is capable of said target polynucleotide, thereby modifying the target polynucleotide, wherein the composition, system, or component thereof, complex with a guide sequence, and hybridize said guide sequence to a target sequence within the target polynucleotide, wherein said guide sequence is optionally linked to a tracr mate sequence, which in turn can hybridize to a tracr sequence. In some embodiments, modification can include cleaving or nicking one or two strands at the location of the target sequence by one or more components of the composition, system, or component thereof.

In some embodiments, the Cas12a editing system and the associated compositions, systems, vectors, uses, and methods of use, can be used to treat diseases of the circulatory system. In some embodiments, the treatment can be carried out by using an AAV or a lentiviral vector to deliver the Cas12a editing system, composition, system, and/or vector described herein to modify hematopoietic stem cells (HSCs) or iPSCs in vivo or ex vivo. In some embodiments, the treatment can be carried out by correcting HSCs or iPSCs as to the disease using a composition, system, herein or a component thereof, wherein the composition, system, optionally includes a suitable HDR repair template (e.g., a template in the msDNA of the Cas12a editing system).

In some embodiments, the treatment or prevention for treating a circulatory system or blood disease can include modifying a human cord blood cell. In some embodiments, the treatment or prevention for treating a circulatory system or blood disease can include modifying a granulocyte colony-stimulating factor-mobilized peripheral blood cell (mPB) with any modification described herein. In some embodiments, the human cord blood cell or mPB can be CD34*. In some embodiments, the cord blood cells or mPB cells modified are autologous. In some embodiments, the cord blood cells or mPB cells are allogenic. In addition to the modification of the disease genes, allogenic cells can be further modified using the composition, system, described herein to reduce the immunogenicity of the cells when delivered to the recipient. The modified cord blood cells or mPB cells can be optionally expanded in vitro. The modified cord blood cell(s) or mPB cells can be derived to a subject in need thereof using any suitable delivery technique.

The composition and system may be engineered to target genetic locus or loci in HSCs. In some embodiments, the components of the systems can be codon-optimized for a eukaryotic cell and especially a mammalian cell, e.g., a human cell, for instance, HSC, or iPSC and sgRNA targeting a locus or loci in HSC, such as circulatory disease, can be prepared. These may be delivered via particles, such as the lipid nanoparticle delivery system described herein. The particles may be formed by the components of the systems herein being admixed.

In some embodiments, after ex vivo modification the HSCs or iPCS can be expanded prior to administration to the subject. Expansion of HSCs can be via any suitable method such as that described by, Lee, "Improved ex vivo expansion of adult hematopoietic stem cells by overcoming CUL4-mediated degradation of HOXB4." Blood. 2013 May 16; 121(20):4082-9. doi: 10.1182/blood-2012-09-455204. Epub 2013 Mar. 21.

In some embodiments, the HSCs or iPSCs modified are autologous. In some embodiments, the HSCs or iPSCs are allogenic. In addition to the modification of the disease genes, allogenic cells can be further modified using the composition, system, described herein to reduce the immunogenicity of the cells when delivered to the recipient.

In some embodiments, the Cas12a editing system and the associated compositions, systems, vectors, uses, and methods of use, can be used to treat neurological diseases. In some embodiments, the neurological diseases comprise diseases of the brain and CNS.

Delivery options for the diseases in the brain include encapsulation of the systems in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors or vector systems of the invention. In other embodiments, an artificial virus can be generated for CNS and/or brain delivery.

In some embodiments, the Cas12a editing system and the associated compositions, systems, vectors, uses, and methods of use, can be used to treat hearing diseases or hearing loss in one or both ears. Deafness is often caused by lost or damaged hair cells that cannot relay signals to auditory neurons. In some embodiments, the composition, system, or modified cells can be delivered to one or both ears for treating or preventing hearing disease or loss by any suitable method or technique known in the art, such as US20120328580 (e.g., auricular administration), by intratympanic injection (e.g., into the middle ear), and/or injections into the outer, middle, and/or inner ear; administration in situ, via a catheter or pump (U.S. 2006/0030837) and Jacobsen (U.S. Pat. No. 7,206,639). Also see US20120328580. Cells resulting from such methods can then be transplanted or implanted into a patient in need of such treatment.

In some embodiments, the Cas12a editing system and the associated compositions, systems, vectors, uses, and methods of use, can be used to treat diseases in non-dividing cells. Exemplary non-dividing cells include muscle cells or neurons. In such cells, homologous recombination (HR) is generally suppressed in the G1 cell-cycle phase, but can be turned back on using art-recognized methods, such as Orthwein et al. (Nature. 2015 Dec. 17; 528(7582): 422-426).

In some embodiments, the Cas12a editing system and the associated compositions, systems, vectors, uses, and methods of use, can be used to treat diseases of the eye.

In some embodiments, the Cas12a editing system and the associated compositions, systems, vectors, uses, and methods of use, can be used to treat muscle diseases and cardiovascular diseases.

In some embodiments, the Cas12a editing system and the associated compositions, systems, vectors, uses, and methods of use, can be used to treat diseases of the liver and kidney.

In some embodiments, the Cas12a editing system and the associated compositions, systems, vectors, uses, and methods of use, can be used to treat epithelial and lung diseases.

In some embodiments, the Cas12a editing system and the associated compositions, systems, vectors, uses, and methods of use, can be used to treat diseases of the skin.

In some embodiments, the Cas12a editing system and the associated compositions, systems, vectors, uses, and methods of use, can be used to treat cancer.

In some embodiments, the Cas12a editing system and the associated compositions, systems, vectors, uses, and methods of use, can be used in adoptive cell therapy.

In some embodiments, the Cas12a editing system and the associated compositions, systems, vectors, uses, and methods of use, can be used to treat infectious diseases.

In some embodiments, the Cas12a editing system and the associated compositions, systems, vectors, uses, and methods of use, can be used to treat mitochondrial diseases.

In some embodiments, the Cas12a editing system and the associated compositions, systems, vectors, uses, and methods of use, can be used to treat hemoglobinopathies. The hemoglobinopathies are a group of disorders passed down through families in which there is abnormal production or structure of the hemoglobin molecule. Sickle cell disease (SCD) is one such blood disorder caused by the abnormal hemoglobin that damages and deforms red blood cells. The abnormal red cells break down, causing anemia, and obstruct blood vessels, leading to recurrent episodes of severe pain and multi-organ ischemic damage. SCD affects millions of people throughout the world and is particularly common among people whose ancestors come from sub-Saharan Africa, regions in the Western Hemisphere (South America, the Caribbean, and Central America); Saudi Arabia; India; and Mediterranean countries such as Turkey, Greece and Italy. There is no widely available cure for SCD although some children have been successfully treated with blood stem cell, or bone marrow, transplants. However, hematopoietic stem cell transplant is not widely done for SCD, because of the difficulty in finding a matched donor. Therefore, the number of people with SCD who get transplants is low. In addition, there are several complications associated with the procedure, including death in about 5 percent of people. In SCD, clinical severity varies, ranging from mild and sometimes asymptomatic states to severe symptoms requiring hospitalization. Symptomatic treatments exist, and newborn screening (NBS) for SCD can reduce the burden of the disease on affected newborns and children.

Thalassemia is another type of blood disorder that is caused by a defect in the gene that helps control the production of the globin chains that make up the hemoglobin molecule. There are two main types of thalassemia: (a) Alpha thalassemia occurs when a gene or genes related to the alpha globin protein are missing or changed (mutated). Alpha thalassemias occur most often in persons from Southeast Asia, the Middle East, China and in those of African descent. (b) Beta thalassemia occurs when a beta globin gene is changed (mutated) so as to affect production of the beta globin protein. Beta thalassemias occur most often in persons of Mediterranean origin. To a lesser extent, Chinese, other Asians and African Americans can be affected.

The Cas12a editing system may be used to target a correction in the defective gene that causes the hemoglobinopathy.

All publications, published patent documents, and patent applications cited herein are hereby incorporated by reference to the same extent as though each individual publication, published patent document, or patent application was specifically and individually indicated as being incorporated by reference.

K. Sequences

The following sequences form part of the specification.

| SEQ ID NO: | Description |
| --- | --- |
| 1-565 | Type V nucleases and associated sequences |
| 1-19 | Group 1 Type V nucleases |
| 20-31 | Group 2 Type V nucleases |
| 32-44 | Group 3 Type V nucleases |
| 45-56 | Group 4 Type V nucleases |
| 57-72 | Group 5 Type V nucleases |
| 76-99 | Group 6 Type V nucleases |
| 100-117 | Group 7 Type V nucleases |
| 118-130 | Group 8 Type V nucleases |
| 131-330 | Group 9 Type V nucleases |
| 331-367 | Group 10 Type V nucleases |
| 368-385 | Group 11 Type V nucleases |
| 386-398 | Group 12 Type V nucleases |
| 399-435 | Group 13 Type V nucleases |
| 436-565 | Group 14 Type V nucleases |
| Selected sequences from 1-565 | Group 15 Type V nucleases |
| 608-638 | Primers - Table Ex. 9.1. Primers used in PAM sample preparation for Illumina sequencing |
| 639-648 | Primers - Table Ex. 10.1 - Primer sequences used for target amplification in T7 Endonuclease I assay |
| 649-665 | Primers - Table Ex. 12.1. - Custom primers used for primary PCR of genomic DNA deep sequencing sample preparation |
| 666-677 | Table Ex. 12.2. Custom primers used for primary PCR of genomic DNA deep sequencing sample preparation |
| 678-692 | Table Ex.12.3. Target sequences in HEK293T cells in Example 12 |
| 693-707 | Table Ex. 12.4. crRNA sequences used in Example 12 |
| 708-722 | Table Ex.12.5. Full cassette sequences used in Example 12 |
| 723-742 | Table S13.2. crRNA sequences for mutant Cas12a nucleases of Table S13.1 |
| 743-747 | Table S13.3. Sequences of synthetic Cas9 sgRNAs used for RNA transfections as a part of SpyCas9 |
| 748-757 | Table S13.4. Primer sequences used for target amplification in T7 Endonuclease I assay. |
| 758-792 | Table S1: crRNA for PAM determination: |
| 793-968 | Table S2: Target sequences HEK293T |
| 969-1145 | Table S3: crRNA cassette sequences HEK293T |
| 1146-1322 | Table S4: crRNA sequences HEK293T |
| 1323-1332 | Table S5: Primer sequences T7 Endo I |
| 1333-1337 | Table S6: Amplicon sequences |
| 1338-1366 | Table X - Exemplary nucleotide sequences of 5' UTRs |
| 1367-1381 | Table Y - Additional stop elements of linear mRNA |
| 1385 | LbCas12a amino acid sequence |
| 1386-1402 | Highly conserved amino acid regions of LbCas12a based on alignment with all Cas12a orthologs of Table S15A (see FIG. 31 for alignment) |

In various embodiments, the (Cas Type V) polypeptide is a polypeptide selected from any one of the polypeptide sequences listed in any of Groups 1-15, or a polypeptide having at least 70%, 75%, 80%, 85, 90%, 95%, 99%, or 1000 sequence identity with a polypeptide from any one of the polypeptide sequences listed in any of Groups 1-15. In various other embodiments, the (Cas Type V) polypeptide is encoded by a polynucleotide sequence selected from any one of Tables S1B-S15A, or a polynucleotide having at least 70%, 75%, 80%, 85%, 90%, 95%, 99%, or 100% sequence identity with a polynucleotide of any one of Tables S1B-S15A. In various other embodiments, the Cas12a (Cas Type V) guide RNA is selected from any Cas12a (Cas Type V) guide sequence disclosed in the following tables, including Table S15C, or a nucleic acid molecule having at least 70%, 75%, 0%, 85%, 90%, 95%, 99%, or 100% sequence identity with a Cas12a (Cas Type V) guide sequence of any of the following relevant tables, including Table S15C.

A. Group 1 Type V Nuclease and Associated Sequences (SEQ ID Nos: 1-19)

TABLE S1A

| Enzyme Sequences Group 1 | |
|---|---|
| SEQ ID NO | Sequence |
| 1 | MEELMTNFSDFTGLFSLSKTLRFELKPVGKTKETFKQWLENMNSTNEEGNLLAKDKKIKDAYLALKPVM<br>NSLHEQFIEMSLLSGKAKEIDFSKYYEAYKEKNVSSKLEEELRAKIGETYEIAGNYFYKEISNVLGKEIKPKK<br>DKPYECLTDAKMLKYLSAKVQELAEQNGVDEQTLKGHLEQFKGFWGYLDGYNQNRENYYEYEKEAST<br>AVATRIVHENLPTFCSNVLRFENRKDEYLGIYQYLKDKNRETKIKNSKGEEVDAKAISESVFQIKHFNECLT<br>QPQIEEYNRIIGNYNLLINLYNQARREEAGFKKIDEFETLYKQIGCGKKKSMFETLQNDSDVKDLLQNAK<br>NAGDVMFKNTLPAFIRFLKECDNWDGIYMSSAAVNKISNQYFANWHSIKDKLKDAKANACITYDKNR<br>EEQIKLRDAVELSGLFAVLDTEHSEHFFKDSLFKDNETNEYRGILDKDLPPSKNLINLLCFDIERNIKAFLQE<br>SDRIAALEKYKDENIQAGEEDQTIKKIKEWFDAATDAMRIVRYFAVRKSKMKGNLPNVTMEQALSNLL<br>YNDDVQWFKWYDLVRNYFTKKPQDDAKENKLKLNFGKGTLLNGFVDSHSDSDNGTQYGGYIFRKKH<br>EKCNEYEYFLGVSKNAQLFRCHLKNEVPSNDKSAFERLEYYQMKSTTPYPNDYGNKKEEIIDVVRKLAED<br>NEELVEWIDKKNEDKKLTPTELFKRLENTNDPILKNKELLNKVDETISIIKSNLKNFTRINAINDLQNDDQN<br>HGGIDGFKKLVDELKKITAATKLFDFFPVSSSEFNAHNGEDLFLFKISNKDLSYCETFAEGKRKEKTNQKE<br>NLHTLIFRALMREDLFGDIVDIGKGEVFLREKVREYDYDDSVRKYGHHYNDLKDRFTYPIISNKRFSEDKIL<br>LHLSVILNYKSDNKKNVGVEINDALQQSDNLQFIGIDRGEKHLVYSCTIDKNAKIIKCNHHDNINGTDYV<br>KKLEDVADERIIAKKNWQAQNKIKDLKTGYISHVVHRLVEETIKDGEKIAPHAYIVLEDLNTEMKRGRQK<br>IEKQIYQNLETALAKKLNFVVDKDAKEGELGSVSKALQLTPPISNYQDIEGKKQFGVMLYTRANYTSVTD<br>PATGWRKTIYIKNGKEEDIMNQIFKEFSDFGFDGKDYYFEYTEANAGHTWRLYSGKDGKPLPRFQNKK<br>QIQQDKNIWVPEQINVVKILDEIFADFDKAKSFKTQIEEGIELKKAGGRTETAWQSLRYALELIQQIRNSG<br>EKDSKDDNFLYSPVRNENGEHFDTRHPEKNGDLSKIVDADANGAYNIARKGLIMDAHIKHWIESGRPK<br>TKKDGKEKSDLDLFISDKEWDLWLLDREQWKKDLPAFASLSAKDDADKSKAGRGRKKQ |
| 2 | MEQFTNLFQLSKTLKFELKPIGKTEETFKQWLEEIQKSELDVYNDSNLFLKDKKIKDAYLAIKPIMDKLHE<br>QFIEESLTSDLAKNIDFSEYYEAFRNKTVKDEMETKLRKVFAETYQYAGKLFIDMISKAQKNGKEIKTKKE<br>KPYECLTDSKILNFLSANVKELAKLTDANEQELTNHIKQFRGFWGYLDGFNTNRENYYVTEKEQSTAVA<br>TRIVHENLPTFCSNALRFEKRREEYLGIYQYLKDNNRETKIKNSQEEIEAESIDVSYFEIEHFNECLAQSQI<br>DEYNRVISHYNLLINLYNQARREESQFKKIDEFEILYKQIGCGKKQSMFEILQSDNDVRNLLQKVRRAGDI<br>MFKKGHSEGEIDNVYDFIQFLKECDNWEGIYMSNAAINKISNLYFANWHSIKDKLKESKANACITYDKK<br>REEPIKLRDAVELSGLFEVLDQEQPEHILKESLFKDEATNEYRGVLKKELSPSKNIIMLLCYDIERNTKAFLD<br>SSDSIVAIEKFKDKKQFVGEEDQTIKQVKDWLDAATDAMRIVRYFAVRKSKMKGNLPNVTMEQALSNL<br>LHNEDAQWFKWYDLIRNYLTKKPQDDAKENKLKLNFGTSSLLGGWSDGQEKTKAATLLRNNNALYLCI<br>LKTKNVFDTSKDNNPIYNVSQSNASRLILRNLKFQTLAGKGFLGEYGISYGEMGKNDSTKAISCLQKIIKT<br>RYVDKYPLLEKFVTNYTYTDKREFDAEILETLKECYVCEFKPIDWTFVIEKQNAGELFLFKISSKDYLPNAKG<br>RKDLQTMYWEDVLSDGSKHQLCAGAEIFMREPVAKESPVMHRIGSKLVNRRDKDGNTIPEHIYREIYSY<br>VNGKMSVVSAKAQKYIDDKRVIVKDVKHEIVKDKRFYGETKYMFHCPIKLYFEAKDPKYAFSEVNKTITD<br>SLQQQSPNLQFIGIDRGEKHLVYSCTVDTNCKIIRCNHHDFINGTDYVQKLDAVANDRIIAKKNWQAQSK<br>IKDLKSGYISHVVHRLVDETIKDGNVIAPHAYIVLEDLNTEMKRGRQKIEKQVYQNLEVALAKKLNFVVD<br>KNAKHGELGSVSMALQLTPPINNYQDIEGKKQFGVMLYTRANYTSVTDPATGWRKTIYIKNGKEEDIRK<br>QILEAFRDFGFDGRDYYFEYTEANVGHTWRMYSGNNGKPLPRFRNRKQIFQDKNVWVSEQINVVEIL<br>DRLFVKFDKKKSFKEQIEQGKELEKVEWRDESAWQSFRFALDLIQQIRNSGTEDNDDNFLYAPVRNDH<br>GEHFDTRNHKNNGELSEIRDADANGAYNIARKGLIMDAHIKRWIEIGCPTVSEDKAPDLDLFISDLEWD<br>LWLLDRERWEKELPIFASRSAKKKEDKQQTRGKKQ |
| 3 | MKEFTNLYQLSKTLRFELKPIGKTAKTFQRWLEEMNKAELVGDNDGNLFLKDKKIKNAYLAIKPIMDKL<br>HEQLIEMALLSKEAKQIDFSEYFEAYKNKAVRVEMENGLRKAFAKPFQYAGLYFVEEISKSQKNGKEIKT<br>KKDKQYECLTDAKMYNYLSAHVRDLAEQNGIDEQKLKKHIEQFKGFWGYLDGYNQNRENYYEVDKEA<br>STAVATRIVHENLPTFCSNAMRFEKRKDEYLCIHRYLKDNSRETKIKNTKGEEIDVEAISDNIFQIKHFNEC<br>LAQSQIEEYNRIIGNYNMLINLYNQLRRGEKDFKKIDEFEKLKKQIGCGKKKSMFETLQGDSDVKKLLLKA<br>SEAGKQMFKDVADFSEIKTVPDFIEFLRECDNWDGIYMSKTAIDKISSLYFANWHSIKDKLKEAKADACI<br>TYEKKREEPIKLRDAVELSGLFAVLDSEQSEHFFKDSLFKDDDTNDYRGVLNKTLTPSKNLIQLLCFDIERN<br>TNAFLSKSNNIVKLEKYKDENDQAGEEDQTIRKIKEWFDAATDAMRIVRYFSVRKSKMKGNIPNATIEQ<br>ALSNLLYNDDAQWFKWYDLIRNYLTKKPQDDAKENKLKLNFGTSSLLGGWSDGQEKTKVATLLKYHDE<br>IYLCVLKTKNIFDTSKDNNPIYDITESEASRLLLRNLKFQTLAGKGFLGEYEISYGDMGKENPTKAIKCLQKII<br>KERYVNKYPLLEKFARNTYTDKAQFDAEITETLKECYVCQFVPIDWNVVTEKQDNEELFLFKILCKDYRPK<br>SVGKKDLQTMYWEDVLSDGSKHQLCAGAEIFMREPVAKESPIIHRIGSKFVNKRDKDGTIPEQIYREIY<br>SYANGKKKTISAESRKYIDEQKVIIKDVKHKIIKDNRFYGETKYMFHCPIKLQFEAKDPKYAYSEVNTTVSN<br>ALQQSDNLQFIGIDRGEKHLVYSCIVDKDCKILKCGHHDVINGTDYVQKLEAVADERIVAKKNWQQQN<br>KIRDLKNGYISHVVHRLVEETIKDNGIAPHAYIVLEDLNTEMKRGRQKIEKQVYQNLETALAKKLNFVV<br>DKDTKKGEIGSVSKALQLTPPINNYQDIEGKKQFGVMLYTRANYTSVTDPATGWRKTIYIKNGKEDDIK<br>NQILDKFSDFGFDGDYYFEYTEANVGHTWRLYSGKNGKALPRFQNKKQALQDKNVWVPEKINVVDIL<br>NKLFAKFDKKKSFKSQIEAGVELQKDEERNETAWQSLRFALDLIQQIRNSGEKNSGDDNFLYSPVRNDK<br>DEHFDTRNYKNNGELSEIRDADANGAYNIARKGLIMDTHIKHWINNGRPKTKIDGSEVSDLDLFISDRE<br>WDLWLLDREQWMKELPTFASKIAKYDSDAPQTAKRRKKR |

TABLE S1B

Human Codon Optimized Nucleotide Sequences Group 1

| SEQ ID NO | Corresponding AA | Sequence |
|---|---|---|
| 4 | 1 | ATGGAGGAACTCATGACGAATTTTTCTGATTTCACAGGCCTCTTTTCTCTGTCTAAGACCCTGA
GATTCGAATTAAAGCCAGTCGGGAAAACTAAGGAGACTTTTAAGCAGTGGTTGGAGAACAT
GAACTCTACAAACGAGGAGGGCAACCTGCTGGCCAAAGACAAGAAAATTAAGGATGCGTAC
CTGGCCCTGAAACCAGTTATGAATAGCTTGCACGAACAGTTTATTGAGATGAGTCTACTGTCC
GGCAAGGCAAAGGAGATTGACTTCAGTAAATACTACGAGGCCTACAAGGAGAAAAATGTGA
GCAGCAAACTCGAAGAAGAGTTGCGTGCCAAAATTGGAGAAACATACGAAATCGCAGGGAA
CTACTTCTACAAAGAGATCTCCAATGTTCTTGGCAAGGAAATCAAACCTAAGAAAGACAAGC
CCTATGAGTGCCTCACTGATGCTAAAATGCTGAAATATTTGTCAGCGAAGGTGCAAGAATTA
GCAGAGCAGAACGGTGTGGACGAACAAACACTTAAGGGACATCTGGAGCAATTTAAGGGGT
TTTGGGGGTACCTGGACGGGTACAACCAGAATAGAGAAACTACTACGAGTACGAGAAAGA
GGCTTCCACTGCAGTGGCCACCCGAATCGTGCATGAAAATCTGCCCACATTTTGTAGTAACGT
TCTGCGCTTCGAAAACCGAAAAGACGAGTATCTAGGCATATATCAGTACTTGAAGGACAAGA
ATCGGGAAACCAAGATTAAAAACTCAAAGGGGGAAGAAGTTGACGCTAAGGCAATATCGGA
GTCAGTCTTTCAGATTAAGCACTTCAACGAATGTTTAACCCAACCCAAATCGAAGAGTATAA
CAGAATCATCGGCAACTACAATCTCCTGATCAACCTGTATAACCAGGCCCGTAGGGAAGAGG
CCGGTTTCAAGAAAATCGACGAGTTCGAGACATTGTATAAACAGATCGGCTGTGGCAAAAAA
AAATCAATGTTCGAGACACTTCAGAACGACAGTGACGTGAAAGACTTGCTGCAGAATGCCAA
GAATGCTGGTGACGTTATGTTTAAAAATACACTTCCGGCCTTCATCAGATTCTTGAAGGAGTG
TGATAATTGGGATGGCATATACATGAGCTCCGCCGCCGTGAATAAGATCAGCAACCAGTATT
TTGCAAACTGGCACAGTATCAAGGATAAGTTGAAGGATGCTAAAGCCAATGCCTGTATCACC
TACGATAAAAACAGGGAAGAACAAATCAAACTGCGGGATGCTGTAGAGCTATCTGGGCTGT
TCGCTGTGTTGGACACCGAACACTCCGAACACTTCTTTAAGGACTCACTGTTCAAAGACAATG
AGACGAACGAGTATAGGGGCATTCTCGACAAAGACTTGCCACCTAGCAAAAATCTGATCAAC
CTTCTATGCTTCGATATTGAGAGGAATATAAAAGCCTTCCTCCAGGAATCAGATCGGATCGCT
GCTTTGGAGAAGTACAAAGACGAGAATATCCAGGCTGGAGAGGAGGATCAGACCATCAAAA
AAATCAAGGAATGGTTCGATGCAGCGACAGACGCCATGAGGATTGTACGCTATTTTGCCGTC
CGGAAATCAAAAATGAAGGGTAACCTGCCAAATGTGACCATGGAGCAGGCTCTGAGCAACT
TACTGTACAACGATGATGTGCAGTGGTTCAAGTGGTACGACTTGGTCAGGAATTATTTTACA
AAGAAGCCTCAGGACGATGCCAAAGAGAATAAGCTTAAACTCAATTTTGGCAAGGGTACCCT
ATTAAATGGCTTCGTGGATTCCCATAGCGATAGTGATAATGGAACTCAGTACGGGGGTTACA
TATTCCGTAAAAAACACGAGAAATGCAACGAATACGAATATTTCTTAGGGGTATCCAAGAAC
GCGCAACTCTTCAGATGCCATCTGAAGAACGAGGTCCCTAGCAATGACAAATCAGCCTTCGA
GCGCCTTGAATACTATCAGATGAAATCCACTACACCCTATCCAAATGATTACGGGAATAAAAA
GGAAGAGATCATTGACGTGGTTAGAAAACTGGCCGAGGATAATGAGGAACTGGTGGAATG
GATCGACAAAAAGAATGAGGACAAAAAGCTTACTCCCACTGAGCTCTTCAAGCGGCTTGAGA
CACCAACGACCCAATTCTGAAGAATAAGGAACTGCTCAACAAGGTGGACGAAACCATATCC
ATCATCAAGTCTAATCTCAAGAATTTTACCCGGATCAACGCTATTAACGATTTACAGAATGAC
GACCAGAATCACGGTGGTATTGATGGTTTTAAAAAGCTCGTCGACGAACTAAAGAAGATTAC
TGCAGCCACCAAGCTTTTCGATTTTTTCCCTGTGTCGTCTAGTGAATTTAATGCGCACAATGG
GGAAGACCTGTTTCTCTTCAAGATTTCAAACAAGGATCTCAGCTACTGTGAAACATTTGCGGA
GGGCAAGCGCAAGAAAAAACCAATCAAAAGGAGAACCTCCATACCCTGATCTTCAGAGCG
CTGATGAGAGAGGACCTGTTTGGAGATATTGTCGACATCGGAAAGGGCGAGGTTTTTCTCCG
AGAGAAGGTGCGGGAGTACGACTATGACGATAGCGTGCGCAAATATGGGCATCATTACAAC
GACCTGAAGGATAGGTTTACATACCCCATTATTTCAAACAAACGATTCTCTGAGGATAAGATT
CTCCTACACCTGTCTGTCATTTTGAACTACAAGTCCGATAACAAGAAAAACGTGGGGGTCGA
AATAAACGACGCCCTGCAGCAATCCGACAATTTGCAATTCATTGGAATTGACCGCGGGGAGA
AGCACCTGGTTTATAGCTGCACCATCGATAAGAATGCCAAATCATAAAGTGCAACCATCAC
GATAACATCAACGGAACAGACTATGTCAAGAAACTGGAGGACGTGGCTGACGAACGAATTA
TTGCCAAAAAGAATTGGCAAGCTCAAAACAAGATTAAGGACCTGAAGACCGGATACATTAGC
CACGTAGTACATCGCCTGGTGGAAAGACGATCAAAGATGGAGAAAAAATAGCTCCTCACG
CATATATAGTGCTTGAGGATCTCAACACAGAGATGAAAAGGGGCCGGCAGAAGATCGAGAA
ACAGATTTACCAAAATCTGGAAACTGCTCTTGCAAAAAAGCTCAATTTCGTAGTTGATAAGGA
TGCCAAGGAAGGCGAGCTCGGCAGCGTGTCCAAAGCCCTTCAGCTTACTCCCCCTATAAGCA
ATTATCAGGATATCGAGGGAAAGAAACAGTTCGGAGTGATGCTATATACCCGGGCAAACTA
CACCTCGGTCACTGACCCGGCTACTGGCTGGAGGAAGACCATCTATATTAAGAATGGCAAAG
AGGAGGACATCATGAACCAGATCTTCAAAGAGTTTTCCGATTTTGGCTTTGACGAAAGGAT
TACTATTTTGAGTATACGGAAGCAAACGCCGGTCACACGTGGAGCTTTACAGCGGCAAGGA
CGGCAAGCCCTTACCCCGCTTTCAGAACAAGAAGCAGATACAGCAGGACAAGAACATTTGG
GTCCCGGAACAGATCAATGTTGTGAAGATTCTCGACGAGATATTCGCCGACTTCGATAAGGC
TAAGTCGTTCAAAACCCAGATCGAAGAGGGGATTGAACTGAAGAAGGCAGGAGGGAGAAC
TGAAACGGCTTGGCAGTCCCTGCGATATGCGCTGGAGCTGATACAGCAGATCCGCAATTCTG
GAGAAAAAGACAGTAAGGATGATAACTTTCTCTATTCACCAGTCCGTAATGAGAACGGTGAA
CACTTTGACACAAGACATCCAGAGAAGAACGGGGATCTCTCTAAAATTGTGGATGCAGATGC
CAATGGGGCCTATAACATCGCACGCAAGGGACTGATTATGAACGCGCTCATATCAACACTGGA
TCGAATCTGGCAGGCCTAAGACTAAGAAAGATGGAAAGGAGAAAAGTGATCTGGACTTGTT
CATAAGCGACAAGGAGTGGGACCTGTGGTTACTTGATCGGGAGCAGTGGAAGAAGGACCT
GCCTGCCTTTGCTTCCCTGTCTGCAAAAGACGATGCAGATAAAAGTAAAGCCGGCAGGGGAC
GGAAAAAGCAATGA |

TABLE S1C

Direct Repeat Group 1

| SEQ ID NO | Direct Repeat (Variant #1) | SEQ ID NO | Direct Repeat (Variant #2) |
|---|---|---|---|
| 7 | CTGCTAAACCGCTAAAATTTCTACTATTGTAGAT | 8 | GGCTGCTAAACCGCTAAAATTTCTACTATTGTAGAT |
| 9 | ATCTACGATAGTAGAAATTATAATGGCTTTATAGCC | 10 | ATCTACGATAGTAGAAATTATAA |
| 11 | GTCTATAGGACTCAAATAATTTCTACTATTGTAGAT | 12 | GTCTATAGGACTCAAATAATTTCTACTATTGTAGAT |

TABLE S1D crRNA Sequences Group 1

Figure 1B:
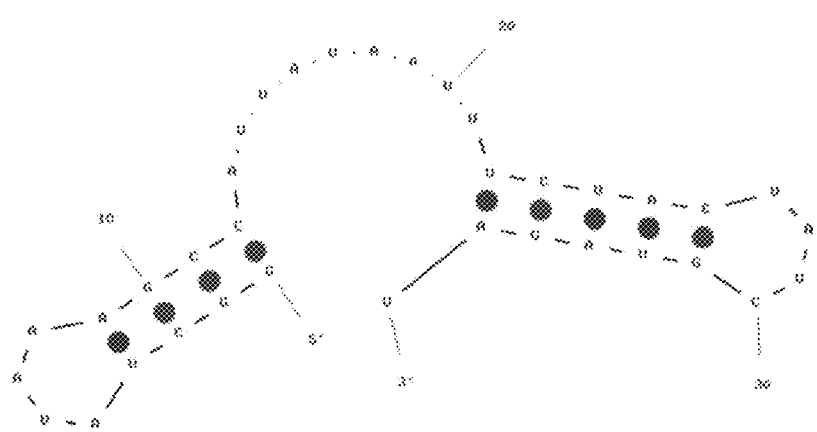
Figure 1C:
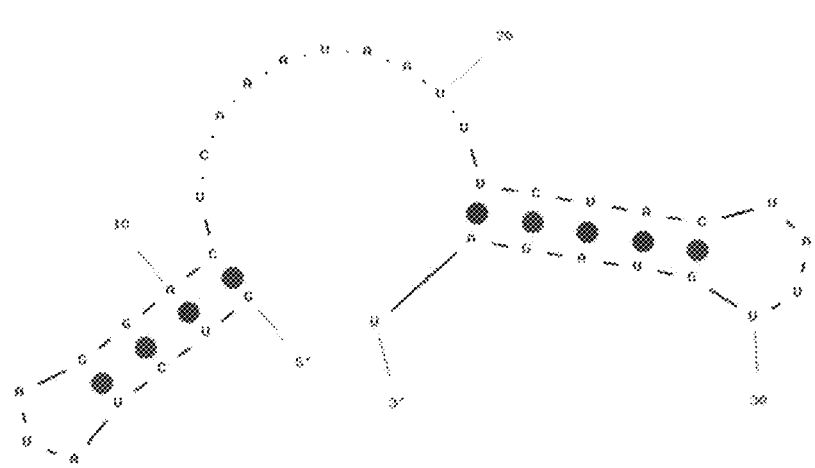

| SEQ ID NO | Sequence | FIG | Name |
|---|---|---|---|
| 13 | GGCUGCUAAACCGCUAAAAUUUCUACUAUUGUAGAU | FIG. 1A | MGYG000290766_951_gen |
| 14 | GGCUAUAAAGCCAUUAUAAUUUCUACUAUCGUAGAU | FIG. 1B | CADAJV010000039.1_18 |
| 15 | GUCUAUAGGACUCAAAUAAUUUCUACUAUUGUAGAU | FIG. 1C | MGYG000293160_375_gen |

TABLE S1E

Consensus Sequence Group 1

| SEQ ID NO | Consensus Sequence (of SEQ ID Nos: 1-3) |
|---|---|
| 16 | MEELMTNMXXFTNLFQLSKTLRFELKPIGKTXETFKQWLEEMNKXELXXXNDGNLFLKDKKIKDAYLAIKPIMDKL HEQFIEMSLLSXXAKXIDFSEYYEAYKNKXVXXEMEXXLRKXFAETYQYAGXYFXXEISKXQKNGKEIKTKKDKPYEC LTDAKMLNYLSAXVXELAEQNGXDEQXLKXHIEQFKGFWGYLDGYNQNRENYYEXEKEASTAVATRIVHENLPT FCSNALRFEKRKDEYLGIYQYLKDNNRETKIKNSKGEEIDAEAISXSXFQIKHFNECLAQSQIEEYNRIIGNYNLLINLY NQARREEXXFKKIDEFEXLYKQIGCGKKKSMFETLQXDSDVKXLLQKAXXAGDXMFKXXXXXXEIXTVPDFIXFLKE CDNWDGIYMSXAAINKISNLYFANWHSIKDKLKEAKANACITYDKKREEPIKLRDAVELSGLFAVLDXEQSEHFFK DSLFKDXXTNEYRGVLXKXLXPSKNLIXLLCFDIERNTKAFLXXSDXIVALEKYKDENXQAGEEDQTIKKIKEWFDAA TDAMRIVRYFAVRKSKMKGNLPNVTMEQALSNLLYNDDAQWFKWYDLIRNYLTKKPQDDAKENKLKLNFGTSS LLGGWSDGQEKTKXATZZZZZZLLRZZZZZZZNXXEXYLCVLKTKNXFDTSKDNNPIYXXXXSNASRLXLRNLKFQTLA GKGFLGEYGISYGEMGKZZZZZZEDXTKAIXCLQKIIKXRYVXKYPLLEKFZZXXNTYTDKXEFDAEIXETLKZZECYVC XFXPIDWZZXXVXEKQNXGELFLFKILXKDYXPXXXGXKDLQTMYWEDVLSDGSKHQLCAGAEIFMREPVAKESP XXHRIGSKXVNXRDKDGXTIPEXIYRZZZZZZZZZZZZZZZZZZZEIYSYXNGKXXXXSAXXRKYIDXXXVIXKDVKHXIIKD KRFYGETKYMFHCPIKLXFEAKDPKYAXSEVNXTIXDALQQSDNLQFIGIDRGEKHLVYSCTVDKNCKIIKCNHHDX INGTDYVQKLEAVADERIIAKKNWQAQNKIKDLKXGYISHVVHRLVEETIKDGXKIAPHAYIVLEDLNTEMKRGRQ KIEKQVYQNLETALAKKLNFVVDKDAKXGELGSVSKALQLTPPINNYQDIEGKKQFGVMLYTRANYTSVTDPATG WRKTIYIKNGKEEDIXNQILXXFSDFGFDGXDYYFEYTEANVGHTWRLYSGKNGKPLPRFQNKKQIXQDKNVWV PEQINVVXILDXLFAKFDKKKSFKXQIEXGXELXKXEXRXETAWQSLRFALDLIQQIRNSGEKDSXDDNFLYSPVRN DXGEHFDTRNXKNNGELSEIRDADANGAYNIARKGLIMDAHIKHWIEXGRPKTKXDGXEXSDLDLFISDXEWDL WLLDREQWXKELPXFASXSAKXDXDKXQTXXRRKKQ |

Wherein:
each X is independently selected from any naturally occurring amino acid; and
each Z is independently selected from absent and any naturally occurring amino acid.

TABLE S1F

Native Nucleotide sequences Group 1

| SEQ ID NO | Corresponding AA | Sequence |
|---|---|---|
| 17 | 1 | ATGGAGGAGTTGATGACAAATTTTTCTGATTTCACGGGGCTTTTTTCGCTTAGCAAGACTCTCAGG<br>TTTGAACTTAAACCTGTTGGGAAAACTAAAGAAACCTTTAAGCAATGGCTTGAAAATATGAATAGC<br>ACCAATGAGGAAGGCAACTTGTTGGCAAAGGATAAGAAAATCAAAGATGCCTATTTAGCATTAAA<br>GCCAGTAATGAATAGTCTGCATGAGCAGTTTATTGAAATGTCTTTGCTCTCTGGTAAAGCGAAGGA<br>AATCGATTTCTCGAAATACTATGAAGCATACAAAGAAAAAAACGTTTCAAGCAAGCTTGAGGAAG<br>AATTACGCGCAAAAATTGGTGAAACCTATGAGATTGCTGGGAATTATTTTTATAAAGAAATAAGCA<br>ATGTTCTTGGCAAAGAAATCAAACCAAAGAAAGATAAGCCATACGAATGCCTTACTGATGCTAAA<br>ATGCTCAAGTACTTATCAGCCAAAGTACAGGAATTGGCTGAACAAAACGGCGTAGACGAACAAAC<br>CCTTAAAGGTCATCTTGAACAATTCAAAGGATTTTGGGGATATTTGGACGGATATAACCAGAATCG<br>TGAGAATTATTATGAATATGAGAAAGAGGCTTCAACCGCTGTTGCTACACGTATTGTCCACGAAAA<br>TCTACCCACATTTTGCAGCAATGTTTTGCGTTTTGAGAATCGCAAGGACGAGTATCTCGGCATTTAC<br>CAGTATTTGAAAGATAAGAACCGCGAAACAAAGATTAAAAATTCAAAAGGCGAAGAAGTTGACG<br>CAAAAGCAATTTCTGAAAGTGTTTTTCAAATCAAGCATTTTAACGAATGCCTTACGCAGCCGCAAA<br>TTGAAGAGTACAACCGAATTATTGGCAATTACAATTTGCTAATCAACCTATACAATCAGGCACGAC<br>GAGAGGAAGCAGGTTTCAAGAAGATAGACGAGTTTGAAACCTTATACAAACAAATTGGTTGCGGT<br>AAAAAGAAATCGATGTTTGAAACGTTGCAAAACGACAGTGATGTAAAAGATCTTCTGCAAAATGC<br>TAAAAATGCAGGCGATGTAATGTTTAAAAATACCCTGCCGGCATTTATCCGGTTTTTGAAAGAGTG<br>CGATAACTGGGACGGCATTTATATGTCAAGTGCCGCCGTCAATAAAATATCAAACCAGTACTTTGC<br>TAATTGGCACAGTATCAAGGATAAATTAAAAGACGCAAAAGCAAACGCATGCATCACATACGATA<br>AAAACAGGGAAGAGCAAATAAAACTGCGTGATGCTGTGGAATTGTCGGGATTGTTCGCTGTGTTG<br>GATACAGAACATTCGGAACACTTTTTCAAAGACTCGCTTTTCAAGGATAACGAAACCAACGAGTAT<br>CGTGGCATTTTGGATAAAGATCTTCCGCCAAGCAAAAATCTCATCAATTTGTTGTGCTTTGATATTG<br>AGCGCAACATAAAGGCATTTCTGCAAGAATCTGATAGGATTGCCGCATTGGAAAAATACAAAGAC<br>GAAAACATTCAGGCAGGTGAAGAAGACCAGACGATAAAGAAAATAAAAGAGTGGTTTGATGCAG<br>CAACCGATGCTATGCGTATTGTGCGCTATTTTGCTGTGCGTAAAAGCAAGATGAAAGGCAACTTGC<br>CAAATGTGACGATGGAACAGGCATTGAGCAACTTGCTATACAACGATGATGTCCAGTGGTTCAAG<br>TGGTATGACCTTGTTCGCAACTATTTTACCAAGAAACCTCAAGACGATGCAAAAGAAAATAAATTG<br>AAGTTGAATTTTGGAAAAGGAACATTGTTAAATGGATTTGTTGATTCTCATAGTGATTCGGATAAT<br>GGTACGCAATATGGTGGCTATATTTTTAGAAAGAAACATGAAAAGTGCAATGAATATGAATATTTC<br>TTGGGTGTCAGTAAAAATGCGCAACTGTTTAGATGTCATTTGAAAAATGAAGTTCCTTCCAATGAT<br>AAAAGTGCTTTTGAGCGTTTGGAGTATTACCAAATGAAATCAACGACACCGTATCCAAATGACTAT<br>GGTAACAAAAAAGAGGAAATTATAGATGTTGTGAGAAAATTAGCCGAAGATAATGAAGAATTGG<br>TAGAGTGGATTGATAAGAAAAATGAAGACAAGAAATTAACACCAACAGAGTTGTTTAAGAGATTG<br>GAGAATACAAATGATCCTATATTGAAAAATAAGAACTATTAAACAAGGTAGATGAGACCATTTCT<br>ATAATCAAATCTAATCTCAAAAACTTTACACGTATTAATGCGATTAATGACCTTCAAAACGATGACC<br>AGAACCATGGTGGCATAGACGGTTTTAAGAAGCTGGTAGATGAATTAAAGAAAATTACTGCAGCA<br>ACTAAACTGTTTGATTTCTTTCCTGTCAGCTCAAGTGAGTTTAATGCTCACAATGGAAGAGATTTGT<br>TTTTGTTTAAAATATCAAACAAGATTTGTCATACTGCGAAACATTTGCAGAAGGAAAAGAAAAG<br>AAAAAACAAATCAAAAGAAAATCTACATACATTAATTTTTAGAGCTTTGATGCGTGAAGATTTAT<br>TTGGTGATATTGTCGATATTGGGAAAGGAGAGTCTTTTTACGGTGAAAAGGTCAGAGAATATGAT<br>TACGATGATAGTGTACGAAAGTATGGACATCACTACAATGATTTAAAGGACAGATTTACTTATCCC<br>ATTATTTCAAACAAGCGTTTTTCAGAAGATAAAATTCTTTTACATTTGTCAGTAATATTGAATTATAA<br>GTCTGATAATAAGAAAAACGTAGGAGTAGAAATTAACGACGCTCTCCAACAATCCGACAACCTAC<br>AATTTATCGGCATTGATCGTGGCGAAAAGCACCTTGTGTATAGCTGCACGATAGATAAGAATGCTA<br>AGATCATAAAATGCAACCACCACGATAATATCAATGGAACTGACTATGTGAAAAAGTTAGAGGAT<br>GTTGCCGACGAGCGTATTATTGCCAAAAAGAATTGGCAGGCACAGAACAAAATCAAGGATTTGAA<br>GACCGGCTATATATCACATGTTGTGCATCGTTTGGTGGAAGAAACCATCAAAGACGGCGAGAAAA<br>TTGCCCCGCACGCTTACATCGTTTTGGAAGATTTAAACACCGAGATGAAGCGCGGTCGCCAAAGA<br>ATTGAAAAGCAGATTTATCAAAACCTGGGAACAGCGCTCGCAAAGAAACTCAATTTTGTTGTGGAT<br>AAAGACGCTAAGGAGGGCGAACTTGGCTCTGTGAGCAAGGCTTTGCAACTTACGCCGCCAATCAG<br>CAACTATCAAGATATTGAGGGCAAGAAACAATTCGGTGTAATGCTTTATACGAGAGCAAATTATAC<br>TTCTGTTACTGATCCGGCAACAGGATGGCGCAAAACCATTTATATAAAAAATGGCAAGGAAGAAG<br>ACATTATGAACCAGATATTTAAGGAATTCAGTGATTTTGGTTTTGACGGAAAAGACTATTACTTTG<br>AATACACCGAAGCCAATGCAGGGCACACTTGGCGTTTGTATTCCGGCAAAGATGGCAAACCGCTA<br>CCTCGTTTCCAAAACAAGAAGCAAATACAGCAGGACAAGAATATTTGGGTGCCTGAGCAAATAAA<br>TGTGGTAAAAATCCTTGATGAAATTTTTGCTGATTTTGATAAAGCGAAGTCGTTTAAAACACAGAT<br>TGAAGAAGGTATTGAATTAAAAAAGGCTGGTGGACGAACCGAAACGGCTTGGCAATCGCTTCGAT<br>ATGCGCTTGAATTGATTCAGCAAATCCGCAATTCAGGTGAAAAGGATTCCAAAGACGACAACTTCT<br>TATATTCCCCCGTCCGCAACGAAAACGGTGAACACTTTGACACGCGCCATCCAGAAAAGAATGGC<br>GACTTGTCCAAAATCGTAGATGCCGATGCCAATGGCGCATACAACATCGCTCGCAAAGGCTTGATT<br>ATGGATGCGCACATCAAGCATTGGATTGAAAGCGGACGGCCAAAAACGAAAAAAGACGGAAAAG<br>AAAAATCTGATTTAGATTTGTTTATTTCTGATAAAGAGTGGGATTTGTGGCTTTTGGATAGAGAGC<br>AATGGAAAAAGATTTGCCTGCATTTGCCTCTCTAAGCGCAAAGGATGATGCTGATAAATCCAAA<br>GCAGGAAGAGGAAGAAAAAAACAATAA |
| 18 | 2 | ATGGAACAATTTACAAATCTTTTTCAGTTATCAAAAACATTGAAGTTTGAATTGAAACCCATTGGTA<br>AAACGGAAGAAACTTTTAAACAGTGGCTGGAGGAAATTCAAAAATCTGAATTAGATGTTTATAAT<br>GATAGCAACTTGTTTCTGAAAGATAAGAAAATCAAAGATGCCTATTTGGCTATTAAGCCGATTATG<br>GACAAGTTGCATGAACAGTTTATTGAAGATGTCTTTGACGTCTGATTTGGCCAAAAATATCGATTTC<br>TCGGAATACTATGAAGCTTTTAGAAATAAGACTGTAAAGGATGAGATGGAAACGAAATTGCGAA<br>GGTTTTTGCCGAGACCTACCAATATGCAGGCAAACTTTTTATAGATATGATTTCTAAAGCCCAAA<br>AAACGGCAAAGAAATCAAGACTAAAAGGAAAAACCATACGAGTGCCTTACCGATTCTAAAATAC<br>TTAACTTTTTATCTGCAAACGTAAAGGAATTGGCAAAACTTACAGATGCTAATGAGCAAGAACTGA<br>CTAATCATATAAAGCAGTTCCGTGGTTTTTGGGGATATTTAGATGGTTTCAATACAAACAGGGAAA |

TABLE S1F-continued

Native Nucleotide sequences Group 1

| SEQ ID NO | Corresponding AA | Sequence |
|---|---|---|
| | | ACTATTATGTAACAGAGAAAGAGCAGTCTACAGCTGTTGCCACTCGTATTGTCCATGAAAACTTGC<br>CCACATTCTGCAGCAATGCTTTACGTTTTGAAAAGCGCAGGGAAGAGTATCTCGGTATTTATCAGT<br>ATCTAAAAGATAATAACCGCGAGACCAAAATTAAGAACTCGCAGGGCGAAGAGATAGAAGCGGA<br>GTCCATTGACGTAAGTTATTTCGAAATAGAGCATTTTAATGAATGCCTTGCACAGTCTCAAATAGAT<br>GAGTATAATCGTGTCATCAGCCATTATAACCTATTGATTAATCTTTACAATCAGGCACGTCGCGAA<br>GAATCGCAATTTAAAAAGATTGACGAATTCGAAATCCTCTATAAGCAAATTGGTTGTGGCAAAAA<br>GCAATCAATGTTTGAAATCTTACAAAGTGACAATGATGTGAGAAATTTATTACAAAAAGTAAGACG<br>TGCTGGTGATATAATGTTTAAAAAAGGCCATAGTGAAGGCGAAATAGATAATGTCTACGATTTTAT<br>CCAATTCTTGAAAGAATGTGATAATTGGGAAGGAATCTATATGTCAAATGCTGCTATTAATAAGAT<br>TTCAAATTTATACTTTGCCAATTGGCACAGCATAAAAGACAAATTAAAGGAGTCAAAGGCAAATGC<br>ATGTATTACATACGACAAAAACGTGAAGAGCCAATCAAATTACGTGATGCCGTGGAGTTGTCTG<br>GCTTGTTTGAAGTGCTGGATCAGGAACAGCCAGAACACATTCTCAAAGAATCGCTTTTCAAAGATG<br>AGGCCACTAATGAGTATCGTGGTGTTTTGAAAAAGGAACTTTCTCCGAGTAAGAATATCATAATGC<br>TATTGTGCTATGATATTGAACGTAATACAAAGGCTTTTTTGGATTCTTCAGATAGCATTGTTGCAAT<br>AGAAAAGTTTAAAGACAAGAAACAGTTTGTAGGGAAGAAGACCAAACGATAAAACAAGTAAAA<br>GATTGGCTTGATGCGGCAACAGACGCTATGCGTATAGTTCGTTATTTTGCTGTGCGTAAAAGTAAA<br>ATGAAGGGGAACTTACCAAATGTAACGATGGAACAAGCGTTGAGCAACCTTCTACATAATGAAGA<br>TGCACAATGGTTTAAATGGTATGACCTTATCCGTAACTATCTTACCAAGAAGCCGCAAGATGATGC<br>AAAAGAGAACAAACTAAAGCTTAATTTTGGCACTTCTTCTTTACTTGGCGGCTGGAGTGACGGACA<br>GGAGAAAACAAAAGCTGCTACTTTATTGAGGAATAATAATGCCTTATATCTATGTATATTAAAAAC<br>GAAAAACGTTTTTGACACGTCAAAGGATAATAATCCCATTTATAATGTTTCACAATCAAATGCAAG<br>TCGCTTGATTTTAAGAAATCTCAAATTTCAGACACTTGCAGGGAAAGGCTTTTTAGGTGAGTATGG<br>TATTTCTTATGGAGAGATGGGGAAAAATGATTCTACCAAAGCAATTAGTTGTTTACAAAAAATCAT<br>AAAAACGCGATATGTGGATAAATATCCTTTACTGGAGAAATTTGTAACAAACACATATACAGATAA<br>GCGTGAATTCGATGCTGAGATTCTCGAGACATTGAAAGAATGTTATGTCTGCGAGTTCAAACCAAT<br>AGATTGGACTTTTGTCATTGAAAAACAAATGCCGGTGAGTTGTTTTGTTTAAAATATCTAGTAA<br>AGATTACTTACCAAACGCTAAGGGTAGAAAAGATTTGCAGACAATGTATTGGGAAGATGTGTTGT<br>CTGATGGTAGTAAACATCAATTGTGCGCAGGTGCCGAAATCTTTATGCGCGAGCCAGTCCGCCAAA<br>GAGTCACCCAGTGATGCATAGAATAGGATCAAAACTCGTAAACAGGAGAGACAAAGACGGAAACA<br>CTATTCCAGAGCATATATATAGAGAAATTTATTCTTATGTTAATGGCAAAATGAGTGTCGTTTCAGC<br>TAAAGCCCAAAAGTATATAGATGACAAAAGAGTGATTGTCAAGGATGTAAAGCATGAAATTGTCA<br>AAGACAAGCGCTTTTATGGTGAAACGAAATATATGTTCCATTGTCCAATTAAGTTGTATTTTGAGG<br>CAAAAGATCCCAAATATGCATTCTCGGAAGTTAATAAAACAATAACAGATTCGCTTCAACAGTCCC<br>CCAATTTGCAATTTATAGGCATAGATCGTGGCGAAAAGCACCTTGTATATAGTTGTACGGTTGATA<br>CGAATTGTAAAATCATCAGATGTAACCATCATGATTTTATCAATGGGACCGACTATGTGCAGAAAT<br>TGGATGCAGTTGCTAATGATCGCATCATTGCTAAAAAGAATTGGCAAGCCCAGAGTAAAATTAAG<br>GATTTGAAAAGTGGTTATATATCGCATGTGGTACATCGTTTAGTGGATGAAACCATAAAAGACGG<br>TAACGTAATTGCCCCACACGCGTATATTGTCTTGGAAGACCTGAACACGGAAATGAAGCGAGGCC<br>GCCAAAAGATAGAAAAGCAAGTCTACCAAAATTTGGAAGTTGCCCTTGCCAAGAAATTAAATTTTG<br>TAGTAGATAAAAACGCCAAGCATGGAGAACTAGGTTCAGTGAGCATGGCATTGCAGCTTACGCCG<br>CCAATCAACAACTACCAAGATATTGAGGGTAAAAAACAATTTGGAGTAATGCTTTACACACGAGCC<br>AATTACACATCGGTGACCGATCCTGCAACAGGATGGCGTAAAACCATCTATATAAAGAATGGAAA<br>AGAAGAAGATATAAGAAAACAAATTCTCGAAGCATTTCGCGACTTTGGCTTTGACGGCAGGGATT<br>ATTACTTTGAATATACTGAAGCCAATGTGGGGCAATTTGGCGTATGTATTCTGGCAATAATGGTA<br>AACCTCTACCTCGCTTCCGGAACAGAAAACAGATATTCCAGGACAAGAATGTATGGGTATCAGAG<br>CAAATTAATGTAGTGGAGATCCTCGACAGGCTGTTTGTCAAATTCGATAAAAAGAAATCTTTCAAG<br>GAGCAGATAGAACAGGGCAAAGAACTTGAAAAGGTAGAATGGCGAGACGAGTCCGCTTGGCAAT<br>CTTTTCGATTTGCGCTTGATTTGATTCAGCAAATTCGCAATTCTGGTACGGAAGACAACGATGATA<br>ATTTCTTGTATGCTCCAGTGCGCAACGACCACGGCGAACACTTTGACACACGCAATCATAAGAATA<br>ATGGCGAATTATCTGAAATCAGAGATGCTGATGCTAATGGAGCATACAATATTGCTCGCAAAGGA<br>TTGATAATGGATGCTCATATTAAGCGTTGGATTGAAATCGGCTGTCCCACAGTGAGTGAAGATAA<br>AGCGCCAGATTTAGATTTATTTATCTCAGATTTGGAATGGGATTTGTGGCTTCGGATAGAGAACG<br>TTGGGAAAAAGAACTACCCATCTTCGCATCACGGAGTGCAAAGAAGAAAGAAGATAAACAGCAA<br>ACGAGAGGGAAAAACAATAA |
| 19 | 3 | ATGAAAGAATTTACGAACCTGTATCAGTTATCAAAAACTCTGAGATTTGAACTGAAGCCTATTGGC<br>AAGACCGCAAAAACCTTTCAAAGATGGCTTGAGGAAATGAATAAAGCCGAACTTGTTGGTGATAA<br>TGATGGCAACTTATTTTTGAAGGACAAGAAAATTAAGAATGCCTATTTGGCTATTAAACCAATAAT<br>GGACAAACTGCATGAGCAGCTTATAGAGATGGCTTTGCTTTCTAAAGAAGCAAAACAAATTGATTT<br>TTCGGAATATTTTGAAGCATATAAGAATAAAGCCGTAAGGGTTGAAATGGAAATGGCTTGCGGA<br>AAGCATTCGCAAAACCATTTCAATATGCAGGCCTATACTTTGTCGAAGAGATTTCTAAATCCCAAA<br>AGAATGGGAAGAGATCAAGACTAAAAAAGATAAGCAATACGAATGTCTCACCGATGCGAAGAT<br>GTATAATTATCTATCAGCACATGTCAGGGATTTAGCTGAACAGAACGGTATTGATGAACAAAAACT<br>TAAGAAACATATTGAACAATTCAAAGGCTTTTGGGGGTATTTGGATGGGTACAACCAAAATAGGG<br>AGAATTATTATGAGGTTGACAAAGAGGCTTCAACCGCTGTTGCCACACGTATTGTTCATGAAAACT<br>TACCCACTTTCTGTAGCAATGCTATGCGTTTTGAAAAGCGCAAGGATGAATATCTCTGTATTCATCG<br>ATATTTGAAAGATAATAGCCGTGAAACGAAGATTAAAAACACGAAAGGCGAAGAGATTGATGTA<br>GAAGCGATTTCCGATAATATTTTTCAAATAAAGCATTTTAACGAATGCCTTGCTCAGTCACAAATTG<br>AAGAGTACAACCGCATTATTGGCAATTACAATATGCTGATTAATTTATACAATCAGTTGCGACGTG<br>GCGAAAAGGATTTTAAGAAAATTGACGAATTTGAAAAATTAAAAAAGCAAATTGGTTGCGGCAAA<br>AAGAAATCAATGTTTGAGACATTGCAGGGGATAGCGATGTGAAAAAACTTCTGCTAAAAGCAAG<br>TGAAGCAGGAAAACAGATGTTTAAGGATGTCGCTGATTTCTCAGAAATTAAAACGGTGCCAGATT<br>TTATTGAATTCTTGAGAGAATGCGATAATTGGGATGGCATTTATATGTCGAAAACAGCGATTGACA<br>AAATATCTAGCTTGTATTTTGCCAACTGGCACAGCATCAAGGATAAATTAAAAGAAGCTAAAGCG |

TABLE S1F-continued

Native Nucleotide sequences Group 1

| SEQ ID NO | Corresponding AA | Sequence |
|---|---|---|
| | | GATGCCTGTATCACATACGAAAAGAAACGTGAAGAACCTATAAAATTACGTGATGCAGTGGAATT
GTCTGGGTTGTTTGCCGTGTTGGATTCTGAGCAATCTGAACATTTTTTCAAAGATTCGTTATTCAAA
GATGATGATACCAACGACTATCGTGGTGTTTTGAATAAAACTCTTACGCCAAGCAAGAACCTCATC
CAATTGCTGTGTTTTGATATTGAGAGAAATACGAATGCATTTCTATCTAAATCTAATAACATTGTTA
AATTAGAAAAGTATAAGGACGAAAACGATCAGGCTGGTGAAGAAGACCAAACGATTAGGAAAAT
AAAAGAATGGTTTGATGCGGCAACCGATGCTATGCGTATTGTGCGCTATTTCTCCGTGCGCAAAA
GCAAAATGAAAGGTAATATTCCAAATGCCACAATAGAACAGGCGTTGAGCAATCTGTTATACAAC
GATGATGCACAGTGGTTTAAGTGGTATGACCTCATCCGCAATTATCTAACCAAGAAACCGCAAGAC
GATGCAAAGAAAACAAGTTGAAGTTGAATTTTGGGACTTCGTCTTTACTAGGTGGTTGGAGTGA
TGGACAAGAAAAAACAAAGTCGCCACCTTATTAAAGTACCATGATGAAATATATTTATGTGTATT
GAAGACCAAGAATATTTTTGATACATCAAAGGATAATAATCCGATTTATGACATAACGGAATCAGA
AGCAAGTCGCCTGTTATTAAGAAACCTGAAGTTCCAAACTCTTGCAGGAAAAGGCTTTTTGGGAG
AATATGAAATTTCATATGGCGATATGGGGAAAGAAAATCCAACCAAAGCAATTAAGTGTTTACAG
AAAATAATTAAAGAACGATACGTAAACAAATATCCCTTATTGGAGAAATTTGCAAGAAATACCTAT
ACAGACAAAGCTCAATTCGATGCAGAAATTACAGAAACATTAAAAGAATGTTATGTCTGTCAATTT
GTTCCAATAGATTGGAATGTTGTTACTGAAAAACAAGATAATGAGGAATTATTCTTGTTCAAAATA
CTCTGCAAGGATTATAGGCCGAAAAGCGTTGGAAGAAAGATCTACAAACAATGTATTGGGAGG
ACGTGTTGTCAGATGGAAGCAAACATCAATTGTGTGCTGGTGCCGAAATATTTATGCGTGAACCA
GTAGCAAAGGAATCACCAATTATACATAGAATCGGTTCTAAGTTTGTAAACAAACGAGACAAAGA
CGGCGATACTATTCCAGAACAGATTTATAGAGAAATATATTCGTATGCCAATGGTAAGAAGAAAA
CAATATCCGCTGAATCTAGAAAGTATATTGATGAACAAAAGGTGATAATTAAAGATGTGAAGCAC
AAAATCATTAAGGATAATCGGTTTTATGGTGAAACAAAATACATGTTCCATTGCCCAATTAAATTG
CAATTTGAAGCTAAAGATCCTAAATACGCTTATTCGGAAGTAAACACAACCGTCAGCAACGCACTT
CAGCAATCTGACAACCTACAATTTATCGGCATAGACCGTGGTGAAAAGCATCTTGTTTATAGTTGT
ATAGTTGACAAGGATTGCAAGATACTAAAGTGTGGTCATCACGACGTTATCAATGGAACGGACTA
TGTTCAAAAATTAGAGGCTGTTGCCGACGAACGCATTGTTGCCAAAAAGAATTGGCAACAGCAGA
ACAAAATCAGAGATCTGAAAAACGGCTATATATCGCATGTGGTACATCGCTTGGTAGAGGAGACA
ATAAAAGATAACGGAAAAATAGCTCCACACGCATACATTGTTTTGGAAGACCTGAATACAGAAAT
GAAACGTGGTCGCCAAAAGATTGAGAAACAGGTTTATCAAACCTGGAAACAGCGCTTGCAAAAA
AACTCAATTTTGTAGTGGATAAAGATACTAAGAAAGGTGAAATAGGATCTGTAAGTAAGGCATTA
CAACTTACGCCCCTATCAATAACTACCAAGACATTGAAGGTAAGAAACAATTTGGCGTAATGCTA
TATACTCGAGCCAATTATACGTCAGTCACCGACCCCGCAACAGGTTGGCGCAAAACCATCTACATT
AAGAATGGCAAAGAAGATGATATTAAAAATCAGATTCTTGACAAATTCAGCGACTTTGGCTTTGAT
GGAGATTATTATTTTGAATACACAGAAGCCAATGTGGGACACACTTGGCGTTTGTATTCTGGTAAA
AATGGCAAAGCATTGCCACGTTTCCAAAACAAAAGCAAGCGCTTCAAGATAAAAATGTTTGGGT
GCCAGAAAAGATCAATGTAGTTGATATCCTCAATAAGCTTTTTGCGAAGTTTGACAAGAAGAAATC
CTTTAAATCACAAATTGAAGCTGGAGTTGAATTACAAAAAGATGAGGAACGTAATGAAACAGCTT
GGCAATCGTTACGCTTTGCACTTGATTTGATTCAGCAAATCCGTAATTCGGGTGAGAAGAATTCCG
GAGATGATAATTTCTTGTACTCTCCTGTCCGCAACGATAAAGACGAACACTTTGACACGCGTAATT
ATAAAAATAATGGCGAACTATCAGAAATCAGAGATGCCGATGCAAACGGTGCATACAACATTGCT
CGCAAGGGCTTAATTATGGATACACACATAAAGCATTGGATTAATAATGGGCGACCCAAAACGAA
AATTGATGGCAGCGAAGTCTCTGATTTGGATTTGTTTATTTCCGATAGAGAGTGGGATTTGTGGCT
TTTAGATAGAGAACAATGGATGAAAGAATTGCCCACATTCGCTTCGAAAATTGCAAAATACGACA
GCGACGCCCCTCAAACTGCAAAAAGAAGAAAGAAGAGATAA |

B. Group 2 Type V Nuclease and Associated Sequences
(SEQ ID Nos: 20-31)

TABLE S2A

Enzyme sequences Group 2

| SEQ ID NO | Sequence |
|---|---|
| 20
ID415 | MEMRLMVVFEDFTKQYQVSKTLRFELIPQGKTLENMERAGIVKGDCQRSEDYQEAKKIIDKIYKHILNSSMAK
VEIDWSTLAEATKEFRKNKDKKKYENVQVRVRKKLLEDIKNQTITVEKGAKDLYKAMFEKEIVTGEVCAAFPEID
LTDEEKAILDKFKKFTTYFTGFFENRKNIFTDEGISTSFTYRLVNDNFIKFYDNCNLYKDIIASVPGLKGEFKKCFKD
LQLFSKCRLEEIFETSFYNHILTQDGIDEFNQLLGGISAKEGEKKKQGLNEVINLAMQKDEGIRNKLRYRAHKFTP
LFKQILNDRSTLSFIPETFENDRKVLESIEAYKLYLSEQNILEKAQELLCSMNRYDSRKLSIDGKYISKLSQAIFNSWS
KIHDGIKDYKKSLLPKETKKALKGIDMELKQGVSVQDILDALPEENFHEVIVDYTHNLVQKCQAVLSGSLPGNIE
TDKDKTDIKLVMDPLLDLYRFLEIFSHDNSQGVKTAFEEQLMEILADMKEIIPLYNKVRNFATKKAYSVEKFKLNF
NVATLASGWDQNKENANCAIILRKKDMYYLGIYNSSNQPFFEIVEQDDDGFEKMIYKQFPDFNKMLPKCTVS
RKNDVAVHFNKSDADFLLNVNTFSKPLLITKEVYDLGTKTVQGKKKFQIDYKRNTGDEAGYKAALKAWIDFGK
EFIKAYESTAIYDISLLRKSEDYPDIQSFYKDVDNICYKIAFQKISDEAVNQCVENGSLYLFKLHAKDFSPGASGKP
NLHTLYWKYVFEEENLKDVVVKLNGQAELFYRPRSLTQPVVHHKKGEKILNKTTRSGEPVPDDVYVELSHFIKNG
STGNLSNEAKKWQAKVSVRNVPHEITKDRRFTQDKFFFHVPLTLNYKSANTPRRFNDLVKAYIKKNPDVHVIGI
DRGERNLIYAVVIDGKGIVEQRSFNIVGGYNYQEKLWQKENERQAARRDWTAVTTIKDLKQGYLSAVVHELS
KMIVKYKAIVVLENLNAGFKRMRGGIAERSVYQQFEKALIDKLNYLVFKDAVPAVPGGVLNAYQLTDKFDSFSK
MNQQTGFLFYVPAAYTSKIDPLTGFVDCFNWKQIKKNTESRKAFIGLFESLCYDANTNNFVLHYRHKANRYVR
GGNLDITEWDILIQENKEVVSKTGKSYRQGKRIIYRKGSGNHGEASPYYPHEELQSLLEEHGISYKAGKNILPKIK |

TABLE S2A-continued

Enzyme sequences Group 2

| SEQ ID NO | Sequence |
|---|---|
| | AANDNALVEKLHYIIKAVLQLRNSNSETGEDYISSPVEGRKDWCFDSRAADDALPQDADANGAFHIAMKGLLL<br>MKRIRNDEKLAISNEDWLNYIQGLRS |
| 21 | MRDVVTFENFTKQYQVSKTLRFELIPQGKTLDNMKRDGIISVDRQRNEDYQKAKGILDKLYKYILDFTMETVVI<br>DWDELATATEDFRKSKDKKAYEKVQSKIRTALLEHVKKQKVGTEDLFKGMFSSKIITGEVLAAFPEIRLSDEENLI<br>LEKFKDFTTYFTGFFENRKNVFTDEALSTSFTYRLVNDNFIKFFDNCIVFKNVVNISPHMAKSLETCASDLGIFPG<br>VSLEEVFSISFYNRLLTQTGIDQFNQLLGGISVKEGEHKQQGLNEIINLAMQQNPEVKEVLKNKAHRFTPLFKQI<br>LSDRSTMSFIPDAFADDGEVLSAVDAYRKYLSEKNIGDRAFQLISDMEAYSPELMRIGGKYVSVLSQLLFNSWS<br>EIRDGVKAYKESLITGKKTKKELENIDKEIKYGVTLQEIKEALPKKDIYEEVKKYAMSVVKDYHAGLAEPLPEKIETD<br>DERASIKHIMDSMLGLYRFLEYFSHDSIEDTDPVFGECLDTILDDMNETVPLYNKVRNFSTRKVYSTEKFKLNFN<br>NSSLANGWDKNKEQANGAILLRKEGEYFLGIFNSKNKPKLVSDGGAGIGYEKMIYKQFPDFKKMLPKCTISLKD<br>TKAHFQKSDEDFTLQTDKFEKSIVITKQIYDLGTQTVNGKKKFQVDYPRLTGDMEGYRAALKEWIDFGKEFIQA<br>YTSTAIYDTSLFRDSSDYPDLPSFYKDVDNICYKLTFEWIPDAVIDDCIDDGSLYLFKLHNKDFSSGSIGKPNLHTL<br>YWKALFEEENLSDVVVKLNGQAELFYRPKSLTRPVVHEEGEVIINKTTSTGLPVPDDVYVELSKFVRNGKKGNLT<br>DKAKNWLDKVTVRKTPHAITKDRRFTVDKFFFHVPITLNYKADSSPYRFNDFVRQYIKDCSDVKIIGIDRGERNLI<br>YAVVIDGKGNIIEQRSFNTVGTYNYQEKLEQKEKERQTARQDWATVTKIKDLKKGYLSAVVHELSKMIVKYKAI<br>VALENLNVGFKRMRGGIAERSVYQQFEKALIDKLNYLVFKDEEQSGYGGVLNAYQLTDKFESFSKMGQQTGFL<br>FYVPAAYTSKIDPLTGFINPFSWKHVKNREDRRNFLNLFSKLYYDVNTHDFVLAYHHSNKDSKYTIKGNWEIAD<br>WDILIQENKEVFGKTGTPYCVGKRIVYMDDSTTGHNRMCAYYPHTELKKLLSEYGIEYTSGQDLLKIIQEFDDDK<br>LVKGLFYIIKAALQMRNSNSETGEDYISSPIEGRPGICFDSRAEADTLPYDADANGAFHIAMKGLLLTERIRNDDK<br>LAISNEEWLNYIQEMRG |

TABLE S2B

Human Codon Optimized Nucleotide Sequences Group 2

| SEQ ID NO | Corresponding AA | Sequence |
|---|---|---|
| 22 | 20 | ATGGAAATGAGGCTGATGGTTGTTTTTGAGGATTTTACCAAGCAGTACCAAGTATCTAAAACGCT<br>GCGCTTTGAACTCATCCCCCAGGGCAAGACGCTGGAGAATATGAAAGGGCTGGGATCGTGAA<br>GGGTGACTGTCAAAGATCCGAGGATTATCAGGAAGCCAAGAAGATTATCGACAAGATCTACAAA<br>CACATCCTGAACAGCAGCATGGCCAAGGTGGAGATCGACTGGTCTACTCTCGCCGAGGCAACCA<br>AGGAGTTCCGTAAGAACAAGGATAAGAAGAAGTACGAGAACGTCCAAGTGCGGGTGCGGAAG<br>AAGTTACTTGAGGACATTAAGAACCAGACTATTACCGTGGAGAAAGGTGCAAAAGACTTGTATA<br>AGGCTATGTTTGAGAAGGAAATCGTGACAGGAGAGGTTTGCGCAGCCTTCCCTGAAATTGATCT<br>GACGGATGAGGAAAAAGCCATCCTCGACAAGTTCAAAAAGTTCACCACATACTTTACAGGCTTTT<br>TTGAGAACCGCAAGAATATCTTCACAGACGAGGGAATCTCAACTTCCTTTACTTACAGGCTGGTT<br>AATGACAACTTCATTAAGTTCTACGACAACTGCAACCTTTATAAGGACATCATTGCCAGTGTGCCC<br>GGATTGAAAGGTGAGTTCAAGAAGTGTTTTAAGGACTTGCAGCTGTTTTCCAAGTGCCGACTTGA<br>AGAGATCTTTGAGACATCCTTTTACAACCATATCCTTACACAAGACGGGATCGACGAGTTTAACC<br>AGCTGTTAGGGGGGATTTCTGCTAAAGAGGGCGAAAAAAGAAACAGGGCCTGAACGAGGTGA<br>TAAATTTGGCTATGCAGAAAGACGAGGGAATTCGAAACAAACTCCGCTATAGAGCACACAAATT<br>TACCCCTTTGTTCAAGCAGATTTTAAACGATCGGAGCACCCTGAGTTTTATTCCAGAGACATTTGA<br>GAACGACAGAAAGGTGCTTGAGAGTATTGAAGCTTACAAGCTCTATCTGTCCGAGCAGAATATT<br>CTTGAAAAAGCCCAGGAACTGTTATGTTCAATGAACCGGTACGACTCTCGTAAACTCAGCATCGA<br>CGGCAAATATATCTCAAAACTCAGTCAGGCGATCTTCAACAGTTGGAGCAAAATCCATGATGGCA<br>TCAAGGACTATAAGAAGAGTCTGCTTCCTAAAGAGACAAAGAAAGCCTTAAAAGGCATTGATAT<br>GGAGCTAAAACAGGAGTGTCTGTCCAGGACATCCTGGATGCCCTACCCGAAGAGAATTTTCAC<br>GAAGTGATTGTTGATTACACTCACAACCTAGTGCAAAAGTGTCAAGCTGTCCTGTCAGGGTCACT<br>TCCAGGTAACATCGAAACAGATAAAGACAAGACCGATATTAAGCTTGTCATGGACCCCTTACTGG<br>ATCTCTACAGGTTCCTGGAGATATTCTCACATGATAATAGCCAGGGGGTGAAGACGGCTTTTGAA<br>GAACAGCTCATGGAGATTCTGGCTGATATGAAGGAGATCATACCACTTTATAACAAGGTTAGGA<br>ACTTTGCGACGAAAAGGCTTATTCCGTCGAAAAGTTCAAGCTCAATTTCAATGTTGCGACACTC<br>GCCTCTGGGTGGGATCAGAACAAAGAAAACGCCAATTGCGCAATTATTCTCAGAAAGAAGGACA<br>TGTACTACCTCGGAATCTACAACAGCTCCAATCAGCCATTCTTCGAGATCGTGGAGCAGGACGAC<br>GACGGGTTCGAGAAAATGATTTACAAACAATTCCCTGACTTCAACAAGATGTTGCCCAAGTGTAC<br>CGTGAGCAGGAAGAATGACGTAGCGGTTCATTTTAATAAGTCCGACGCCGACTTCCTCCTAAATG<br>TGAACACCTTCTCCAAGCGCTCCTGATAACAAAGGAAGTATATGACCTCGGCACGAAGACCGTG<br>CAAGGCAAGAAGAATTTCAAATTGACTACAAGCGCAATACCGGCGATGAGGCTGGATACAAAG<br>CAGCACTGAAGGCGTGGATCGATTTCGGCAAAGAGTTCATTAAAGCCTATGAAAGTACAGCCAT<br>CTATGATATAAGCCTGCTCAGGAGAGCGAAGACTATCCAGATATACAGTCTTTCTATAAGGACG<br>TCGATAACATCTGCTACAAAATAGCGTTCCAGAAGATTTCAGATGAGGCAGTTAATCAGTGTGTT<br>GAAAATGGCTCTCTGTACTTGTTCAAACTCCACGCTAAGGATTTTTCACCTGGAGCATCCGGCAA<br>ACCCAATCTTCACACTCTGTACTGGAAGTATGTATTTGAAGAGGAAATCTGAAGGATGTCGTCG<br>TCAAACTTAATGGGCAGGCCGAACTGTTCTATCGCCCAAAGTCGCTGACCCAACCCGTGGTCCAC<br>AAGAAAGGCGAAAAATCTTGAACAAAACCACCCGTCAGGTGAGCCTGTACCAGATGACGTCT<br>ACGTGGAACTCTCACATTTTATCAAAAACGGTTCTACTGGCAATCTGAGTAATGAAGCGAAAAAA<br>TGGCAGGCTAAGGTGAGCGTGAGGAACGTACCCCACGAAATTACTAAAGATCGCCGCTTCACTC<br>AAGACAAATTCTTCTTTCATGTGCCTCTGACACTGAACTATAAAAGCGCAAATACCCCACGAAGAT<br>TCAATGATCTGGTTAAGGCTTACATCAAGAAAAATCCAGACGTCCATGTGATCGGGATCGACCG |

TABLE S2B-continued

Human Codon Optimized Nucleotide Sequences Group 2

| SEQ ID NO | Corresponding AA | Sequence |
|---|---|---|
| | | GGGTGAGCGGAACTTGATTTACGCTGTGGTAATCGACGGGAAAGGGAAGATCGTGGAGCAGAG<br>ATCGTTCAACATAGTGGGAGGATACAACTACCAGGAAAAACTGTGGCAGAAAGAGAATGAAAG<br>GCAGGCTGCTCGTCGAGATTGGACTGCCGTGACCACAATAAAAGATCTGAAACAGGGCTATCTC<br>AGCGCTGTGGTGCACGAACTTTCCAAGATGATAGTAAAATACAAGGCCATTGTCGTCCTGGAGA<br>ATTTAAATGCGGGATTTAAGCGAATGAGAGGCGGTATTGCAGAAAGATCCGTGTACCAGCAATT<br>TGAGAAAGCTCTAATTGACAAGTTGAATTACCTGGTTTTCAAGGACGCCGTACCTGCAGTGCCGG<br>GAGGAGTCCTCAACGCCTATCAGCTTACCGACAAGTTTGATTCCTTTTCCAAAATGAACCAGCAA<br>ACAGGGTTCCTGTTTTACGTCCCCGCCGCATACACTAGCAAGATTGACCCTTTGACCGGATTCGTG<br>GACTGCTTTAACTGGAAACAGATCAAAAAGAACACCGAGAGTCGAAAGGCATTTATCGGGCTAT<br>TCGAATCTCTGTGCTATGACGCAAATACTAATAATTTCGTGTTGCATTACCGGCACAAGGCCAATA<br>GGTATGTTCGCGGGGGAATCTGGATATTACTGAGTGGGATATCCTTATCCAGGAGAACAAGGA<br>AGTCGTTTCCAAAACCGGCAAATCCTATCGTCAGGGCAAAAGAATAATCTATCGGAAGGGAAGC<br>GGCAACCATGGCGAAGCCAGCCCTTACTACCCGCACGAGGAGCTGCAGAGTCTCCTGGAGGAGC<br>ACGGTATCTCTTACAAGGCTGGGAAAAACATACTGCCCAAGATAAAGGCTGCAAATGACAACGC<br>CCTAGTCGAGAAACTGCACTATATTATAAAAGCTGTGCTACAGCTGAGGAATAGTAATTCTGAGA<br>CTGGAGAAGATTATATTTCGTCTCCGGTGGAGGGCCGCAAAGATTGGTGCTTCGATAGCAGAGC<br>CGCCGATGATGCCTTGCCCCAGGATGCCGATGCCAACGGTGCCTTTCATATAGCCATGAAAGGCC<br>TGTTATTAATGAAACGGATCAGAAATGATGAGAAGCTGGCAATCTCGAATGAAGACTGGTTGAA<br>CTATATTCAAGGACTGCGCTCTTGA |

TABLE S2C

Direct Repeat Group 2

| SEQ ID NO | Direct Repeat (Variant #1) | SEQ ID NO | Direct Repeat (Variant #2) |
|---|---|---|---|
| 24 | ATCTACGAGAGTAGAAATTAACATTGTCAGTTAGAC | 25 | TCTACGAGAGTAGAAATTAACATTGTCAGTTAGAC |
| 26 | ATCTACGAGAGTAGAAATTAACATATACTGTCAGAC | 27 | ATCTACGAGAGTAGAAATTAACATATACTGTCAGAC |

TABLE S2D crRNA Sequences Group 2

Figure 2A:
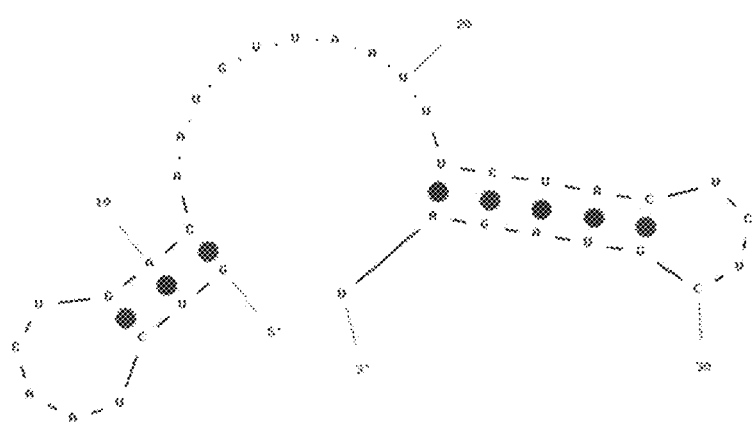
FIG. 2A-2B (SEQ ID NOs:28-29) are schemes depicting the predicted stem loop structures of crRNA sequences of the present disclosure corresponding to Group 2 sequences.
Figure 2B:
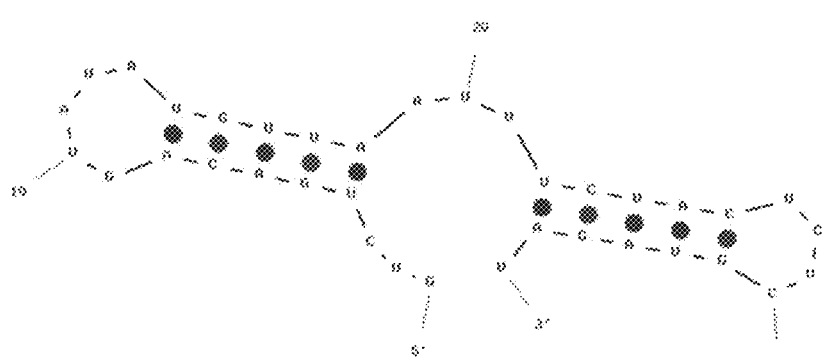

| SEQ ID NO | Sequence | FIG |
|---|---|---|
| 28 | GUCUAACUGACAAUGUUAAUUUCUACUCUCGUAGAU | FIG. 2A |
| 29 | GUCUGACAGUAUAUGUUAAUUUCUACUCUCGUAGAU | FIG. 2B |

TABLE S2E

Native Nucleotide Sequences Group 2

| SEQ ID NO | Corresponding AA | Sequence |
|---|---|---|
| 30 | 20 | ATGGAGATGAGATTAATGGTTGTATTTGAGGATTTCACAAAACAGTATCAAGTGTCGAAAAC<br>ATTAAGATTTGAATTGATTCCCCAAGGAAAGACCTTGGAAAATATGGAACGGGCAGGTATTG<br>TAAAGGAGATTGTCAACGTAGTGAGGACTATCAAGAAGCAAAGAAAATTATCGATAAAAT<br>TTATAAACACATTTTAAATTCATCCATGGCTAAGGTTGAAATTGATTGGTCAACCTTAGCGGA<br>AGCAACTAAAGAATTTAGGAAAAATAAGGATAAAAGAAATATGAAAATGTTCAAGTTCGT<br>GTTAGAAAGAAACTGCTTGAAGATATAAAAAATCAAACAATCACAGTAGAAAAGGGGGCGA<br>AAGATCTTTATAAGGCAATGTTTGAGAAAGAAATCGTTACGGGGGAAGTATGTGCTGCATTT<br>CCCGAAATAGATTTAACGGATGAAGAAAAAGCCATATTGGATAAATTTAAAAAATTTACAAC<br>GTATTTTACAGGATTCTTTGAAAACAGAAAAATATCTTTACTGATGAAGGTATCAGTACTTC<br>TTTTACGTATCGACTGGTAAATGATAATTTTATAAAATTTTATGATAATTGCAATCTTTATAAA<br>GATATTATTGCCTCTGTTCCGGGATTGAAGGGCGAGTTTAAGAAATGTTTTAAAGACTTACA<br>GCTTTTTTCTAAATGTAGACTAGAAGAAATCTTTGAGACTTCTTTTTATAATCATATTTTGACA |

TABLE S2E-continued

Native Nucleotide Sequences Group 2

| SEQ ID NO | Corresponding AA | Sequence |
|---|---|---|
| | | CAAGACGGTATCGATGAATTTAATCAACTCTTGGGCGGAATTTCCGCAAAAGAGGGAGAAA<br>AAAAGAAACAAGGCTTAAATGAAGTTATCAATTTAGCTATGCAAAAAGACGAGGGAATTAG<br>AAATAAGTTAAGATATAGAGCTCATAAATTTACGCCTCTTTTTAAACAAATTTTAAATGACCG<br>GTCTACCTTGTCATTTATACCCGAAACTTTTGAAAATGACCGTAAAGTTTTGGAGTCTATAGA<br>GGCATATAAATTATATTTATCTGAACAGAATATATTAGAAAAAGCACAAGAATTACTGTGCA<br>GCATGAATCGGTATGATTCTCGAAAGTTAAGTATTGACGGTAAGTATATTTCAAAGCTGTCTC<br>AGGCTATCTTTAACTCTTGGAGTAAGATTCATGATGGAATAAAAGATTATAAGAAGTCTTTAC<br>TTCCTAAAGAAACGAAAAAAGCTTTGAAAGGCATTGACATGGAATTAAAGCAGGGAGTAAG<br>CGTGCAGGACATATTGGACGCACTTCCTGAAGAAAATTTTCATGAAGTTATAGTTGATTATAC<br>TCATAATCTTGTGCAAAAATGTCAAGCTGTATTGAGCGGGTCTTTGCCTGGTAATATTGAAAC<br>GGATAAAGATAAAACAGATATTAAGCTAGTAATGGACCCACTGTTGGATTTGTATCGGTTTTT<br>AGAAATATTCAGCCATGATAATTCCCAAGGTGTAAAAACGGCATTTGAAGAACAATTGATGG<br>AAATTTTGGCAGATATGAAGGAAATCATCCCTTTGTACAATAAGGTTAGAAATTTCGCTACTA<br>AAAAAGCATATTCAGTAGAAAAATTTAAACTTAATTTTAATGTAGCGACATTGGCATCCGGTT<br>GGGATCAGAACAAAGAAAATGCAAATTGTGCAATTATACTTCGAAAGAAGGATATGTATTAT<br>TTGGGTATATATAATTCTTCCAATCAGCCGTTTTTTGAAATAGTCGAGCAAGATGATGACGGG<br>TTTGAAAAGATGATATATAAACAATTTCCCGATTTTAATAAAATGTTACCTAAATGTACAGTAT<br>CACGTAAAAATGATGTTGCAGTTCATTTTAATAAGTCTGATGCAGATTTTTTATTAAATGTAAA<br>TACGTTCAGTAAACCGCTTCTTATAACTAAAGAAGTCTATGATTTAGGCACTAAAACTGTTCA<br>AGGAAAAAAGAAATTCCAGATTGATTATAAGAGAAACACTGGGGATGAGGCCGGGTATAAG<br>GCTGCCTTGAAGGCATGGATTGACTTCGGGAAAGAGTTCATAAAGGCTTATGAAAGCACAG<br>CTATATACGATATATCATTGTTACGAAAAAGCGAAGATTATCCCGATATCCAATCTTTTTACAA<br>GGATGTAGACAATATATGCTATAAAATCGCCTTTCAAAAGATCTCTGATGAAGCAGTAAATC<br>AATGTGTAGAAAATGGTTCTTTATATCTTTTTAAATTGCACGCCAAGGATTTTTCGCCCGGTG<br>CCAGTGGGAAACCGAATTTACACACGCTGTATTGGAAGTATGTATTTGAAGAAGAAAACTTG<br>AAAGATGTAGTTGTGAAATTAAACGGACAGGCAGAATTGTTTTATCGCCCCCGAAGTTTAAC<br>GCAGCCAGTTGTACATAAAAAAGGAGAGAAAATTCTTAATAAAACTACTCGATCGGGAGAA<br>CCCGTTCCCGATGACGTATATGTTGAGTTGTCTCACTTTATTAAAAACGGAAGTACGGGCAAT<br>TTGTCGAATGAGGCAAAAAAGTGGCAGGCGAAGGTAAGCGTTCGCAATGTGCCTCATGAGA<br>TTACAAAGGATCGCAGATTTACACAGGATAAATTCTTTTTCCATGTGCCTCTGACTTTGAATTA<br>TAAATCTGCCAATACACCCCGGCGCTTTAATGATTTAGTCAAAGCGTATATTAAGAAGAATCC<br>GGATGTGCATGTCATTGGAATTGACCGGGGCGAACGAAATCTTATTTATGCAGTTGTTATTG<br>ACGGAAAAGGTAAGATTGTTGAACAGCGGTCCTTCAATATCGTAGGGGGCTATAATTACCAA<br>GAAAAATTATGGCAAAAGAAAATGAACGGCAGGCAGCGAGACGCGATTGGACCGCTGTC<br>ACCACGATTAAGGATTTAAAACAAGGATACCTGTCCGCTGTTGTACATGAGTTATCTAAATG<br>ATAGTGAAGTATAAGGCTATTGTTGTACTTGAAAACCTCAACGCGGGTTTTAAACGTATGCG<br>AGGCGGCATTGCGGAACGATCCGTTTACCAGCAGTTTGAAAAGGCCTTAATCGATAAATTAA<br>ATTATTTAGTTTTTAAAGATGCAGTCCCTGCGGTGCCCGGAGGAGTCTTAAATGCGTATCAAT<br>TAACCGACAAATTTGACAGTTTCAGTAAAATGAACCAGCAAACGGGATTTTTGTTTTACGTGC<br>CCGCAGCTTATACTTCTAAAATTGATCCCTTAACAGGATTTGTAGATTGTTTTAATTGGAAACA<br>AATAAAGAAAAATACTGAGAGTCGGAAGGCATTTATTGGTTTGTTTGAATCGCTTTGCTATG<br>ACGCGAATACGAATAATTTTTGTGCTTCATTATAGGCATAAGGCTAACCGATATGTTCGTGGC<br>GGTAATTTGGACATTACGGAATGGGATATACTGATTCAAGAAAATAAAGAAGTAGTAAGTA<br>AAACCGGCAAATCCTATCGCCAAGGGAAACGCATTATCTACAGGAAAGGCTCCGGTAATCAT<br>GGGGAAGCGTCTCCCTACTATCCTCACGAAGAACTGCAATCTTTGTTGGAAGAACATGGAAT<br>TTCATATAAAGCAGGCAAGAACATCTTACCCAAGATTAAAGCCGCTAATGACAACGCATTGG<br>TAGAAAAGTTGCACTACATTATTAAGGCCGTGCTTCAATTACGCAACAGCAATAGTGAAACC<br>GGAGAGGATTATATCAGTTCTCCCGTTGAAGGCCGCAAAGATTGGTGCTTTGATAGTAGAGC<br>TGCAGATGATGCGTTACCACAAGATGCTGATGCTAACGGTGCCTTTCATATTGCCATGAAAG<br>GATTGTTATTAATGAAACGGATTCGGAATGATGAAAAGCTTGCAATTAGTAATGAAGATTGG<br>CTGAATTACATACAAGGATTGAGAAGCTAA |
| 31 | 21 | ATGAGAGATGTGGTGACCTTCGAGAATTTTACAAAACAGTACCAGGTGAGCAAGACTCTGA<br>GGTTTGAACTGATCCCCCAGGGGAAAACACTGGATAACATGAAAAGAGATGGAATCATTTCC<br>GTGGACAGGCAGCGCAACGAGGACTATCAGAAGGCCAAGGGCATCCTGGATAAGCTGTATA<br>AATACATCCTGGACTTCACCATGGAGACCGTGGTGATCGACTGGGACGAGCTGGCAACCGCC<br>ACCGAGGATTTCAGGAAGAGCAAAGATAAGAAGGCCTACGAAGAGGTCCAGAGCAAGATC<br>AGAACAGCTCTGCTGGAGCACGTGAAAAAACAGAAAGTGGGCACCGAGGATCTGTTCAAGG<br>GGATGTTCAGCAGCAAGATCATTACCGGCGAAGTGCTGGCAGCTTTCCCCGAGATCCGCCTG<br>TCCGACGAAGAGAATCTGATTCTCGAAAAGTTCAAGGACTTCACAACCTACTTCACAGGATTC<br>TTCGAGAACCGGAAGAATGTGTTTACTGACGAGGCCCTGAGCACCAGCTTCACTTACCGGCT<br>CGTGAACGATAATTTTATCAAGTTCTTCGATAACTGCATCGTGTTTAAGAACGTTGTGAATAT<br>CAGCCCTCATATGGCCAAGAGCCTGGAGACCTGCGCCTCCGATCTGGGCATCTTCCCTGGCG<br>TTTCCCTGGAGGAGGTGTTCTCCATTAGTTTCTACAATAGACTGCTGACCCAGACTGGCATTG<br>ATCAGTTCAACCAGCTGCTGGGCGGAATCTCTGTGAAGGAAGGAGAGCACAAGCAGCAGGG<br>GCTGAATGAGATCATCAACCTTGCCATGCAGCAGAATCCTGAGGTCAAAGAGGTGCTGAAG<br>AATAAGGCCCACCGGTTTACCCCCCTCTTTAAGCAGATTCTGTCCGACAGGTCCACCATGTCC<br>TTTATTCCTGATGCCTTCGCCGATGACGGCGAAGTGCTGAGCGCCGTCGACGCATACCGAAA<br>ATACCTGAGTGAGAAGAACATCGGCGATAGGGCCTTTCAGCTGCATCAGCGATATGGAAGCC<br>TACAGCCCCGAGCTGATGAGAATCGGCGGCAAGTATGTGTCCGTGCTGTCACAGCTGCTGTT<br>CAACTCTTGGAGCGAGATCAGGGATGGAGTGAAGGCCTACAAGGAAAGCCTGATCACTGGC<br>AAGAAGACCAAGAAGGAACTGGAGAACATCGACAAGGAGATCAAATATGGAGTGACACTCC<br>AGGAGATCAAGGAGGCTCTGCCTAAGAAAGACATTTATGAGGAGGTGAAGAAATACGCCAT<br>GTCCGTGGTGAAGGACTATCATCAGGCCTGGCCAGCCTCTGCCAGAAAAAATTGAGACC |

TABLE S2E-continued

Native Nucleotide Sequences Group 2

| SEQ ID NO | Corresponding AA | Sequence |
|---|---|---|
| | | GATGATGAGAGGGCTTCAATCAAGCACATCATGGATAGCATGCTGGGGCTGTATAGATTTCT<br>GGAGTACTTTAGTCACGACAGCATCGAGGACACTGATCCTGTGTTCGGAGAGTGCCTGGACA<br>CTATCCTGGACGATATGAATGAGACAGTGCCTCTGTACAATAAGGTGCGCAATTTCAGCACA<br>AGGAAGGTGTACAGCACAGAGAAGTTCAAGCTGAACTTCAATAATAGCTCCCTGGCCAACG<br>GATGGGATAAAAACAAAGAGCAGGCTAATGGCGCAATTCTGCTGAGAAAGGAGGGGAGT<br>ATTTCCTGGGAATCTTCAACAGCAAGAATAAACCCAAGCTCGTGTCCGACGGCGGCGCCGGC<br>ATCGGCTACGAGAAGATGATTTACAAGCAGTTCCCTGACTTCAAGAAAATGCTGCCAAAGTG<br>CACCATCAGCCTGAAGGACACCAAAGCCCACTTCCAGAAATCTGATGAAGACTTTACCCTGC<br>AGACCGATAAATTCGAGAAGTCCATCGTGATCACAAAGCAGATCTACGACCTGGGGACCCA<br>GACTGTGAACGGCAAGAAAAAGTTCCAGGTGGATTACCCCAGGCTGACCGGAGATATGGAG<br>GGATACCGGGCCGCACTGAAAGAGTGGATCGATTTCGGCAAGGAGTTTATCCAGGCCTACA<br>CATCCACAGCCATCTACGACACTTCCCTGTTCCGGGACTCATCAGATTACCCTGACCTGCCCA<br>GCTTTTACAAGGACGTTGACAACATCTGCTACAAGCTGACCTTTGAATGGATCCCGGACGCA<br>GTGATTGACGATTGCATCGATGACGGGTCCCTGTACTTGTTCAAGCTGCACAACAAAGACTTT<br>TCCAGCGGCTCCATCGGCAAGCCAAATCTTCACACACTCTATTGGAAAGCCCTGTTCGAGGA<br>GGAAAACCTGTCCGATGTGGTGGTGAAGCTGAATGGCCAGGCAGAGCTGTTTTATCGGCCA<br>AAGAGCCTGACAAGGCCTGTGGTGCACGAGGAGGGTGAGGTGATCATCAATAAGACTACCA<br>GCACCGGCCTCCCTGTGCCAGATGACGTGTACGTCGAGCTGTCCAAGTTCGTGCGCAACGGC<br>AAGAAGGGAAACCTGACCGACAAAGCCAAGAACTGGCTGGACAAAGTGACCGTGCGGAAA<br>ACCCCCCACGCCATCACCAAAGATCGGCGCTTTACAGTGGACAAGTTCTTCTTCCACGTGCCC<br>ATTACACTGAACTATAAGGCTGACTCAAGCCCTTATAGATTCAACGACTTCGTGCGCCAGTAC<br>ATTAAGGACTGCTCAGATGTGAAGATTATCGGCATTGACAGGGGAGAGAGGAACCTGATTT<br>ACGCCGTGGTGATCGACGGCAAGGGCAACATCATCGAACAGAGAAGTTTTAATACAGTGGG<br>CACCTACAACTACCAGGAGAAACTGGAACAGAAGGAAAAGGAGAGGCAGACCGCCAGGCA<br>GGACTGGGCAACCGTGACAAAAATTAAAGATCTGAAGAAGGGCTACCTGTCTGCCGTGGTG<br>CACGAGCTGTCCAAGATGATCGTGAAGTACAAGGCTATCGTGGCCCTGGAGAACCTGAATGT<br>GGGGTTTAAACGGATGAGGGGGGGCATTGCCGGCAGGCTCTGTGTATCAGCAGTTCGAAAA<br>GGCCCTGATCGACAAGCTTAATTACCTCGTGTTTAAGGACGAAGAACAGAGTGGTTATGGTG<br>GGGTCCTGAACGCCTACCAGCTGACCGATAAGTTCGAGTCCTTCAGCAAATGGGCCAGCAG<br>ACCGGGTTCTTTTCTACGTGCCCGCAGCCTACACCAGCAAAATCGACCCTCTCACAGGCTTC<br>ATTAACCCTTTCTCTTGGAAACACGTGAAGAATCGGGAGGACAGGAGGAACTTCCTGAACCT<br>GTTCAGCAAGCTGTATTACGATGTGAACACCCACGACTTCGTGCTTGCCTACCACCACAGCAA<br>CAAAGATAGTAAATACACAATCAAGGGAAACTGGGAGATCGCCGACTGGGACATTCTGATA<br>CAGGAGAACAAGGAGGTGTTCGGCAAGACCGGCACACCTTACTGCGTGGGCAAAAGGATTG<br>TGTACATGGATGATTCCACCACCGGCCACAATAGAATGTGTGCTTACTATCCACATACCGAAC<br>TGAAAAAACTGCTGTCCGAGTACGGAATTGAGTACACATCTGGACAGGATCTGTTGAAGATC<br>ATCCAGGAGTTCGATGACGACAAACTGGTGAAAGGCCTGTTCTACATCATTAAGGCTGCTCT<br>GCAGATGCGGAATTCCAACAGTGAGACAGGCGAAGACTACATCTCCTCCCCCATCGAGGGC<br>AGGCCTGGCATCTGTTTTGACAGCAGAGCCGAGGCCGACACACTGCCTTATGACGCAGACGC<br>CAATGGCGCTTTTCACATTGCCATGAAGGGGCTGCTGCTGACCGAGCGGATCCGGAATGATG<br>ATAAGCTGGCCATCAGCAACGAGGAATGGCTGAACTATATCCAAGAGATGCGGGGCTAG |

C. Group 3 Type V Nuclease and Associated Sequences
(SEQ ID Nos: 32-44)

TABLE S3A

Enzyme Sequences Group 3

| SEQ ID NO | Sequence |
|---|---|
| 32 | MKNLKEFHNLYPVQKTLRFKLEPIGKTEEFIERAQILENDERRADEYLKVKEYIDRYHREFIENALSQPLLKVESEGK<br>QDSLEDFADCYNNDNSEKRSDNLEKIQDKLRTQIVKGFSKLPAFARIAKKELIKEDLPKFLKDKNEKEIVSHFDEFT<br>TYFTGFHQNRMNMYTAEAKSTSIAFRLINQNLVKFVDNSNILEKVVPVLGKDIIAQLDKDFEPFLNVDSALDLFKI<br>DNYNEVLTQLQIELYNAIIGGRVDEGNKVEIKGLNQYINEFNQTHEKSLRIPKLKPLFKQILSENVGVSFRMEQFT<br>DASQVQTAIKEEYIKLESSVFDKLKEMIKSLPTFNLNGIYLANDLGLTDICQRYYGAWDKLNNALVAEFDAVVPRK<br>KTQSQEKRDNQVKKYLKSVKSISLGKIDSLLADVTEKSIVDYFTNLGAIDNETTQRENLFALIQNRYISLKEVLDCPT<br>PSDELLRKNIEGIKDLLDAIKDLQRFIKPLCGCGEELDKDEMFYSDFSPLYETLDDIITPLYNKVRSYLTKKPYKLDKF<br>KLNFETPTLLQSWPNYQAYSCAIFKEDDNHYYLAILDKNNRSCLNTIVPPISKNDIIGLVKHLQGGDMGKNVQNL<br>MRIDGKTRKVNGRKETSGPNAGQNIRLEESKKTYLPHEINEIRIEKSFSLNSPNYRRECLNKYIDFYKPLVEEYYSEF<br>DFEFKEASEYRDFSQFTNHINQQSYQLKIIPFSKKYLKTLVDNGQVFLFRILNKDFSPYSKGRPNLHTIYWKMLFD<br>DNNLKDVIYKLNGKAEMFFRRSSITNPVIHAANKEIANKSAYNKQHKAVSKFDYDIIKDRRFTRNQYEFHVPITM<br>NFKSAGSVRFNQEVLSFIKEKGIKHIIGIDRGERHLLYLTMINMKGEIVEQFSLNDVASNPNNPEYKQDYNELLSIK<br>EGDRLSARRNWSTIENIKELKSGYLSQIVHLLSKMMIENDAILVLENLNTGFMRGRQKVEKSVYLKFEKMLIDKL<br>NYVVDKTAAPNEPSGALKALQLTDTYDNFNKYQKGNVRQCGFVFYIPAWNTSKTDPVTGYVNLFDTRLSTIGEI<br>KSFFSKFDRIKYNSKNDAFEFTFDYNNFTTRAEGTRTCWTISSQGERIFTHRSKEQNNQFVSETVHPTQIFKDVFK<br>MAGCEINGNLKEGIASIESLEPLKQLLHAFKLVIQMRNSITGTEVDFLLSPAIDAKGTNFDSRKGISTLPENADANG<br>AYNIARKGLMIVEQIQNADDIANIKYSVSNNDWLKFAQG |

TABLE S3A-continued

Enzyme Sequences Group 3

| SEQ ID NO | Sequence |
|---|---|
| 33 | LCSIFAHMAINFAREIKKYYLCIINIKKILNMECLKDFYNQYSVQKTLRFKLEPVGKTEEFIERAQVLENDERRAAEY KKVKDLIDNYHRWFIEQALSAPLLKVDSTGDNDSLEDFQDCYNNDTSEKRSDNLEKIQGKLRSQIVKGFSKHPAF KHIDKKELITTDLKQFLTDPNEIDIVSHFANFTTYFTGFHQNRMNMYSVEAKSTSISFRLINQNLVKCVDNSKILEK VKPALGADIFSKLNHDFEPPLNVVDALDLFKVENYNEVITQPQIELYNAIIGGRVDNDSKVEIKGLNQYINEYNQT HSKQERLPKLKPLFKQILSEREGVSFRIEQFEKANQVQDAINEAYNDLHANVFTKLKDLLLNLSSFDLDGVFVAND QSLTDISQRHYGAWDTVKNAVVASYDMTNPRKKSQSQEKRDEQVKKHLKSIKSLSLATIDNMLKDSTGLSIVDY FTTLGAVNNENLQHENLFALIENRYNAARSVLDSDSPSDELLRKNITQIKDLLDSIKDLQRFIKPLCGSGEEPLKDEI FYSDFSALYESLDDTITPLYNKVRSYLTRKPYSLDKFKLNFDNSQLLDGWDVNKEKDYLSILLRKNGYYYLAIANKN DKSALSQINQCDMISGDCYEKLNYKLLPSPFKMLPKVFFSRKGIEVYNPSQEILDIYNEKKFQLGDKFDKESLIKLID FYKNAIPQNESWQSFDFSFAPSQSYESINEFYSVIENQGYKIDFKKVPSSLINLLIDQGLLYVFKIANKDFSPHSKGR PNLHTIYWRMLFDENNLKNVVYKLNGRAEMFYRKSSIQNPVIHKAHHDIKNKSEYNKLHKPSSKFDYDIIKDRRF TRNQYEFHVPITMNFKPAGSGQFNRDVLKFIKAKGIKHIIGIDRGERHLLYLTMIDLKGRIVEQFSLNSVASNPNN PDFKQDYNTMLAIKEGDRLNARRNWSTIENIKELKQGYLSQIVHLLSKMMIENDAILVLENLNSGFMRGRQKVE KSVYLKFEKMLIDKLNYVVDKGTDLNEPCGALKALQLTDSYEKFNKFQKGNVRQCGFVFYIPAWNTSKIDPATGF VNLFDTRLSTIGEIKAFFSKFDRISYDASNDVFEFSFDYNNFTSRAQGTRTRWTVTTRGERIFTHRSKEKNNQFVS ELVSPTSLLKDVLEKTGTNLQGNLKEAIASLQSLDELKQLLHAFKLTMQMRNSVTGTDVDYLISPAIDAKGNNFD SRECDSTMPLNADANGAFNIARKGLMIVEQIQKVDDIGNLKYAVTNKDWLTFAQK |

TABLE S3B

Human Codon Optimized Nucleotide Sequences Group 3

| SEQ ID NO | Corresponding AA | Sequence |
|---|---|---|
| 34 | 32 | ATGAAGAACCTCAAGGAGTTTCATAATCTCTATCCTGTGCAGAAGACTCTGCGGTTTAAGCTGG AACCCATCGGTAAGACCGAAGAATTCATCGAGAGAGCACAGATTTTGGAGAATGATGAGCGG CGCGCCGACGAATATCTGAAGGTAAAGGAATACATTGACCGGTACCATAGGGAATTCATTGAG AACGCCTTGTCACAGCCTCTGCTCAAAGTCGAGAGTGAAGGCAAACAGGATTCCTTGGAAGAC TTCGCAGACTGTTATAACAACGACAATAGCGAGAAAAGATCCGATAATCTGGAAGATCCAA GATAAACTGAGAACCCAGATCGTTAAAGGATTCAGCAAACTACCAGCCTTTGCCCGGATCGCA AAGAAGGAGCTAATTAAGGAAGATCTGCCCAAATTCTTAAAGGATAAAAACGAAGGAGAT CGTGTCTCATTTTGACGAATTTACAACCTACTTTACCGGCTTTCATCAGAATAGGATGAACATGT ATACTGCAGAGGCAAAGAGTACATCCATAGCATTTCGCCTTATCAATCAGAACCTGGTGAAGTT TGTAGACAACTCTAATATTCTCGAAAAGGTTGTCCCAGTACTGGGAAAAGACATCATCGCTCAA CTGGACAAAGATTTCGAGCCTTTCCTCAACGTAGATTCTGCTCTGGACTTATTCAAGATCGATAA CTACAACGAGGTGCTCACTCAGCTTCAGATTGAGCTGTATAATGCCATCATCGGGGGCAGAGT GGATGAAGGTAACAAAGTCGAGATAAAGGGACTGAATCAGTATATTAACGAGTTCAACCAGAC CCATGAGAAGAGTCTGCGTATACCCAAACTCAAACCTCTGTTCAAGCAGATACTTAGCGAGAAC GTGGGCGTGTCGTTCCGCATGGAGCAGTTCACAGATGCCAGCCAAGTGCAGACTGCTATCAAA GAGGAATACATCAAACTGGAATCCTCAGTTTTCGACAAACTCAAGGAGATGATAAAATCACTCC CCACCTTCAACCTGAACGGGATCTACCTGGCTAATGATTTGGGTCTGACGGACATCTGCCAAAG ATACTATGGCGCGTGGGATAAACTTAACAACGCCCTGGTTGCAGAATTCGACGCGGTGGTACC TAGGAAGAAAACCCAGAGTCAAGAGAAAAGGGACAACCAGGTCAAAAAATACCTGAAGAGCG TGAAGTCCATCAGCTTGGGGAAAATAGACTCCCTTCTCGCTGACGTTACAGAAAAGTCAATTGT GGACTATTTCACAAATCTCGGAGCTATCGATAACGAAACCACTCAGCGCGAAAACCTGTTTGCT CTCATACAGAATCGCTACATCTCTCTCAAGGAGGTCCTTGACTGTCCAACACCTTCTGATGAACT GCTTAGGAAGAATATTGAGGGATTAAGGACTTATTGGATGCAATAAAGGATCTACAACGGTT TATAAAACCCCTATGTGGCTGCGGAGAGGAACTAGATAAGGATGAAATGTTTTACAGCGACTT TTCACCTCTCTACGAGACTCTGGATGACATTATAACTCCCCTGTATAATAAGGTGAGGAGCTACT TGACCAAGAAACCCTATAAGCTTGACAAGTTCAAGCTCAATTTTGAGACGCCCACCCTCTTGCA GTCTTGGCCTAACTATCAAGCCTACTCATGTGCGATCTTCAAGGAGGATGATAATCATTACTACT TAGCCATCCTGGACAAAAACAACAGGTCGTGCCTGAATACCATCGTTCCACCTATATCCAAGAA CGACATAATCGGCCTGGTCAAGCACTTACAGGGGGCGATATGGGAAAAAATGTGCAGAATTTG ATGCGAATCGACGGTAAAACTCGGAAAGTTAATGGCCGGAAAGAGACATCTGGCCCAAATG CTGGCCAGAACATTAGGCTTGAGGAGTCGAAGAAGACATATCTGCCGCACGAGATTAACGAGA TCCGAATTGAGAAAGTTTCAGCTTAAACTCTCCGAATTATAGACGCGAATGCCTGAACAAGTA CATTGATTTCTACAAACCTCTGGTCGAGGAGTACTATTCAGAGTTTGACTTTGAGTTCAAAGAG GCTAGCGAATATCGGGACTTCTCCCAGTTTACTAATCACATCAACCAGCAATCATACCAGCTGA AAATTATCCCCTTCAGCAAAAAGTACCTGAAAACCCTAGTGGATAACGGGCAGGTGTTTTATT CCGGATCCTCAACAAGGACTTTAGCCCATATTCTAAGGGGCGTCCAAACCTGCACACGATCTAC TGGAAGATGTTGTTTGACGACAATAACCTGAAGGACGTGATTTATAAGCTCAATGGTAAAGCG GAGATGTTTTTTAGGCGGTCCTCTATTCAAAACCCAGTGATACATGCTGCAAACAAAGAAATTG CCAATAAGTCTGCCTACAATAAACAACATAAGGCCGTGTCCAAGTTCGATTATGACATTATAAA GGATCGCCGATTCACAAGAAACCAGTACGAGTTCCACGTCCCCATCACCATGAACTTTAAGTCC GCCGGATCAGTCAGGTTCAATCAAGAGGTTTTGAGCTTCATTAAGGAGAAGGGTATTAAGCAC ATTATTGGAATTGATCGAGGTGAACGGCACCTTCTTTATCTGACAATGATCAACATGAAAGGAG AGATCGTCGAACAATTTTCTCTCAATGACGTTGCCTCAAATCCGAATAATCCCGAATACAAACAA GACTATAACGAGCTCCTCTCTATCAAGGAGGGAGATAGACTGTCGGCCCGCAGGAATTGGTCC ACAATCGAGAACATTAAAGAGCTAAAGTCTGGTTACCTTAGCCAGATTGTTCACCTGCTTAGTA |

TABLE S3B-continued

Human Codon Optimized Nucleotide Sequences Group 3

| SEQ ID NO | Corresponding AA | Sequence |
|---|---|---|
| | | AGATGATGATCGAAAATGACGCCATTTTAGTGCTAGAGAATCTGAACACGGGCTTTATGAGAG
GTAGACAGAAGGTGGAAAAAAGCGTCTATCTGAAGTTCGAGAAATGCTTATCGATAAGCTGA
ATTATGTGGTAGACAAAACAGCTGCACCAAACGAACCAAGTGGGGCATTAAAAGCTCTCCAGC
TCACTGACACGTACGATAACTTCAACAAGTACCAGAAGGGAAATGTGAGGCAGTGCGGCTTTG
TCTTTTATATCCCAGCCTGGAACACCTCTAAAACCGACCCCGTCACAGGGTATGTCAACTTGTTC
GACACTCGTCTCAGTACCATCGGGGAAATCAAGAGTTTTTTCAGCAAGTTCGATCGTATCAAAT
ACAACAGTAAGAACGATGCCTTCGAGTTCACATTCGACTACAATAATTTCACTACGCGAGCGGA
GGGGACTCGTACCTGCTGGACCATCTCCAGCCAGGGAGAAAGAATATTTACCCACCGCTCAAA
GGAACAGAACAATCAGTTCGTGTCCGAAACCGTGCACCCCACTCAGATCTTTAAAGACGTGTTC
AAGATGGCTGGATGTGAAATCAATGGGAACCTGAAAGAAGGGATCGCATCCATTGAATCCCTG
GAGCCGTTGAAGCAGCTTCTGCACGCCTTTAAACTGGTGATTCAGATGCGCAATAGTATTACCG
GAACTGAAGTGGACTTTCTGCTGAGCCCTGCAATTGACGCTAAAGGCACAAATTTTGATTCCCG
AAAAGGCATTAGCACATTGCCCGAAAATGCCGACGCCAACGGGGCTTACAATATAGCCAGAAA
AGGCTTGATGATTGTAGAGCAGATTCAAAATGCGGATGATATCGCTAATATCAAGTACTCAGTT
TCCAATAACGATTGGCTGAAGTTTGCCCAAGGCTGA |
| 35 | 33 | CTTTGCAGCATTTTCGCCCACATGGCCATCAACTTCGCCAGAGAAATCAAGAAGTACTACCTGT
GCATCATCAACATAAAGAAGATCCTGAACATGGAATGCCTGAAAGATTTCTATAATCAATACAG
CGTCCAGAAGACCCTGAGATTCAAGCTGGAACCTGTTGGAAAGACCGAGGAATTCATCGAGAG
AGCCCAAGTGCTGGAACGATGAACGCCGGGCCGCTGAATACAAGAAGGTCAAGGACTTGA
TCGATAACTACCAGATGGTTCATCGAGCAGGCCCTGAGCGCTCCTTTGTTAAAGGTGGACA
GCACCGGGGATAACGATTCCCTGGAAGATTTCCAGGACTGCTACAACAACGATACCAGCGAGA
AGAGAAGCGACAATCTGGAGAAAATCCAGGGCAAGCTGCGGTCTCAGATCGTGAAGGGCTTT
AGCAAGCACCCCGCCTTCAAGCACATCGACAAAAAGGAGCTGATCACAACCGACCTGAAACAG
TTTCTGACCGACCCCAACGAGATCGACATCGTCAGCCACTTCGCCAACTTCACCACCTACTTCAC
CGGCTTCCACCAGAACAGAATGAACATGTACAGCGTGGAAGCCAAGAGCACCTCCATCTCTTTT
AGACTGATCAACCAGAATCTGGTGAAGTGCGTGGATAATTCCAAGATCCTGGAAAAAGTGAAG
CCTGCTCTCGGCGCCGACATCTTCAGCAAGCTGAACCACGATTTTGAGCCTTTCCTGAATGTGG
TGGACGCCCTGGACCTGTTCAAGGTGGAAAACTACAATGAGGTGATCACACAACCTCAGATCG
AACTGTACAACGCCATAATTGGAGGCAGAGTGGACAACGACTCGAAGGTGGAAATCAAAGGC
CTGAACCAGTACATCAACGAGTACAACCAAACACACTCTAAACAGGAGCGGCTGCCTAAGCTG
AAACCACTGTTTAAGCAGATCCTGAGCGAGAGAGAGGGCGTGAGCTTCAGAATCGAGCAATTT
GAGAAAGCGAACCAGGTCCAGGACGCCATCAACGAGGCCTACAATGACCTGCACGCCAACGT
GTTCACAAAGCTGAAGGATCTGCTGCTGAACCTGTCTAGCTTCGATCTGGACGGCGTGTTCGTG
GCCAACGACCAGTCTCTTACAGACATCAGCCAGCGGCATTACGGCGCCTGGGATACTGTGAAG
AACGCTGTAGTGGCCAGCTACGACATGACAAATCCCAGAAAAAAAAGCCAGTCTCAGGAGAA
GAGAGATGAGCAAGTGAAGAAGCACCTGAAGTCTATCAAGTCACTAAGCCTGGCCACCATCGA
CAATATGCTGAAGGATTCTACCGGCCTGAGCATCGTGGATTATTTCACCACCCGGGCGCGGTG
AACAATGAAAATCTTCAGCACGAGAACCTGTTCGCCCTGATCGAAAACCGGTACAACGCCGCC
AGAAGCGTGCTGGACAGCGATCTCCCAAGCGACGAACTGCTGAGGAAGAATATCACCCAGATC
AAAGACCTGCTCGACAGCATCAAGGACCTGCAGCGGTTCATCAAGCCCCTGTGCGGAAGCGGC
GAAGAGCCTCTGAAGGACGAGATTTTCTACAGCGATTTTTCTGCCCTGTACGAAAGCCTCGATG
ACACCATCACCCCTCTGTATAACAAGGTGCGGTCTTACCTGACCAGAAAGCCATACTCTCTGGA
CAAGTTCAAGCTGAACTTCGATAACAGCCAGCTGCTGGACGGCTGGGACGTTAACAAGGAGAA
AGACTACCTGAGCATCCTGCTGAGAAAGAACGGATACTACTACCTGGCTATTGCCAATAAGAAC
GACAAGAGCGCCCTGTCCCAGATCAACCAGTGTGATATGATCAGCGGCGACTGTTACGAGAAG
CTGAATTACAAACTGCTGCCTAGCCCTTTCAAGATGCTGCCTAAGGTGTTTTTCAGCAGAAAGG
GCATCGAGGTTTACAACCCCAGCCAGGAGATCCTGGACATCTCACAACGAGAAAAAGTTTCAGC
TGGGCGATAAAATTCGATAAGGAATCTTTAATCAAGCTGATCGACTTCTACAAGAATGCCATCCC
TCAGAACGAGTCCTGGCAGTCATTCGACTTCAGCTTTGCCCCTTCCCAATCCTACGAGAGCATCA
ACGAATTCTACTCCGTGATAGAGAACCAGGGCTACAAAATCGACTTTAAGAAGGTGCCCTCTTC
TCTCATCAACCTGCTGATCGACCAGGGCCTGCTGTACGTGTTCAAGATCGCCAATAAGGACTTT
TCTCCTCACAGCAAGGGTAGGCCTAATCTCCATACAATCTACTGGCGCATGCTTTTCGACGAGA
ACAACCTGAAGAACGTGGTGTATAAGCTGAACGGCAGAGCCGAGATGTTCTACAGAAAAAGCT
CTATCCAGAACCCTGTGATCCACAAGGCTCACCACGACATCAAGAACAAATCTGAATATAACAA
GCTGCACAAGCCAAGCAGCAAGTTTGATTACGACATTATCAAGGACAGAAGGTTTACCAGAAA
TCAGTACGAGTTCCACGTGCCAATCACCATGAACTTCAAGCTGCAGGCAGCGGCCAGTTCAAC
CGGGACGTGCTGAAATTCATCAAAGCCAAGGGAATTAAGCACATTATCGGAATCGATAGAGGC
GAGAGGCACCTGCTGTATCTGACAATGATGACCTGAAGGGCCGAATCGTGGAACAGTTCAGT
CTGAACAGTGTCGCCAGCAACCCCAACAACCCTGACTTCAAGCAGGATTACAACACAATGCTGG
CCATCAAAGAGGGCGACCGCCTGAACGCCCGGAGAAACTGGAGCACCATCGAGAACATCAAG
GAACTGAAGCAGGGCTATCTGAGCCAGATCGTGCACCTCCTGAGCAAGATGATGATCGAGAAT
GACGCCATACTGGTACTGGAAAACCTGAACAGCGGATTCATGAGAGGCAGACAGAAGGTGGA
GAAGAGCGTGTACTTGAAATTCGAGAAGATGCTGATTGACAAGCTGAACTACGTGGTGGACAA
GGGCACGGATCTGAACGAGCCTTGCGGCGCCCTGAAAGCTCTGCAGCTGACAGACAGCTACGA
GAAGTTCAACAAATTCCAGAAGGGAAATGTGCGGCAGTGCGGCTTCGTGTTCTACATCCCCGC
CTGGAACACCTCCAAGATCGACCCTGCTACCGGCTTCGTGAACCTGTTTGATACCAGACTGTCC
ACAATCGGCGAGATCAAGGCCTTCTTCAGCAAGTTCGACCGGATCTCTTACGACGCCAGCAACG
ACGTGTTCGAGTTCAGCTTTGATTACAACAACTTCACCAGCAGCCCAGGGCACGGACCA
GATGGACCGTGACCACACGGGGCGAGAGAATCTTTACCCACAGATCCAAAGAGAAGAACAAC
CAGTTCGTGAGCGAGCTGGTGAGCCCCACATCTCTGCTGAAAGACGTGCTGGAAAAGACAGGA
ACAAACCTCCAGGGCAATCTGAAGGAAGCCATCGCCAGCCTGCAGAGCCTGGATGAGCTGAA
GCAACTGCTTCATGCCTTCAAGCTGACAATGCAGATGCGGAATTCCGTGACCGGCACCGACGT
GGACTACCTCATTAGCCCAGCCATCGACGCTAAAGGAAACAACTTCGATAGCCGGGAATGTGA |

TABLE S3B-continued

Human Codon Optimized Nucleotide Sequences Group 3

| SEQ ID NO | Corresponding AA | Sequence |
|---|---|---|
| | | CTCTACCATGCCTCTGAATGCTGACGCCAACGGCGCCTTCAATATCGCTAGAAAGGGCCTGATG ATCGTGGAACAAATCCAGAAAGTGGATGACATCGGCAACCTGAAGTACGCCGTAACAAACAAA GATTGGCTGACCTTCGCCCAGAAG |

TABLE S3C

Direct Repeat Group 3

| SEQ ID NO | Direct Repeat (Variant #1) | SEQ ID NO | Direct Repeat (Variant #2) |
|---|---|---|---|
| 36 | ATCTACAATAGTAGAAATTTTGGTCTATA GTTAGAC | 37 | ATCTACAATAGTAGAAATTTTGGTCTAT AGTTAGAC |
| 38 | GTCTATACTAAGACCAAAATTTCTACTAT TGTAGAT | 39 | GTCTATACTAAGACCAAAATTTCTACTAT TGTAGAT |

TABLE S3D crRNA Sequences Group 3

Figure 3A:
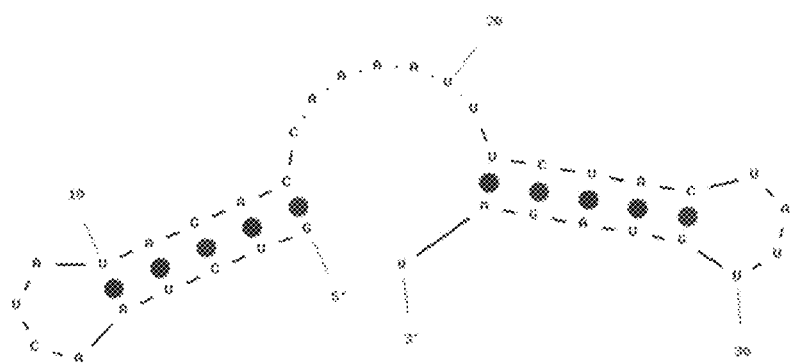
FIG. 3A-3B (SEQ ID NOs:40-41) are schemes depicting the predicted stem loop structures of crRNA sequences of the present disclosure corresponding to Group 3 sequences.
Figure 3B:
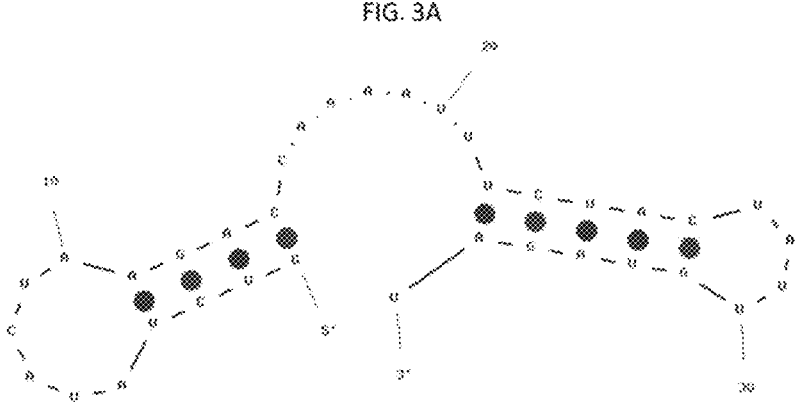

| SEQ ID NO | Sequence | FIG |
|---|---|---|
| 40 | GUCUAACUAUAGACCAAAAUUUCUACUAUUGUAGAU | FIG. 3A |
| 41 | GUCUAUACUAAGACCAAAAUUUCUACUAUUGUAGAU | FIG. 3B |

TABLE S3E

Consensus Sequence Group 3

| SEQ ID NO | Consensus Sequence of AA SEQ ID Nos: 32-33) |
|---|---|
| 42 | LCSIFAHMAINFAREIKKYYLCIINIKKILNMXXLKXFXNXYXVQKTLRFKLEPXGKTEEFIERAQXLENDERRAXEY XKVKXXIDXYHRXFIEXALSXPLLKVXSXGXXDSLEDFXDCYNNDXSEKRSDNLEKIQXKLRXQIVKGFSKXPAFX XIXKKELIXXDLXXFLXDXNEXXIVSHFXXFTTYFTGFHQNRMNMYXXEAKSTSIXFRLINQNLVKXVDNSXILEK VXPXLGXDIXXXLBXDFEPPFLNVXXALDLFKXXNYNEVJTQXQIELYNAIIGGRVDXXXXKVEIKGLNQYINEXNQT HXKXXXRJPKLKPLFKQILSEXXGVSFRXEQFXXAXQVQXAIXEXYXXLXXXXFXKLKXXJXXLXXFBLBGXXXAND XXLTDIXQRXYGAWDXXXNAXVAXXDXXXPRKKXQSQEKRDXQVKKXLKSXKSJSLXXIDXXLXDXTXXSIVDY FTXLGAXBNEXXQXENLFALIZNRYXXXXXVLDXXXPSDELLRKNIXXIKDLLDXIKDLQRFIKPLCGXGEEXXKDE XFYSDFSXLYEXLDDXITPLYNKVRSYLTXKPYXLDKFKLNFXXXXLLXXWXXNXZXXXXXIXXXXBXXYYLAIXBK NBXSXLXXXXXXIXXXDXIXXXXXXXXGDXXXXXXXXXXXXXXXXXXXXXXXXXXXXXXXXXXXXYXPXXE IXXIXXEKXFXLXXXXXXXXEXLXKXIDFYKXXXXXXXEXXXXFDFXFXXXXXXXXXXXZFXXXIXXQXYXJXXXXXXXXXJ XXLXDXGXXXXFXIXNKDFSPXSKGRPNLHTIYWXMLFDXNNLKBVXYKLNGXAEMFXRXSSIXNPVIHXAXXX IXNKSXYNKXHKXXSKFDYDIIKDRRFTRNQYEFHVPITMNFKXAGSXXFNXXXVLXFIKXKGIKHIIGIDRGERHLL YLTMIBXKGXIVEQFSLNXVASNPNNPXXKQDYNXXLXIKEGDRLXARRNWSTIENIKELKXGYLSQIVHLLSKM MIENDAILVLENLNXGFMRGRQKVEKSVYLKFEKMLIDKLNYVVDKXXXXXNEPXGALKALQLTDXYXXFNKXQ KGNVRQCGFVFYIPAWNTSKXDPXTGXVNLFDTRLSTIGEIKXFFSKFDRIXYBXXNDXFEFXFDYNNFTXRAZG TRTXWTXXXXGERIFTHRSKEXNNQFVSEXVXPTXJXKDVXXXXGXXJXGNLKEXIASJZSLXXLKQLLHAFKLXX QMRNSXTGTXVDXLJSPAIDAKGXNFDSRXXXSTXPXNADANGAXNIARKGLMIVEQIQXXDDIXNJKYXVXN XDWLXFAQX |

Wherein:
each X is independently selected from any naturally occurring amino acid.

TABLE S3F

Native Nucleotide Sequences Group 3

| SEQ ID NO | Corresponding AA | Sequence |
| --- | --- | --- |
| 43 | 32 | ATGAAGAATTTAAAGGAATTTCACAACCTGTATCCAGTACAGAAAACTCTTCGTTTTAAGTT<br>GGAGCCTATCGGAAAAACAGAGGAGTTCATTGAACGTGCACAAATCTTAGAGAATGATGA<br>GCGCCGCGCTGATGAATATCTCAAGGTTAAGGAGTATATAGACCGATATCATCGTGAGTTC<br>ATTGAGAACGCTTTAAGTCAACCTCTACTTAAGGTGGAATCGGAAGGGAAGCAGGATTCTC<br>TTGAAGATTTTGCCGACTGCTACAACAATGACAATAGCGAAAAACGCAGTGATAATCTTGA<br>AAAAATTCAAGACAAACTTAGAACGCAAATTGTCAAAGGATTCAGTAAATTACCCGCTTTTG<br>CACGAATAGCTAAAAAGGAGCTTATTAAGGAGGATTTACCCAAGTTTCTAAAAGACAAAAA<br>CGAAAAAGAAATTGTTTCGCATTTTGATGAGTTCACAACCTATTTCACTGGTTTCCATCAGAA<br>TCGCATGAACATGTATACTGCCGAAGCAAAGTCGACTTCTATAGCTTTTAGGCTTATTAACC<br>AGAACCTTGTAAAATTTGTTGACAATAGCAATATCCTTGAAAAGGTTGTTCCTGTACTTGGA<br>AAAGACATTATTGCACAACTTGATAAAGATTTTGAACCGTTCCTCAACGTTGATTCTGCTCTT<br>GATTTGTTTAAAATTGACAATTACAATGAAGTGCTTACACAATTGCAAATTGAGCTATACAA<br>CGCGATTATAGGTGGAAGAGTGGATGAGGGGAACAAAGTTGAGATTAAAGGATTGAACCA<br>GTATATCAACGAGTTTAATCAAACGCACGAAAAGTCACTAAGGATTCCAAAACTCAAACCAT<br>TGTTTAAACAAATATTGAGTGAAAATGTGGGTGTTTCATTTGAATGGAGCAATTCACCGAT<br>GCCAGCCAAGTACAAACCGCCATAAAAGAAGAATACATCAAGTTGGAGTCTAGTGTTTTTG<br>ACAAGCTAAAAGAAATGATTAAGAGTTTGCCAACATTCAACTTAAATGGTATTTATCTAGCC<br>AATGATTTGGGGCTTACCGACATATGCCAACGTTATTATGGTGCTTGGGACAAATTGAATAA<br>TGCCCTTGTCGCTGAATTTGACGCTGTTGTGCCTCGCAAGAAAACACAGTCACAGGAAAAA<br>CGTGACAACCAAGTGAAGAAGTACCTTAAAAGTGTCAAGAGCATATCTTTAGGCAAAATCG<br>ACAGCCTCTTGGCTGACGTAACAGAGAAGTCAATTGTTGACTATTTCACCAACCTGGGTGCT<br>ATCGACAATGAAACCACGCAGCGTGAGAACTTGTTTGCACTCATTCAAAACCGATATATTTC<br>TTTAAAGGAAGTTCTTGATTGCCCTACACCGTCCGACGAACTCTTGCGCAAGAAATATTGAAG<br>GCATCAAGGATTTACTTGATGCTATCAAAGACTTACAACGATTTATCAAACCGCTGTGCGGT<br>TGCGGTGAGGAACTTGATAAAGATGAGATGTTCTATAGCGATTTTTCTCCTCTTTATGAAAC<br>GCTTGACGACATCATTACTCCTCTATACAACAAGGTGAGAAGCTATCTGACAAAGAAGCCTT<br>ACAAACTTGACAAGTTCAAGCTGAATTTCGAAACTCCGACTTTATTGCAAAGTTGGCCAAAT<br>TATCAAGCATATTCTTGTGCTATTTTTAAAGAAGATGATAATCACTATTATCTAGCAATTCTT<br>GATAAGAATAATCGAAGCTGTCTTAATACTATAGTACCACCAATATCAAAAAACGATATCAT<br>TGGATTAGTTAAGCACTTACAAGGTGGTGACATGGGAAAGAACGTTCAGAACTTAATGAGA<br>ATAGATGGCAAAACAAGAAAAGTCAATGGTCGTAAAGAGACTTCTGGCCCAAATGCAGGA<br>CAAAACATACGTCTTGAGGAATCAAAAAAGACATATTTGCCACATGAAATTAATGAAATAA<br>GAATTGAAAAATCTTTTTCATTAAATAGCCCAAATTATAGGAGAGAATGCCTCAACAAGTAT<br>ATTGACTTTTATAAACCACTTGTAGAAGAGTATTATTCTGAATTTGATTTTGAATTCAAAGAA<br>GCATCTGAATATAGAGATTTCTCTCAGTTTTACCAATCACATTAATCAGCAGTCTTACCAATTA<br>AAGATTATTCCTTTTTCGAAAAAGTATCTAAAAACTCTTGTTGATAATGGTCAAGTATTTCTT<br>TTTAGAATACTAAACAAAGACTTCTCTCCTTATTCTAAAGGACGTCCTAATTTGCACACGATT<br>TACTGGAAGATGCTCTTTGATGACAACAACCTCAAGGATGTAATCTACAAGCTTAACGGCAA<br>AGCCGAGATGTTTTTCCGCAGGAGCTCTATCACGAATCCAGTAATCCATGCTGCCAACAAGG<br>AGATTGCCAACAAGAGCGCTTATACAAGCAGCACAAAGCGGTGGCAAGTTTGATTATGA<br>TATAATCAAGGATCGTCGCTTCACTCGCAACCAATATGAGTTGGTTCCATGTTCCAATAACCATGA<br>ACTTCAAATCGGCAGGAAGTGTTCGTTTCAATCAAGAAGTGTTGTCTTTCATCAAAGAGAAA<br>GGCATCAAGCATATTATTGGGATTGATAGAGGCGAGCGTCATCTTCTTTACTTAACGATGAT<br>TAACATGAAAGGAGAGATTGTGGAGCAGTTCTCGCTTAATGACGTGGCAAGCAATCCTAAT<br>AATCCTGAATATAAGCAAGATTACAATGAGTTGCTTTCAATCAAGGAAGGCGACCGACTGA<br>GCGCGCGTCGTAACTGGTCAACTATCGAGAACATCAAGGAGCTGAAATCAGGATATCTAAG<br>CCAGATTGTTCATCTCTTGTCAAAGATGATGATAGAGAATGATGCCATCTTGGTTCTTGAGA<br>ACCTTAATACAGGATTCATGAGAGGACGTCAAAAGGTTGAAAAATCGGTATATCTCAAATTT<br>GAGAAAATGCTTATTGACAAGCTCAATTATGTGGTAGACAAAACAGCTGCCCCTAATGAGC<br>CTAGTGGAGCATTGAAAGCATTGCAACTTACCGACACTTACGACAACTTCAACAAGTATCAA<br>AAGGGCAATGTGCGCCAGTGCGGTTTTGTTTTCTACATTCCAGCATGGAACACCAGCAAGA<br>CCGACCCTGTTACTGGCTACGTAAACCTATTTGACACACGACTGTCAACAATTGGTGAGATT<br>AAGTCTTTCTTCAGCAAATTTGACCGCATCAAGTATAATTCTAAAAATGACGCTTTTGAATTC<br>ACTTTCGATTACAACAACTTTACTACAAGAGCAGAAGGCACTCGCACTTGCTGGACTATAAG<br>CTCACAAGGAGAGCGCATTTTTACTCATCGCAGCAAAGAGCAGAACAATCAGTTTGTCTCTG<br>AAACAGTTCACCCAACACAAATCTTTAAGGATGTGTTCAAAATGGCTGGTTGTGAGATTAAC<br>GGCAATCTGAAAGAAGGAATTGCTTCAATCGAAAGTCTAGAACCTTTAAAGCAGCTATTGC<br>ATGCTTTTAAGCTTGTGATTCAAATGAGAAACAGCATTACTGGAACCGAAGTTGACTTCTTG<br>CTATCTCCTGCTATAGATGCTAAAGGCACGAACTTCGATTCTGAAAAGGCATTAGTACTTT<br>GCCCGAAAATGCCGATGCTAATGGCGCTTATAACATAGCTCGAAAAGGCTTGATGATTGTT<br>GAGCAAATCCAAAATGCCGATGATATTGCTAATATTAAATATTCAGTAAGCAACAATGACTG<br>GCTCAAGTTTGCGCAAGGATAA |
| 44 | 33 | CTGTGCTCGATTTTTGCACACATGGCCATTAATTTTGCGCGTGAGATAAAAAAGTATTATCTT<br>TGTATCATAAACATCAAAAAAATATTGAACATGGAATGCTTAAAAGATTTTTACAACCAGTA<br>TTCAGTCCAAAAGACTCTAAGGTTCAAGCTGGAACCTGTTGGAAAGACCGAGGAATTCATT<br>GAACGAGCGCAGGTCTTAGAGAATGATGAACGTCGAGCAGCCGAATACAAGAAAGTTAAG<br>GACCTTATCGACAACTACCACCGTTGGTTTATTGAGCAAGCACTTAGTGCCCCTTTATTGAA<br>GGTAGACAGCTGGCGACAACGATTCTTTGGAGGATTTTCAAGATTGTTACAACAACGAC<br>ACGAGTGAGAAACGCAGTGATAATCTTGAGAAAATTCAAGGTAAATTGAGGAGCCAAATC<br>GTCAAGGGATTTAGTAAGCATCCAGCCTTTAAACACATCGACAAGAAGGAACTCATCACTA<br>CCGATTTAAAACAATTCCTCACCGACCCTAACGAGATTGATATTGTTTCACATTTTGCCAATT<br>TCACTACCTATTTCACTGGATTTCATCAAAACCGAATGAACATGTATTCGGTCGAGGCTAAA<br>TCAACCTCAATTTCATTTAGGCTGATTAACCAAAATCTTGTGAAATGCGTTGACAACAGCAA |

TABLE S3F-continued

Native Nucleotide Sequences Group 3

| SEQ ID NO | Corresponding AA | Sequence |
|---|---|---|
| | | GATTCTTGAAAAAGTCAAACCAGCATTAGGTGCTGATATCTTCTCGAAACTCAATCACGATT
TTGAGCCATTCCTTAATGTAGTTGATGCTCTTGACTTGTTCAAGGTAGAGAACTACAATGAA
GTCATAACACAACCCCAAATTGAACTCTACAACGCCATCATTGGCGGACGTGTTGACAATGA
CAGCAAGGTTGAGATTAAAGGACTTAATCAGTATATAAATGAGTATAATCAAACCCATTCCA
AGCAAGAGCGTTTGCCAAAACTCAAACCCCTTTTCAAGCAAATCCTGAGCGAGCGTGAGGG
CGTTTCATTTAGAATAGAACAGTTTGAAAAAGCCAACCAAGTCCAAGATGCAATTAATGAA
GCCTACAATGATCTCCATGCTAATGTCTTTACAAAACTCAAGGACCTTCTCCTGAATTTAAGC
AGTTTTGACCTTGATGGAGTGTTTGTTGCCAACGATCAGTCTTTAACCGACATTTCGCAGCG
GCATTATGGTGCATGGGATACAGTCAAGAATGCTGTGGTAGCCTCTTACGACATGACCAAC
CCGCGCAAGAAATCTCAGTCGCAAGAAAAGCGCGACGAGCAAGTCAAGAAGCATCTCAAG
AGCATTAAGAGTCTTTCTTTGGCCACAATCGACAATATGCTTAAAGATAGCACTGGACTGTC
AATTGTAGATTATTTCACAACACTGGGGGCTGTCAACAATGAGAACTTGCAACACGAGAAT
CTATTTGCACTTATTGAGAACCGTTACAATGCAGETAGGTCTGTTCTTGACAGTGATTCGCC
AAGCGATGAATTGTTGCGAAAGAACATAACCCAAATTAAAGATTTGCTTGATTCCATCAAG
GACTTGCAGCGATTTATCAAACCTTTGTGCGGTAGTGGTGAAGAGCCATTGAAAGACGAGA
TATTCTATAGCGATTTCTCGGCACTTTACGAATCGCTCGATGACACAATAACCCCTCTTTATA
ATAAGGTAAGGAGTTACTTGACAAGGAAACCTTATTCTCTCGACAAGTTTAAACTGAATTTC
GACAACTCTCAATTGCTGGATGGCTGGGATGTAAATAAGGAAAAAGACTATCTGTCAATCC
TATTGCGCAAGAATGGCTACTATTATTTAGCCATCGCCAACAAGAACGACAAGAGCGCTTTG
TCGCAGATTAATCAATGCGATATGATTAGCGGTGATTGTTACGAGAAGCTTAACTACAAGCT
ATTGCCATCTCCCTTCAAAATGCTACCTAAAGTGTTCTTCTCTCGTAAGGGTATTGAAGTCTA
TAATCCGTCGCAAGAGATACTAGACATCTACAATGAGAAAAAGTTTCAACTGGGTGACAAG
TTTGACAAGGAGTCACTTATCAAGCTTATTGATTTCTACAAGAATGCAATACCTCAGAATGA
AAGCTGGCAATCATTTGATTTCTCTTTTGCACCATCACAGTCTTATGAGTCAATAAATGAGTT
TTATAGCGTGATTGAAAACCAGGGCTATAAAATCGATTTCAAGAAAGTGCCTTCAAGCTTAA
TCAACTTGCTTATTGATCAAGGGCTTCTCTATGTCTTCAAGATTGCCAATAAGGACTTCTCGC
CCCATTCTAAGGGTAGACCCAACCTTCACACCATCTATTGGAGAATGCTCTTTGACGAGAAC
AATCTTAAGAATGTAGTTTACAAGTTGAATGGTAGAGCCGAGATGTTTTACCGTAAAAGCTC
TATTCAGAACCCTGTCATCCACAAGGCTCACCACGATATAAAAAACAAGAGTGAGTACAAC
AAGCTTCACAAGCCTTCAAGCAAGTTTGACTACGATATCATCAAAGACCGCCGTTTCACCCG
TAACCAATATGAGTTCCATGTGCCCATCACTATGAATTTCAAACCAGCAGGTAGTGGGCAGT
TCAATCGTGACGTGCTCAAATTCATTAAGGCTAAAGGCATCAAGCACATCATTGGCATCGAC
CGCGGTGAGCGTCATCTGCTTTATCTCACCATGATTGACTTGAAAGGTCGCATTGTTGAGCA
GTTCTCGCTTAATAGTGTTGCCAGCAACCCTAATAATCCCGACTTCAAGCAGGATTATAACA
CAATGCTTGCTATCAAAGAGGGCGACCGCCTCAACGCACGTCGCAACTGGTCTACTATCGA
GAATATCAAAGAGCTCAAGCAAGGCTATCTAAGTCAAATAGTTCATCTGCTCTCGAAAATGA
TGATTGAAAATGATGCTATTCTCGTGCTTGAGAACCTCAACTCGGGATTTATGCGTGGTAGG
CAAAAAGTAGAAAAATCGGTCTATCTCAAGTTTGAGAAAATGCTTATAGACAAGCTCAACT
ATGTTGTTGACAAGGGCACTGACCTCAATGAACCATGCGGCGCTCTAAAAGCCCTGCAGCT
TACCGATAGTTATGAAAAATTCAATAAGTTTCAAAAAGGCAATGTGCGCCAATGCGGTTTCG
TGTTCTACATACCAGCCTGGAACACAAGCAAGATTGACCCGGCAACAGGTTTTGTCAATCTC
TTTGACACTCGTCTATCAACAATTGGGGAAATCAAAGCTTTCTTCAGCAAATTTGACCGCATC
TCTTATGATGCTTCCAATGATGTCTTTGAGTTCAGTTTTGATTACAACAATTTCACGTCAAGG
GCTCAAGGTACTCGCACGCGATGGACTGTTACCACCCGAGGTGAACGCATCTTTACTCATCG
AAGCAAGGAGAAGAACAATCAGTTTGTTTCTGAATTAGTTTCGCCAACCAGCCTGCTCAAG
GACGTTTTGGAAAAGACTGGCACCAACTTGCAGGGAAATCTCAAAGAGGCAATAGCTTCAT
TGCAAAGCCTTGACGAACTCAAGCAATTGCTTCATGCTTTCAAGCTCACTATGCAAATGCGA
AACAGCGTCACTGGAACCGATGTTGACTATTTGATTTCACCAGCTATAGATGCTAAGGGTAA
CAACTTCGATTCTCGTGAGTGTGACTCCACCATGCCTCTAAATGCCGACGCCAATGGGGCTT
TCAACATTGCTCGGAAAGGACTTATGATTGTTGAGCAAATCCAGAAGGTAGACGATATTGG
CAATTTAAAATATGCTGTCACCAACAAGGACTGGCTAACTTTTGCTCAAAAATGA |

D. Group 4 Type V Nuclease and Associated Sequences
(SEQ ID Nos: 45-56)

TABLE S4A

Enzyme Sequences Group 4

| SEQ ID NO | Sequence |
|---|---|
| 45 | MSNLYRNLHNFYSVQKTLRFELIPQGKTKENMEKEGILKADEHRAEIYSKVKKYCDEYHKLFIDKCLKNIRLNELN
KYYELYSVVKKDEKQKEEFIKIQEKLRKQISESFRNNNEYKGLFQKDIINIYLITMYKDDKEKIKDISEFNKFTTYFSG
YNKNRENMYSEEEKPTGIAYRLINENLPTFIENFKIYNKVIKFMPEIINKIHTDLMEYIQVEDIDEIFDINYYNEVLT
QKGIECYNIIISGKSKSNGEKIKGLNEYINEFNQKHNEKIPKLQELYKQILSDTDTASFKFDTIESDEELLNNIESYYT
KLLPVFNKINQLFAKFNKYNLDLIFINNDGTLNTISNEIYKDWSYIRNRIGERYDIEYTGKLKKDTEQYSKQKQEY
MKKQKQYSLKFLNDSLRDNYLIEYISNYIEQSKIMEKMKTDFTEVQKIESRGDTKQLIKDENSIVKIKNLLDDIKFL
QEFAKILVLKDRTIEKDAEFYSELMPYYNELKDIIPLYNKTRNYLTQKPYSTEKIKLNFECPTLLNGWDLNKEEANL
GVILLKNEKYYLGIINPYCKKIFKIQEKDSNSENNYKKMEYKLLPGPNKMLPKVFFSKSKIDEFMPSDELLEKYNK
GCHKKGKDFDINFCHELIDFYKTSLNKHKDWKKFDFKFKSTSEYNDISEFYKDVEEQGYKIEYSEYSEKYINELVD |

TABLE S4A-continued

Enzyme Sequences Group 4

| SEQ ID NO | Sequence |
|---|---|
|  | RGELYLFQIYNKDFSEYSKGRPNLHTMYWKAVFDIENIKNPVYKLNGEAEIFYRKKSLERKITHSANEPVANKNE<br>NTIKSGKPTSLFKYDLIKDKRYTVDKFQFHVPITMNFKSEKMFNINQVVNKYLKYNDDINVIGIDRGERNLLYVC<br>VIDKNEKIVYQKSLNEIVNEYKSIKYSTNYHTLLNKKEKEREIAREDWKNIENIKELKEGYMSQVIHILVELMRKYN<br>AIIVIEDLNKGFKNSRIKVEKQVYQKFEKMFIDKLNYLVFKDEPKESEGGVLNAYQLTNKFETFNKIGKQSGVLYY<br>IPAWCTSKIDPTTGFINRFYIKYENLDKSKEFINKIDDISYNSSEKLFEFDIDYSKFTDRLNETRNKWTLYTNGERIY<br>TYRNDKGEWIDKKIQLTNEFNKLFEKYSINLDNIKNEILEKANIEFFKGNNETLGFIQLFKLMVQMRNSLTGKEE<br>DNLISPVKNSNGKFFNTNEQIEGLPKDADANGAYNIARKGLMLIEQMRNTEDDKLNKIKYNITEKEWLDYVQN<br>RGM |
| 46 | MLYDNIIVNEIYGRYDMSNLYNSLHNFYPVQKTLKFELIPQGKTKENMEREGILKTDQHRAAVYKKVKKYCDEY<br>HKVFIDRCLKDLQLKELERYYELYSLTNKDDEKKEELKKIQEKLRKQISDSFKNNSEFKGLFQKDIINSYLMAMYKE<br>DEEKIKEISEFNKFTTYFSGYNKNRENMYSEEEKSSAISYRIINENLPTFIDNLRIYNKIIKLIPEIMEKIYTDLIEYIQVE<br>NINKVFNINHYNKVLTQRGIECYNIIISGKVQNEGEKIKGINEYINEFNQTHNEKIPKMQELYKQILSDTDTASFKY<br>DVIECDRDLLDNIESYGRRILQILDGTGSLLEKINDYNLDLIFINNDGILSKVSNDIYSDWSYIRNRISDIYDEKYNG<br>KLSKNTEKYFKQKQDYIKKQKCYSLKFLKQSLEDDRVIKYISSYIRETSLVERIRSSFIEVQNIKERSNEKNLIKDENSI<br>TKIKTLLDNIKLLQEFVKMLIPKDRTEEKEAKFYSELMTYYDELENVIPLYNKTRNYLTQKPYSTQKIKLNFECPTLL<br>NGWDSNKEQANLGVILLKDEKYYLGIINPYCRKIFETEEQDINSENNYKKMEYKQLPGSKMLAKVFFSKSRKDE<br>FNPSDELLKKYEKGLHKKGPNFDIQFCRELIDFYKNSLNKHEEWKKFDFKFRDTLEYNNIGEFYKEFEEQGYKIEY<br>SEYSESYINELVNRGELYLFQIYNKDFSEYSKGNPNLHTMYWKAVFDLQNIKDPIYKLNGNAEIFYRQRSLEKRIT<br>HPANTPVNNKSEETIKAGKPQSIFKYDLIKDKRYTMDKFQFNVPITMNFKSEKLLNINGIVNKYLKYNDDIYVIGI<br>DRGERNLLYVCVIDKNEKIVYQKSLNEIVNEYRNIKYSIDYHLLLDKKEKEREAAREDWKNIENIKELKEGYMSQV<br>IHVLIELMRKYNAIIVIEDLNKGFKNSRIKIEKQVYQKFEKMFIEKLNYLVFKNEVEKAEGGILNAYQLTNKFESFN<br>KIGKQSGILYYIPAWCTSKIDPVTGFINRFYIKYENLDKSKEFVNKIEDIRYNSREDLFEFDIDYGKFTDKLNDTRNK<br>WTLCSNGERIYTHKNNTGEWIDNRIQLTKEFKKLFEEYDVDLNNIKPEILQKSNIEFFKGNNENLGFMQLFKLM<br>VQMRNSLTGKDEDNLISPVKNRNGKFFDTKDQIEGLPKDADANGAYNIARKGLMLVKQMKDTEDENLNKIKY<br>NITEKEWLNYLQNRGM |

TABLE S4B

Human Codon Optimized Nucleotide Sequences Group 4

| SEQ ID NO | Corresponding AA | Sequence |
|---|---|---|
| 47 | 45 | ATGTCTAACCTGTACAGGAACCTACATAATTTCTACTCTGTACAGAAAACCCTCAGATTTGAAT<br>TGATTCCCCAGGGAAAAACCAAGGAAAACATGGAAAAGAAGGCATACTGAAGGCCGACGA<br>GCATCGGGCCGAAATCTATAGCAAGGTTAAGAAATACTGTGACGAGTATCACAAACTGTTCAT<br>AGATAAATGCCTTAAGAACATTCGGCTGAATGAGCTCAATAAGTATTACGAGTTGTACTCCGT<br>GGTAAAAAAGATGAGAAGCAGAAAGAAGAGTTCATTAAAATCCAGGAAAGCTGAGAAAG<br>CAAATTTCAGAGAGTTTCAGAAACAATAACGAGTATAAGGGCCTTTTCCAGAAGGACATCATT<br>AACATCTATCTCATTACCATGTACAAGGACGACAAAGAGAAGATCAAGGATATCAGCAGGTTT<br>AACAAATTTACCACTTACTTCAGTGGCTACAACAAAAATAGGGAGAATATGTATTCGGAGGAG<br>GAGAAACCTACCGGAATAGCTTATCGTCTGATTAACGAGAACTTGCCCACCTTTATCGAGAAC<br>TTCAAGATCTATAACAAGGTGATCAAGTTTATGCCTGAGATCATCAACAAAATCCATACAGACC<br>TGATGGAATATATCCAGGTCGAAGACATTGATGAGATCTTCGACATCAACTACTATAACGAAG<br>TGTTAACACAGAAAGGCATAGAGTGCTACAATATCATTATTTCTGGCAAGTCAAAGTCCAATG<br>GAGAAAAGATCAAAGGGCTGAATGAGTATATCAACGAATTTAACCAGAAGCACAATGAAAAA<br>ATCCCAAAGTTACAGGAACTGTACAAACAGATACTTAGCGACACAGATACAGCTAGCTTCAAG<br>TTTGATACTATAGAATCTGACGAGGAACTCCTGATAATATCGAAAGCTACTATACCAAACTG<br>CTCCCTGTTTTTAACAAAATCAATCAGCTGTTCGCAAAATTTAACAAGTATAACCTGGACCTCA<br>TTTTCATTAACAATGATGGAACTCTCAACACAATTAGCAACGAGATATACAAAGATTGGAGCT<br>ACATTCGGAATCGAATTGGTGAACGATACGATATTGAGTATACCGGGAAATTAAAGAAAGAT<br>ACGGAGCAATACAGCAAACAAAAACAGGAGTACATGAAGAAGCAAAACAGTACAGCCTTAA<br>GTTCCTGAATGACAGCCTTCGAGATAACTACTTGATAGAATACATCTCCAACTACTACATTGAGCAG<br>TCTAAGATAATGGAAAAGATGAAAACCGACTTCACCGAAGTGCAGAAGATTGAAAGCAGGG<br>GAGACACCCAAACAGTTGATAAAAGACGAAAATTCCATCGTGAAATCAAAAATCTCCTTGACG<br>ACATTAAGTTTCTACAGGAATTTGCCAAGATCCTAGTGCTTAAAGACAGAACAATCGAGAAGG<br>ATGCGGAATTTTACAGTGAATTAATGCCGTACTACAATGAGCTGAAAGACATCATACCACTGT<br>ATAATAAGACCCGCAACTACCTCACTCAGAAACCTTACTCCACTGAGAAAATTAAACTGAACTT<br>CGAGTGTCCTACACTCCTCAATGGGTGGGATCTTAATAAAGAGGAGGCTAACCTGGGAGTTAT<br>TCTCCTGAAGAACGAGAAGTATTATTTAGGCATCATAAACCCCTACTGTAAGAAGATTTTCAA<br>GATCCAAGAAAAGGATAGTAACTCAGAGAACAACTATAAGAAGATGGAATACAAGCTCTTGC<br>CCGGTCCCAATAAAATGCTGCCGAAAGTCTTTTTTTCCAAGTCCAAGATAGATGAATTCATGCC<br>ATCTGACGAGTTGTTAGAGAAATATAACAAGGGTTGCCACAAGAAGGAAAGATTTCGACA<br>TTAACTTCTGCCATGAACTGATCGATTTTATAAAACCTCCCTCAATAAGCACAAGGATTGGAA<br>AAAGTTCGACTTTAAGTTCAAGTCCACTTCGGAATACAACAAGACATCTCTGAGTTTTACAAAGAT<br>GTTGAAGAACAGGGGTACAAAATTGAGTATTCAGAGTACAGTGAGAAATACATTAACGAACT<br>GGTGGATCGCGGGGAACTTTATCGTGTTTCAAATCTACAACAAGGACTTTAGTGAGTATTCGAA<br>AGGGCGTCCAAATCTGCACACCATGTACTGGAAAGCAGTGTTCGATATCGAGAACATCAAAA<br>ATCCGGTGTATAAGCTGAACGGGGAAGCAGAAATCTTCTATAGAAAGAAATCTCTGGAGCGT<br>AAAATTACACACAGTGCTAATGAGCCAGTGGCCAATAAGAACGAAAATACAATCAAGTCTGG |

TABLE S4B-continued

Human Codon Optimized Nucleotide Sequences Group 4

| SEQ ID NO | Corresponding AA | Sequence |
|---|---|---|
| | | AAAACCTACGAGTCTTTTCAAGTACGACCTCATAAAGGATAAGCGCTATACGGTGGATAAGTT<br>TCAATTTCATGTCCCAATAACCATGAATTTCAAGTCCGAGAAAATGTTTAACATCAATCAGGTA<br>GTCAACAAGTACCTCAAATATAACGATGACATAAACGTGATCGGCATCGACCGCGGGGAGAG<br>GAATTTACTGTATGTCTGTGTCATCGATAAGAATGAGAAGATCGTTTACCAAAAGTCTCTAAAT<br>GAGATTGTCAACGAGTACAAGTCTATCAAGTATTCAACCAACTATCACACACTGCTGAACAAA<br>AAAGAGAAAGAGAGAGAGATTGCACGGGAAGACTGGAAGAACATTGAAAACATTAAGGAGT<br>TGAAGGAAGGATATATGAGCCAGGTGATTCACATCTTGGTGGAACTGATGCGGAAATACAAT<br>GCCATAATTGTAATCGAAGACCTGAATAAAGGTTTTAAGAATTCCCGGATCAAGGTGGAGAA<br>GCAGGTGTATCAGAAGTTTGAGAAGATGTTCATTGACAAGCTCAACTATTTGGTGTTTAAAGA<br>CGAACCCAAAGAGTCCGAAGGCGGCGTCCTAAATGCATATCAGCTGACAAATAAGTTCGAAA<br>CGTTCAACAAAATCGGCAAGCAATCAGGTGTGCTCTACTATATCCCCGCCTGGTGCACAAGCA<br>AGATTGATCCAACTACAGGCTTCATTAACAGGTTCTACATAAAGTACGAGAATCTAGATAAGA<br>GCAAGGAGTTCATCAATAAGATCGACGACATTTCATACAATTCCTCCGAAAAACTTTTCGAGTT<br>CGACATCGATTACTCAAAATTTACTGACCGGCTAAACGAGACGAGGAATAAGTGGACTCTTTA<br>CACTAATGGTGAGCGCATTTATACTTACAGAAATGACAAAGGAGAGTGGATTGATAAGAAGA<br>TTCAGCTGACAAATGAGTTTAACAAGCTGTTCGAGAAATATAGCATCAACCTGGATAACATCA<br>AAAATGAGATTTTGGAGAAGGCCAATATCGAATTTTTCAAGGGTAACAACGAAACCCTGGGG<br>TTTATTCAGTTGTTTAAACTGATGGTCCAAATGAGGAATTCTCTGACTGGAAAGGAGGAGGAT<br>AATCTTATTAGTCCCGTTAAGAACTCAAACGGCAAATTCTTCAATACCAATGAACAGATAGAG<br>GGCTTACCTAAAGATGCTGACGCCAATGGCGCTTATAATATCGCGCGCAAGGGGCTCATGCTG<br>ATTGAGCAAATGAGGAATACGGAAGACGATAAGCTGAACAAGATAAAGTACAACATCACTGA<br>GAAAGAATGGCTCGACTACGTTCAGAATCGAGGGATGTGA |
| 48 | 46 | ATGCTGTACGACAACATCATTGTGAACGAGATCTACGGCAGGTACGACATGAGCAATCTGTAC<br>AACAGCCTGCACAACTTCTATCCCGTCCAGAAGACTCTTAAGTTCGAACTGATACCTCAGGGG<br>AAGACCAAGGAGAACATGGAGAGAGGGCATTCTGAAGACCGACCAGCACCGGGCCGCAG<br>TGTATAAGAAGGTGAAGAAATACTGTGACGAATACCACAAAGTGTTCATCGATAGATGCCTG<br>AAAGACCTTCAGCTGAAAGAGTTGGAGCGCTATTACGAGCTGTACAGCCTGACCAATAAGGA<br>CGACGAGAAGAAAGAGGAGCTGAAGAAGATTCAGGAAAAACTGCGCAAACAGATCAGCGAT<br>AGCTTTAAGAACAATAGTGAGTTCAAGGGCCTGTTCCAGAAGGATATCATCAATTCTTATCTG<br>ATGGCCATGTACAAGGAGGACGAGGAAAAGATCAAGGAGATTTCCGAGTTTAACAAGTTCAC<br>CACTTATTTTTCTGGGTACAATAAAAATCGCGAGAACATGTATTCAGAAGAGGAGAAGTCTAG<br>CGCTATCAGCTATAGGATCATCAACGAGAACCTGCCCACCTTTATCGACAACCTGCGGATCTAT<br>AACAAAATTATCAAACTGATTCCCGAGATCATGGAGAAGATCTATACCGACCTGATCGAGTAC<br>ATCCAGGTGGAGAACATCAATAAAGTGTTCAATATTAACCACTACAATAAGGTGCTGACCCAG<br>CGGGGGATCGAATGCTACAATATCATCATCAGTGGAAAGGTGCAGAACGAGGGCGAGAAGA<br>TCAAGGGCATCAACGAATACATTAACGAATTCAACCAGACCCATAATGAAAAGATCCCAAAAA<br>TGCAGGAACTGTACAAACAGATCCTGAGTGATACAGACACCGCTTCTTTCAAGTACGACGTGA<br>TCGAGTGTGATAGGGACCTGCTGGACAACATCGAGTCGTATGGAAGGAGGATCCTGCAGATC<br>CTGGACGGAACAGGCAGCCTGCTCGAGAAGATCAATGACTATAACCTCGACCTGATCTTCATT<br>AATAATGATGGCATCCTGTCCAAAGTTAGCAACGATATTTATTCCGATTGGAGCTACATCAGA<br>AATCGCATTTCCGACATCTACGATGAGAAGTATAACGGTAAGCTGAGCAAAAACACCGAAAA<br>ATACTTCAAACAGAAGCAGGATTACATCAAGAAACAGAAGTGCTACAGCCTGAAATTTCTAAA<br>GCAGAGCCTGGAGGATGATAGGGTGATCAAATACCATCTCTTCCTACATCAGGGAGACCTCACT<br>GGTGGAGAGGATCAGAAGCAGCTTTATCGAGGTGCAGAACATTAAAGAGAGATCAAACGAA<br>AAGAATCTGATCAAGGACGAGAATAGCATCACAAAGATCAAGACCCTGCTGGACAACATCAA<br>GCTGCTGCAGGAGTTCGTGAAGATGCTGATCCCAAAGGACAGAACCGAGGAGAAGGAGGCC<br>AAATTCTACTCTGAGCTGATGACATACTACGATGAGCTGGAGAACGTGATCCCACTGTACAAT<br>AAGACCAGAAATTACCTGACACAGAAGCCCTACTCTACTCAGAAGATCAAGCTGAACTTTGAG<br>TGCCCAACACTGCTGAATGGCTGGGACAGCAATAAAGAACAGGCTAACCTGGGCGTTATCCT<br>GCTCAAGGACGAGAAGTACTATCTGGGCATCATCAACCCATACTGCCGGAAGATCTTCGAGAC<br>AGAGGAACAGGACATCAACTCCGAGAACAACTACAAGAAGATGGAATATAAGCAGCTGCCCG<br>GCTCAAAGATGCTGGCCAAGGTGTTCTTCTCCAAGAGCCGGAAAGACGAGTTTAACCCCAGT<br>GACGAGCTGCTGAAGAAGTACGAAAAGGGCCTCCACAAAAAGGGGCCCAACTTCGATATTCA<br>GTTTTGTAGGGAGCTGATCGATTTTTACAAGAATAGCCTGAATAAGCACGAAGAATGGAAGA<br>AGTTTGACTTTAAGTTTCGCGACACCCTGGAGTATAACAACATCGGGGAGTTTTACAAGGAGT<br>TCGAGGAGCAGGGCTATAAGATTGAATACTCTGAATATAGCGAATCCTACATTAACGAACTGG<br>TGAACAGGGGCGAGCTGTATCTGTTCCAGATCTACAATAAGGATTTTTCTGAATATTCCAAGG<br>GCAACCCCAATCTCCACACCATGTACTGGAAGGCTGTGTTTGACCTGCAGAACATCAAGGATC<br>CCATCTATAAACTGAACGGCAACGCCGAAATCTTTTATAGGCAGCGGTCACTGGAAAAAAGAA<br>TCACCCACCCCGCTAACACCCCAGTGAACAACAAAGCGAGGAGACCATCAAAGCCGGAAAG<br>CCCCAGTCTATCTTTAAGTATGACCTCATCAAGGATAAGCGGTACACCATGGACAAGTTCCAG<br>TTCAATGTGCCCATCACCATGAATTTCAAGTCCGAGAAGCTGCTGAACATCAACGGCATCGTG<br>AATAAGTATCTGAAATACAACGACGACATCTACGTGATTGGAATCGATAGAGGCGAGCGCAA<br>TCTGCTGTATGTGTGTGTTATCGACAAGAACGAGAAAATCGTCTACCAGAAGAGCCTGAACGA<br>GATCGTGAACGAATACAGAAATATTAAGTACTCCATCGACTACCATCTGCTGCTGGACAAGAA<br>GGAAAAGGAAAGGGAGGCTGCCCGGGAAGACTGGAAAAATATCGAGAATATCAAGGAACTG<br>AAGGAAGGATACATGAGCCAGGTTATCCACGTGCTCATCGAGCTGATGAGGAAGTACAACGC<br>TATCATTGTGATCGAGGACCTGAATAAGGGCTTCAAAAACAGCCGAATTAAGATCGAAAAAC<br>AGGTGTATCAGAAGTTCGAGAAGATGTTTATTGAAAAACTGAACTACCTGGTGTTCAAGAACG<br>AAGTGGAAAAGGCCGAAGGCGGGATCCTGAACGCCTACCAGCTGACCAATAAGTTTGAATCC<br>TTTAATAAGATCGGCAAGCAGAGCGGCATCCTGTACTACATCCCTGCCTGGTGTACCAGCAAA<br>ATCGATCCAGTGACCGGCTTCATCAACAGATTCTACATTAAGTATGAGAATCTGGACAAGAGC<br>AAAGAGTTCGTGAACAAGATCGAAGATATTAGATATAATAGCCGGGAGGACCTGTTCGAATT |

TABLE S4B-continued

Human Codon Optimized Nucleotide Sequences Group 4

| SEQ ID NO | Corresponding AA | Sequence |
|---|---|---|
| | | CGACATCGATTATGGCAAGTTTACCGACAAGCTTAACGACACCCGGAACAAATGGACACTGTG<br>CAGTAATGGAGAGAGAATCTACACCCATAAGAACAATACAGGAGAGTGGATCGACAACAGA<br>ATCCAGCTGACCAAAGAGTTTAAAAAGCTGTTCGAGGAGTACGACGTGGACCTGAACAATAT<br>TAAACCTGAGATCCTGCAGAAGTCTAACATCGAGTTCTTCAAGGGCAACAACGAGAACCTGG<br>GCTTCATGCAACTGTTCAAGCTGATGGTGCAGATGCGAAATAGCCTCACCGGCAAGGACGAG<br>GATAATCTGATTAGCCCCGTGAAGAATAGGAACGGCAAGTTCTTTGACACCAAAGACCAGATC<br>GAGGGACTGCCCAAGGACGCCGACGCCAACGGCGCCTACATATTGCCCGGAAGGGCCTGAT<br>GCTGGTGAAGCAGATGAAGGACACAGAGGACGAGAATCTGAATAAAATTAAATACAACATCA<br>CCGAGAAAGAGTGGCTGAACTATCTGCAGAATAGAGGCATGTGA |

TABLE S4C

Direct Repeat Group 4

| SEQ ID NO | Direct Repeat (Variant #1) | SEQ ID NO | Direct Repeat (Variant #2) |
|---|---|---|---|
| 49 | GTTTAATACCTTATATAAATTTCTACTATTGTAGAT | 50 | TTTAATACCTTATATAAATTTCTACTATTGTAGAT |
| 51 | GTTTAATACCTTATATAAATTTCTACTATTGTAGAT | 52 | TTTAATACCTTATATAAATTTCTACTATTGTAGAT |

TABLE S4D crRNA Sequences Group 4

Figures 4A, 4B:
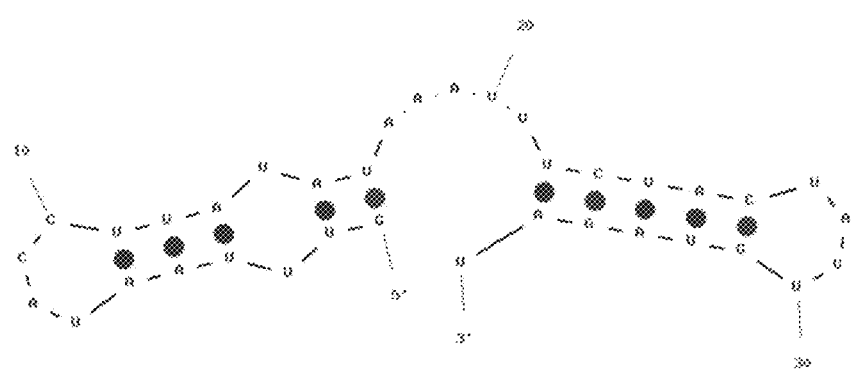
FIG. 4A-4B (SEQ ID NOs:53-54) are schemes depicting the predicted stem loop structures of crRNA sequences of the present disclosure corresponding to Group 4 sequences.

| SEQ ID NO | Sequence | FIG |
|---|---|---|
| 53 | GUUUAAUACCUUAUAUAAAUUUCUACUAUUGUAGAU | FIG. 4A |
| 54 | GUUUAAUACCUUAUAUAAAUUUCUACUAUUGUAGAU | FIG. 4B |

E. Group 5 Type V Nuclease and Associated Sequences (SEQ ID Nos: 57-72)

TABLE S5A

Enzyme Sequences Group 5

| SEQ ID NO | Sequence |
|---|---|
| 57 | MKEQFINRYSLSKTLRFSLIPVGETENNFNKNLLLKKDKQRAENYEKVKGYIDRFHKEYIESVLSKARIEKVNEYANL<br>YWKSNKDDSDIKAMESLENDMRKQISKQLKSNARYKRLFGKELICEDLPSFLTDKDERETVECFRSFTTYFKGENT<br>NREMNYSSDEKSTAIAYRCINDNLPRFLDNVKSFQKVFDNLSDETITKLNTDLYNIFGRNIEDIFSVDYFEFVLAQSG<br>IEIYNSMIGGYTCSDKTKIQGLNEYINLYNQQISKNEKSKRLPLIKPLYKQILSEKDSVSFIPEKFNSDNEVLLAIDDYY<br>NNHIGDFDLLTELLQSLNTYNANGIFVKSGVAITDISNGAFNSWNVLRSAWNEKYEALHPVTSKTKIDKYIEKRDK<br>VYKAIKSFSLFELQSLGNENGNEITDWYISSINESNRKIKEAYLQAQELLKSDYEKSYNKRLYKNEKATESVKNLLDTI<br>KEFQKLIKPLNGTSKEENKDELFYGKFTSLYDSVADIDRLYDKVRNYITQKPYSKDKIKLNFDNPTFLNGWALGNEF<br>ANSAQLLRDGDNYYLAIMDKELKNNIPKKYNSPTNEEDMLQKIIYQQAANPANDIPNLLVIDGVTVKKNGRKEKT<br>GIHAGENIILENLRNTYLPDNINRIRKEKTFSTSSENFSKDDLCEYIQYYICRVQEYYSSYNFTFKNASEYKNFPEFSDD<br>VNSQAYQISYDNISKKQIMELVDNGYIYLFQIYNKDFSKYSKGTPNLHTLYFKMLFDERNLSNVVYKLNGEAEMFY<br>REASIGDKEKITHYANQPIENKNPDNKKKESVFEYDIVKDKRFTKRQFSLHVPITINFKAHGQEFLNYDVRKAVKYK<br>DDNYVIGIDRGERNLIYISVIDSNGKIVEQMSLNEIISDNGHKVDYQKLLDTKEKERDKARKNWTSVENIKELKEGYI<br>SQVVHKICELVVKYDAVIAMEDLNFGFKRGRFPVEKQVYQKFENMLISKLNLLIDKKADPTENGGLLRAYQLTNKF<br>DGVNKAKQNGIIFYVPAWDTSKIDPATGFVNLLKPKCNTSMPEAKKLFETIDDIKYNTNTDMFEFYIDYSKFPRCN<br>SDFKKSWTVCTNSSRILTFPNKEKNNMWDNKQIVLTDEFKSLFNEFGIDYKGNLKSSILSISNADFYRRLIKLLSLTL<br>QMRNSITGSTLPKDDYLISPVANKNGEFYDSRNYKGTNAALPCDADANGAYNIARKALWAINVLKDTPDDMLN<br>KAKLSITNAEWLEYTQK |

TABLE S5A-continued

Enzyme Sequences Group 5

| SEQ ID NO | Sequence |
|---|---|
| 58 ID414 | MKEQFINCYPLSKTLRFSLIPVGKTEDNFNKKLLLESDKQRAENYENVKSYIDRFHKEYIKSALANARIEKINEYAALY WKNNKDDSDAKAMESLEDDIRKQISKQLTSTANFKRLFGKELICEDLPAFLTDENEKETVECFRSFTTYFNGFNTN RKNMYSSEKKSTAIAYRCVNDNLPRFLDNIKTFQKIFDNLSDETITKLNTDLYNIFGRKIEDIFSVDYFDFVLTQSGIDI YNYMIGGYTCSDGTKIQGLNECINLYNQQVAKNEKSKRLPLMKPLRKQILSEKDSVSFIPEKFNSDNEVLLAIEEYY NNHISDIDSLTELLQSLNTYNANGIFIKSGAAVSDISNAAFNSWNVLRLAWNEKYEALHPVTSTTKIDKYIEKRDKV YKSIKSFSLFELQELGAENGNEITDWYISSINECNRKIKETYLQARELLESDYEKDYDKRLYKNEKATELVKNLLDAIKE FQQLVKLLNGTGKEENKDELFYGKFTSLYDSVADIDRLYDKVRNYITQRPYSKDKIKLNFDNPQLLGGWDKNKESD YRTVILRKNDFYYLAVMDKSHSKVFVNAPEITSEDEDYYEKMEYKLLPGPNKMLPKVFFASRNIDKFQPSDRILDIR KRESFKKGATFNKSECHEFIDYFKESIKKHDDWSKFGFEFSPTESYNDISEFYREVSDQGYYISFSKISKNYIDKLVEN GYLYLFKIYNKDFSKYSKGTPNLHTLYFKMLFDERNLSNVVYKLNGEAEMFYREASINDKEKITHHANQPIKNKNP DNEKKESVFEYDIVKDKRFTKRQFSLHVSVTINFKAHGQEFLNYDVRKAVKYKDDNYVIGIDRGERNLIYISVINSN GEIVEQMSLNEIIGDNGYSVDYQKLLDKKEKERDKARKNWTSVENIKELKEGYISQVVHKICELVVKYDAVIAMED LNFGPKRGRFPVEKQVYQKFENMLISKLNLLIDKKAEPTETGGLLRAYQLTNKFDGVNKAKQNGIIFYVPAWDTSK IDPVTGFVNLLKPKYTSVREAKKLFETIDDIKYNTNTDMFEFCIDYGKFPRCNSDFKKTWTVCTNSSRILSFRNEKKN NEWDNKQIVLTDEFKSLFNEFGIDYTSDLKASILSISNADFYNRLIRLLSLTLQMRNSIIGSTLPEDDYLISPVANDRG EFYDSRNYKGSNAALPCDADANGAYNIARKALWAINVLKDTPDDMLQKAKLSITNAEWLEYTQR |
| 59 | MKEQFINCYPLSKTLQFSLIPVGKTDDNFNKKLLLERDKQRAENYEKVKGYIDRFHKEYIESVLVNARVEKIDEYADL YWKSNKDDSDAKAMESLENDMRKQISKQLKSNARYKRLFGKELICEDLPSFLTDKEERETVECFRSFTTYFKGLNT NRENMYSSDEKSTAISYRCINDNLPRFLDNVKSFQKVFDNLSDETITKLNTDLYNTFGRNIEDVFSVDYFEFVLAQS GIDIYNSMIGGYTCSDGTKIQGLNECINLYNKQDAKNEKSKRLPLMKPLYKQILSEKDSVSFIPEKFNSDNEVLLSIE DYYSSHIGDLDLLTELLQSLNTYNANGIFVKSGAAVSDISNGAFNSWNVLRLAWNEKYEALHPVTSKTNLDNYIEK RDKIYKAIKSFSLFELQSLGNENGNEITDWYISSSKECNSKIKEAYLQARELLKSDYEKSYNKRLSKNGKATQSIKNIL DAIKDFPHHLVKSLNCTGKEENKDELFYGKLTSYYDSITDIDRLYKVRNYITQKPYSKDKIKLNFDNPQLLGGWDKN KESDYRTVLLRKDDFYYLAVMDKLHSKAFVDAPNITSKDEDYYEKMEYKLLPGPNKMLPKVFFAAKNIDTFQPSD RILDIRKRESFKKGATFNKSECHEFIDYFKNSIEKHYDWSQFGFEFTPTENYNDISEFYREISDQGYSVSFNKISKSYV DELVDNGYIYLFQIYNKDFSKYSKGTPNLHTLYFKMLFDERNLSNVVYKLNGEAEMFYREASINDKEKITHQANQP IENKNPDNEKKESTFEYDIIKDKRFTKRQFSLHVPITINFKAHGQEFLNYDVRKAVKYKDDNYVIGIDRGERNLIYISV IDSNGKIVEQMSLNEIISDNGHRVDYQKLLDTKEKERDKARKNWTSVENIKELKEGYISQVVHKICELVVKYDAVIA MEDLNFGFKRGRFPVEKQVYQKFENMLISKLNLLIDKKADPTEDGGLLRAYQLTNKFDGVNKAKQNGIIFYVPA WDTSKIDPVTGFVNLLKPKYTSVSEAKKLFETIDDIKYNANTDMFEFCIDYGKFPRCNSDYKNTWTVCTNSSRILTC RNKEKNNMWDNKQIVLTDEFKSLFGEFGIDYKGNLKTSILSISNADFYRRLIKLLSLTLQMRNSITGSTLPEDDYLIS PVANDRGEFYDSRNYKGMNAALPCDADANGAYNIARKALWAINVLKSTPDDMLNKANLSITNAEWLEYTQK |

TABLE S5B

Human Codon Optimized Nucleotide Sequences Group 5

| SEQ ID NO | Corresponding AA | Sequence |
|---|---|---|
| 60 | 57 | ATGAAAGAGCAATTCATCAACCGCTACTCCCTGTCGAAAACCCTGCGCTTTTCTTTGATACCAGT GGGGGGAGACGGAGAACAATTTCAATAAGAACTTGCTGCTGAAGAAGGACAAGCAACGGGCGG AAAACTACGAGAAGGTGAAGGGATACATTGACCGGTTTCACAAAGAGTATATAGAATCCGTGC TGTCAAAGGCCAGGATCGAGAAGGTGAACGAGTATGCCAATTTGTATTGGAAGAGTAACAAAG ACGATAGCGATATCAAGGCAATGGAGAGTTTGGAGAACGACATGAGGAAACAAATCTCTAAGC AGCTGAAATCCAATGCCCGCTATAAGCGACTGTTCGGGAAAGAATTAATATGTGAGGATCTGCC AAGTTTTCTGACAGACAAGGATGAGAGAGAAACAGTCGAATGTTTTCGCTCATTCACCACCTAC TTTAAAGGATTTAACACCAATAGGGAGAATATGTATTCCTCTGATGAGAAAAGTACCGCCATCG CTTACCGTTGCATCAATGATAATCTACCACGGTTCCTTGACAATGTAAAGAGTTTCCAGAAAGTC TTCGATAACCTCTCTGATGAGACTATTACTAAACTTAACACCGACCTGTATAACATTTTTGGACGC AATATAGAGGACATTTTTTCCGTGGACTATTTCGAATTCGTGCTCGCTCAGAGCGGTATCGAAAT TTATAATAGCATGATTGGAGGCTACACTTGTTCAGACAAAACTAAAATCCAGGGCCTCAACAG TACATCAACTTATACAATCAACAGATCAGCAAGAATGAGAGTCAAAAAGGCTGCCCCCTTATTA AACCTCTGTACAAGCAGATTCTTTCTGAAAAGGATTCCGTTAGCTTCATTCCCGAGAAATTTAAT TCGGACAACGAGGTACTCCTGGCCATCGACGATTATTATAATAATCATATCGGCGACTTCGACCT GCTGACGGAACTCCTACAGAGCCTCAACACGTACAACGCCAATGGGATATTTGTGAAGTCTGGC GTGGCTATCACTGATATCTCTAATGGTGCCTTTAATTCATGGAACGTCCTGCGGTCAGCTTGGAA TGAGAAATATGAGGCGCTTCACCCAGTGACTAGCAAGACCAAAATCGACAAATACATTGAGAA GAGAGACAAAGTCTATAAAGCCATCAAAAGCTTTAGCCTGTTTGAACTGCAGTCCCTCGGGAAT GAAAATGGCAATGAGATAACTGACTGGTATATCAGTAGCATTAACGAGTCCAACAGGAAAATC AAGGAAGCGTATTTGCAGGCCCAGGAACTCCTGAAGTCTGACTACGAAAAAAGCTACAATAAG AGGCTTTACAAGAACGAAAAGGCAACTGAGAGCGTCAAAAACCTTTTGGATACCATAAAAGAG TTCCAGAAGCTGATTAAGCCATTGAATGGCACATCAAAGGAAGAGAACAAAGATGAGCTGTTTT ATGGTAAATTCACGTCCCTATACGATTCCGTGGCTGACATAGACCGGCTGTACGACAAGGTTCG AAATTACATCACCCAGAAGCCCTACTCTAAGGATAAGATCAAGCTGAACTTTGACAACCCTACCT TCCTGAATGGCTGGGACACTGGGGAACGAGTTCGCTAATAGCGCTCAACTGTTAAGAGACGGTG ACAACTACTACCTCGCAATTATGGACAAGGAGCTGAAAAATAACATTCCGAAGAAGTACAACAG CCCAACAAACGAGGAGGATATGTTACAGAAAATCATTTACCAGCAAGCCGCCAACCCTGCAAAC GATATTCCCAATCTACTCGTAATAGATGGTGTGACCGTGAAAAAGAACGGCCGCAAGGAGAAG |

TABLE S5B-continued

Human Codon Optimized Nucleotide Sequences Group 5

| SEQ ID NO | Corresponding AA | Sequence |
|---|---|---|
| | | ACCGGCATTCATGCAGGCGAAAATATCATTCTGGAGAACTTGAGGAACACTTATCTTCCCGATA<br>ATATTAACCGGATACGTAAGGAGAAAACATTTTCAACGAGCAGTGAAAACTTTAGCAAAGACG<br>ATCTGTGCGAGTACATCCAATACTATATTTGTAGAGTTCAGGAGTACTATTCCTCCTATAACTTCA<br>CTTTTAAGAACGCCTCCGAGTATAAAAATTTTCCCGAGTTTAGTGATGACGTGAATTCTCAGGCA<br>TACCAGATTAGCTATGACAACATAAGCAAGAAACAGATTATGGAGCTTGTTGACAATGGCTATA<br>TTTACCTCTTCCAGATCTACAACAAAGATTTCAGCAAATACTCCAAGGGGACACCAAACCTGCAC<br>ACTCTATATTTCAAGATGCTGTTTGATGAGCGTAATCTGTCCAATGTCGTTTACAAGCTTAACGG<br>CGAAGCTGAAATGTTCTACAGAGAAGCCAGTATTGGGGACAAAGAGAAGATTACCCACTACGC<br>TAATCAACCTATAGAGAACAAGAATCCTGATAACAAGAAGAAAGAGTCTGTTTTTGAGTATGAC<br>ATCGTTAAGGACAAGCGATTTACGAAGCGCCAATTCAGCCTTCATGTCCCCATAACAATTAACTT<br>CAAGGCTCATGGACAGGAATTCCTCAACTATGATGTGCGAAAAGCCGTCAAGTACAAGGATGA<br>TAACTATGTGATCGGAATTGACCGTGGCGAGAGAAACTTAATATACATCAGTGTTATCGACTCG<br>AACGGGAAATCGTGGAACAAATGTCGCTGAACGAAATCATTAGTGACAATGGACACAAGGTG<br>GATTATCAGAAGCTCTTGGATACAAAGGAAAAGGAAAGGGATAAGGCTCGCAAAAATTGGACA<br>TCTGTCGAAAACATCAAAGAACTAAAGGAAGGTTACATCTCTCAGGTGGTGCACAAGATCTGCG<br>AATTAGTCGTTAAATACGATGCTGTAATTGCAATGGAAGACCTGAATTTTGGGTTTAAACGGGG<br>AAGATTTCCTGTGGAAAAACAGGTGTATCAGAAATTCGAGAACATGCTCATCTCCAAACTGAAC<br>CTTCTCATCGACAAGAAAGCGGATCCCACTGAGAATGGAGGATTACTCCGGGCCTACCAGCTGA<br>CAAATAAGTTTGACGGCGTCAATAAGGCTAAGCAGAACGGAATCATCTTCTATGTACCCGCCTG<br>GGATACATCAAAGATTGACCCGGCCACAGGATTCGTGAATCTGTTGAAACCGAAATGCAACACA<br>TCTATGCCTGAAGCCAAGAAGCTCTTCGAAACAATTGACGACATTAAGTACAACACTAATACCG<br>ACATGTTCGAATTTTACATTGATTACTCCAAGTTCCCTCGCTGCAATTCAGATTTCAAAAAATCAT<br>GGACCGTATGCACAAATTCTAGTAGAATCCTGACCTTCCCTAATAAGGAGAAAAACAACATGTG<br>GGACAATAAACAGATCGTGCTGACAGATGAATTCAAGTCCTTATTCAACGAGTTTGGGATCGAT<br>TATAAAGGCAACCTGAAGTCAAGCATCCTCAGTATTTCAAATGCTGATTTCTACAGGAGGCTCAT<br>CAAACTCCTGTCTTTGACTCTTCAGATGCGAAATTCTATAACCGGGTCGACTCTGCCAAAGGACG<br>ATTATCTAATCTCCCCGTCGCAAATAAGAACGGGGAGTTCTACGACAGCCGGAACTATAAAGG<br>CACCAACGCGGCCTTGCCATGTGATGCCGACGCCAACGGTGCTTACAATATCGCCAGAAAGGCA<br>CTTTGGGCGATAAATGTGCTCAAGGATACCCCCGACGATATGTTGAATAAGGCAAAATTGTCCA<br>TCACCAACGCAGAATGGCTGGAGTATACCCAAAAATGA |
| 61 | 58 | ATGAAGGAACAATTCATCAATTGCTACCCCCTGAGCAAAACACTGAGATTCAGCCTGATCCCCGT<br>CGGAAAAACAGAGGACAATTTCAACAAAAAGTTGTTGCTGGAAAGCGATAAGCAGAGAGCCG<br>AAAACTACGAGAACGTGAAAAGCTACATCGATCGATTCCACAAGGAGTACATCAAGAGCGCCC<br>TGGCCAATGCTAGAATCGAGAAGATCAATGAATACGCCGCTCTGTACTGGAAGAACAACAAGG<br>ATGATAGTGATGCCAAGGCCATGGAGAGCCTCGAGGACGACATCCGCAAGCAGATCTCTAAAC<br>AGCTGACTAGCACCGCCAATTTCAAGAGACTGTTTGGGAAGGAGCTGATCTGCGAGGACCTGC<br>CGGCCTTTCTGACTGATGAGAACGAGAAGGAAACCGTGGAATGCTTCAGAAGCTTCACCACGTA<br>CTTTAACGGCTTCAACACCAACAGAAAGAATATGTACTCTAGCGAGAAGAAGTCCACAGCCATC<br>GCCTATAGATGCGTGAACGATAATCTGCCTAGATTTCTGGACAATATCAAGACATTCCAGAAGA<br>TCTTCGACAACCTGTCCGATGAGACAATCACAAAGCTGAATACAGATCTGTACAATATCTTCGGC<br>AGAAAGATCGAAGACATTTTTAGCGTGGACTATTTCGATTTCGTACTGACCCAGTCCGGCATTG<br>ACATCTACAACTACATGATCGGCGGATACACCTGCAGCGACGGCACCAAAATTCAGGGCCTAAA<br>TGAGTGTATCAACCTGTATAACCAGCAGGTGGCCAAGAATGAGAAAAGCAAGCGCCTGCCTCT<br>GATGAAGCCACTGAGAAAGCAGATCCTGTCTGAAAAAGATTCTGTGTCTTTCATCCCCGAAAAG<br>TTCAACAGCGACAACGAGGTGCTGCTCGCCATCGAAGAGTATTACAACAACCACATCTCCGACA<br>TCGACAGCCTGACCGAGCTGCTGCAGAGCCTGAATACCTACAACGCCAACGGCATCTTCATCAA<br>ATCAGGCGCCGCCGTGTCAGACATCAGCAACGCCGCTTTTAACAGCTGGAACGTGCTGAGGCT<br>GGCCTGGAACGAAAAGTACGAGGCCCTGCATCCTGTGACCAGCACCACCAAGATCGACAAATA<br>CATCGAGAAAGGGACAAGGTGTACAAGAGCATCAAGTCCTTCAGCCTGTTCGAGCTGCAAGA<br>GCTGGGAGCTGAGAACGGCAACGAGATCACCGACTGGTACATCTCCAGCATCAACGAGTGCAA<br>CAGAAAAATAAAAGAAACCTACCTGCAGGCCAGAGAGCTGCTGGAGAGCGACTATGAGAAGG<br>ACTATGATAAACGGCTGTACAAAAACGAAAAGGCCACAGAGCTGGTGAAGAATCTGCTGGACG<br>CCATCAAGGAATTTCAGCAACTGGTGAAGCTCCTGAACGGTACAGGCAAGGAGGAAAACAAGG<br>ATGAGCTCTTTTACGGCAAGTTCCACATCTCTCTACGACAGCGTTGCCGATATCGATAGACTTTAC<br>GACAAAGTGCGGAACTACATTACACAGCGGCCTTACTCTAAGGACAAAATCAAGCTGAACTTCG<br>ACAACCCCCAGTTGCTGGGCGGATGGGATAAAAACAAGGAAAGCGACTACAGAACCGTGATCC<br>TGAGGAAGAACGACTTTTATTACCTGGCTGTGATGGACAAAAGCCACAGCAAGGTGTTCGTGA<br>ACGCCCCTGAGATCACCAGCGAAGATGAGGACTACTACGAGAAGATGGAATATAAGCTGCTGC<br>CAGGCCCCAATAAGATGCTGCCTAAGGTGTTCTTCGCCTCCCGGAATATCGACAAGTTCCAGCCT<br>AGCGACCGCATCCTGGATATTCGGAAGCGGGAATCTTTTAAGAAGGGCGCCACCTTCAACAAGT<br>CCGAATGCCACGAGTTTATCGACTACTTCAAGGAATCAATTAAGAAGCACGACGACTGGTCCAA<br>GTTCGGCTTTGAGTTCTCTCCTACCGAGAGCTACAACGATATCAGTGAGTTCTACAGAGAGGTG<br>AGCGATCAGGGCTACTACATCAGCTTCAGCAAGATCAGTAAGAACTACATCGACAAACTTGTGG<br>AGAATGGCTACCTGTACCTGTTTAAAATCTACAACAAGGACTTCAGCAAATACTCCAAGGGCAC<br>ACCTAACCTGCATACCCTGTACTTCAAGATGCTGTTCGACGAGCGGAACCTCAGCAACGTGGTCT<br>ACAAACTGAACGGAGAGGCCGAGATGTTCTACGAGAAGCTAGCATTAACGACAAGGAAAAG<br>ATCACCCACCACGCCAACCAGCCTATCAAGAACAAGAATCCTGATAACGAGAAAAAGGAAAGC<br>GTGTTTGAGTACGACATCGTGAAGGATAAGAGATTCACCAAGCGCAGTTCAGCCTGCACGTG<br>TCTGTCACAATCAATTTCAAAGCCCACGGACAGGAGTTCCTGAACTACGACGTGCGGAAGGCTG<br>TGAAGTACAAGGACGACAACTACGTGATCGGCATCGATAGGGCGAGAGAAACCTGATCTACA<br>TCAGCGTTATCAACAGCAACGGCGAGATCGTGGAACAGATGAGCCTGAACGAAATCATTGGCG<br>ACAACGGCTACTCTGTGGACTATCAGAAGCTGCTGGACAAGAAAGAGAAGGAAAGAGATAAG<br>GCGAGAAAGAATTGGACCTCCGTCGAGAACATCAAGGAACTGAAGGAGGGCTACATCAGCCA |

TABLE S5B-continued

Human Codon Optimized Nucleotide Sequences Group 5

| SEQ ID NO | Corresponding AA | Sequence |
|---|---|---|
| | | GGTGGTGCACAAGATATGTGAACTGGTGGTGAAGTACGATGCCGTGATCGCCATGGAAGATCT<br>GAACTTCGGATTCAAAAGAGGCAGATTCCCCGTGGAAAAGCAAGTGTACCAGAAGTTCGAAAA<br>CATGCTGATCAGCAAGCTGAACCTGCTGATTGACAAGAAAGCAGAGCCTACAGAGACCGGCGG<br>CCTGCTGCGGGCCTACCAACTGACAAACAAGTTCGACGGCGTGAACAAAGCCAAGCAGAACGG<br>CATCATCTTCTACGTGCCTGCCTGGGACACCTCTAAGATCGACCCTGTGACTGGCTTCGTGAACC<br>TGCTGAAGCCCAAGTATACCTCGGTGCGGGAGGCCAAGAAGCTGTTCGAGACCATCGACGATA<br>TCAAGTACAACACCAACACAGACATGTTCGAGTTCTGCATCGATTACGGCAAATTCCCTAGATGT<br>AACAGCGACTTCAAGAAACCTGGACAGTGTGCACCAACTCTAGCCGGATCCTGAGCTTCAGAA<br>ACGAAAGAAAAACAACGAGTGGGACAACAAGCAAATCGTCCTGACCGACGAATTCAAGTCTC<br>TGTTCAACGAGTTTGGCATCGATTACACCTCGGACCTGAAAGCTAGCATCCTGTCTATCAGCAAC<br>GCTGACTTCTACAATAGACTGATCCGGCTGCTATCTCTGACACTGCAGATGCGTAACAGCATCAT<br>CGGTAGCACCCTGCCCGAGGACGACTACCTGATCAGCCCTGTGGCCAACGACCGGGGAGAATT<br>CTACGACAGCAGAAACTACAAAGGCTCCAACGCCCGCCCTTCCATGTGACGCCGACGCCAACGGC<br>GCTTACAATATCGCCCGGAAAGCCCTGTGGGCTATCAACGTGCTGAAGGATACCCCTGACGATA<br>TGCTGCAGAAGGCCAAGCTCAGCATCACCAATGCCGAGTGGCTGGAATACACCCAGAGA |
| 62 | 59 | ATGAAGGAACAGTTCATCAACTGCTACCCTCTGTCCAAAACACTGCAGTTCAGCCTGATCCCCGT<br>GGGCAAGACCGATGATAACTTCAATAAAAAGCTGCTGTTAGAGCGGGACAAGCAGCGGGCCG<br>AGAACTACGAGAAGGTGAAGGGCTACATTGACAGATTTCACAAAGAGTACATCGAAAGCGTCC<br>TGGTGAACGCAAGAGTTGAAAAGATCGACGAGTACGCCGACCTGTACTGGAAGAGCAATAAG<br>GACGATAGCGACGCCAAGGCCATGGAGAGCCTGGAAAACGACATGCGGAAGCAGATCTCTAA<br>GCAACTGAAGAGCAACGCCCGGTACAAAAGACTGTTCGGCAAAGAGCTGATCTGTGAGGACCT<br>GCCTTCCTTCCTGACCGACAAGGAAGAGCGCGAAACCGTGGAGTGTTTTCGGAGCTTCACCACC<br>TACTTTAAGGGCCTGAACACGAACAGAGAGAACATGTACAGCAGCGACGAGAAGAGCACCGCC<br>ATAAGCTACCGCTGCATCAACGACAACCTTCCTAGATTCCTGGATAATGTGAAGTCTTTCCAGAA<br>AGTGTTCGACAATCTGTCCGACGAAACCATCACCAAGCTCAACACAGATCTGTATAACACATTCG<br>GAAGAAACATCGAGGACGTGTTCTCTGTGGACTACTTTGAGTTCGTGCTCGCTCAGAGCGGCAT<br>CGACATCTACAACAGCATGATTGGCGGCTACACATGCAGCGACGGAACAAAGATCCAGGGCCT<br>GAACGAATGCATCAACCTGTACAACAAGCAAGATGCCAAGAACGAGAAATCTAAGAGACTGCC<br>TCTGATGAAGCCTCTGTACAAGCAGATCCTCAGCGAGAAGGATTCTGTCTCCTTCATCCCTGAGA<br>AGTTTAACAGCGACAACGAGGTCCTGCTGAGCATCGAGGACTACTACTCTAGCCACATCGGCGA<br>CCTGGACCTGCTAACCGAGCTGCTGCAAAGCCTGAACACCTATAACGCTAACGGAATCTTCGTG<br>AAAAGCGGCGCCGCTGTGAGTGATATCAGCAACGGAGCCTTCAACAGCTGGAACGTCCTGCGG<br>CTGGCCTGGAACGAAAAATACGAGGCCCTGCACCCCGTGACCAGCAAGACCAATCTGGACAAC<br>TACATCGAGAAGAGAGATAAGATCTACAAAGCCATCAAGAGCTTCAGCCTGTTTGAGCTGCAGA<br>GCCTGGGCAACGAGAATGGAAATGAGATCACCGACTGGTACATCAGCTCTAGCAAGGAGTGTA<br>ATTCCAAAATCAAGGAGGCCTACCTGCAGGCCAGAGAACTGTTGAAAAGCGATTACGAGAAGT<br>CCTACAACAAGAGACTGTCGAAGAACGGCAAGGCCACCCAGTCCATCAAAAATATCCTGGATGC<br>CATCAAAGACTTCCACCACCTGGTGAAGTCACTGAACTGTACAGGCAAGGAGGAAAACAAGGA<br>TGAGCTGTTCTACGGCAAGCTGACCAGCTATTACGATAGCATCACCGACATCGATAGACTGTAC<br>GACAAGGTGCGGAACTACATCACTCAGAAACTTACAGCAAGGACAAGATCAAGCTGAATTTC<br>GACAACCCCCAGCTGCTCGGCGGATGGGACAAGAACAAGGAAAGCGATTACAGAACCGTGCTG<br>CTGCGTAAGGACGACTTCTACTACCTGGCGGTGATGGACAAACTTCATTCAAAAGCCTTCGTGG<br>ACGCCCCTAATATCACCTCCAAGGATGAGGATTACTACGAGAAAATGGAATACAAGCTGCTGCC<br>CGGCCCTAACAAAATGCTGCCAAAGGTGTTCTTCGCCGCCAAGAACATCGACACATTTCAGCCT<br>AGCGATCGGATCCTCGACATCAGAAAGCGGGAAAGCTTCAAAAAGGGCGCTACCTTTAACAAG<br>TCAGAATGCCACGAGTTCATCGACTATTTTAAGAACAGCATCGAGAAGCACTACGACTGGAGCC<br>AGTTCGGCTTCGAATTCACACCTACCGAGAATTACAACGACATCAGCGAGTTCTACCGGGAGAT<br>TAGCGACCAGGGCTACTCTGTCAGCTTTAACAAGATCTCCAAATCCTACGTGGATGAGCTGGTG<br>GATAATGGCTACATCTATCTGTTCCAGATCTACAACAAAGACTTCAGTAAATACAGCAAGGGCA<br>CCCCAAACCTGCATACCCTGTACTTCAAAATGCTGTTCGACGAAAGAAACCTGAGCAACGTGGT<br>GTACAAGCTGAACGGCGAGGCCGAGATGTTCTACAGAGAGGCTTCTATAAACGACAAAGAAAA<br>GATCACACACCAGGCCAACCAGCCTATCGAAAACAAGAACCCCGACAACGAGAAGAAAGAATC<br>TACCTTCGAGTACGACATCATCAAGGACAAGCGGTTCACCAAGCGACAGTTCAGCCTGCACGTG<br>CCTATCACCATCAACTTCAAGGCCCACGGCCAGGAGTTTCTGAACTACGATGTGCGGAAGGCCG<br>TGAAGTATAAGGACGACAACTATGTGATAGGCATCGATAGAGGCGAGAGAAACCTGATCTACA<br>TCAGCGTGATCGATTCTAACGGCAAAATCGTGGAACAGATGAGCCTGAATGAAATCATCAGCG<br>ACAATGGCCACAGAGTGGACTACCAGAAGCTGCTCGACACCAAGGAAAAGGAACGGGATAAG<br>GCCCGGAAGAACTGGACCAGCGTGGAAAACATCAAGGAGCTGAAGGAAGGCTACATCTCTCAG<br>GTGGTGCACAAGATCTGCGAGCTGGTGGTCAAATATGACGCCGTTATCGCCATGGAAGATCTG<br>AACTTCGGCTTCAAGAGAGGCAGATTTCCTGTGGAAAAACAAGTGTACCAAAAGTTCGAGAAC<br>ATGCTCATTTCTAAACTGAACCTGCTGATCGACAAGAAGGCCGATCCTACAGAGGACGGTGGCC<br>TGCTTAGAGCCTACCAGCTGACAAACAAGTTCGACGGCGTGAACAAGGCTAAGCAGAACGGCA<br>TCATCTTCTACGTGCCCGCTTGGGACACCAGCAAGATCGACCCCGTGACCGGATTTGTGAACCT<br>GCTGAAGCCTAAGTACACAAGTGTGTCTGAAGCTAAGAAGCTCTTCGAAACAATCGACGATATC<br>AAGTACAATGCCAACACCGACATGTTCGAGTTCTGCATCGACTACGGCAAGTTCCCAAGATGCA<br>ATAGCGATTACAAGAACACTTGGACAGTGTGCACCAACAGCTCCAGGATCCTGACCTGTAGAAA<br>CAAGGAAAGAATAACATGTGGGATAATAAGCAGATCGTTCTGACCGATGAGTTCAAGAGCCT<br>GTTTGGCGAATTTGGAATTGACTACAAGGGCAATCTGAAAACCTCCATCCTGTCTATCAGCAAC<br>GCCGACTTCTACCGGAGACTGATCAAGCTGCTGAGCCTGACCCTGCAGATGAGAAACAGCATCA<br>CCGGCAGCACATTGCCAGAGGATGACTACCTGATCAGCCCCGTGGCCAATGACAGAGGAGAAT |

TABLE S5B-continued

Human Codon Optimized Nucleotide Sequences Group 5

| SEQ ID NO | Corresponding AA | Sequence |
|---|---|---|
| | | TCTACGACAGCCGGAATTACAAGGGCATGAACGCCGCTCTGCCGTGCGACGCTGATGCGAATG GCGCTTACAACATCGCTAGAAAGGCCCTGTGGGCCATCAACGTGCTGAAGTCTACACCTGACGA CATGCTGAACAAGGCCAACCTCTCTATCACTAACGCTGAATGGCTGGAGTATACACAGAAG |

TABLE S5C

Direct Repeat Group 5

| SEQ ID NO | Direct Repeat (Variant #1) | SEQ ID NO | Direct Repeat (Variant #2) |
|---|---|---|---|
| 63 | ATCTACAACAGTAGAAATTATTAGG | 64 | ATCTACAACAGTAGAAATTATTAGG |
| 65 | GATTAATAATCCCTAATAATTTCTACTGT TGTAGAT | 66 | ATTAATAATCCCTAATAATTTCTACTGTTGT AGAT |
| 67 | ATCTACAACAGTAGAAATTATTAGGGAT TATTAATC | 68 | ATCTACAACAGTAGAAATTATTAGGGATTA TTAATC |

TABLE S5D crRNA Sequences Group 5

Figure 5A:
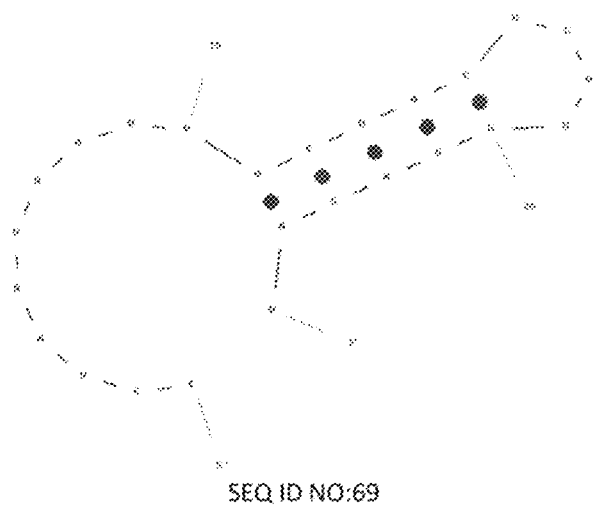
FIG. 5A-5C (SEQ ID NOs:69-71) are schemes depicting the predicted stem loop structures of crRNA sequences of the present disclosure corresponding to Group 5 sequences.
Figure 5B:
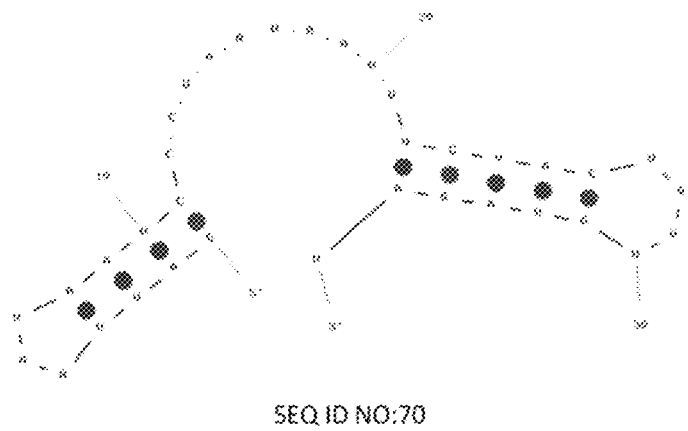
Figure 5C:
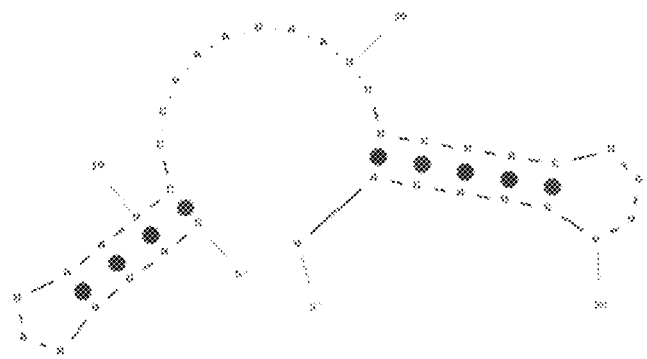

| SEQ ID NO | Sequence | FIG. |
|---|---|---|
| 69 | CCUAAUAAUUUCUACUGUUGUAGAU | FIG. 5A |
| 70 | GAUUAAUAAUCCCUAAUAAUUUCUACUGUUGUAGAU | FIG. 5B |
| 71 | GAUUAAUAAUCCCUAAUAAUUUCUACUGUUGUAGAU | FIG. 5C |

TABLE S5E

Consensus Sequence Group 5

| SEQ ID NO | Consensus Sequence |
|---|---|
| 72 | MKEQFINCYPLSKTLRFSLIPVGKTEDNFNKKLLLEXDKQRAENYEKVKGYIDRFHKEYIESVLXNARIEKINEYAXLY WKSNKDDSDAKAMESLENDMRKQISKQLKSNARYKRLFGKELICEDLPSFLTDKXERETVECFRSFTTYFKGFNT NREMYSSDEKSTAIAYRCINDNLPRFLDNVKSFQKVFDNLSDETITKLNTDLYNIFGRNIEDIFSVDYFEFVLAQS GIDIYNSMIGGYTCSDGTKIQGLNECINLYNQQXAKNEKSKRLPLMKPLYKQILSEKDSVSFIPEKFNSDNEVLLAIE DYYNNHIGDXDLLTELLQSLNTYNANGIFVKSGAAVSDISNGAFNSWNVLRLAWNEKYEALHPVTSKTKIDKYIEK RDKVYKAIKSFSLFELQSLGNENGNEITDWYISSINECNRKIKEAYLQARELLKSDYEKSYNKRLYKNEKATESVKNL LDAIKEFQXLVKXLNGTGKEENKDELFYGKFTSLYDSVADIDRLYDKVRNYITQKPYSKDKIKLNFDNPQLLGGWD KNKESDYRTVLLRKXDFYYLAVMDKXHSKXFVXAPNITSXDEDYYEKMEYKLLPGPNKMLPKVFZZZZZZZZZZZZZ ZZZZZFAXXNIZZZZZZDTFQPSDRILDIRKRESFKKGAZTFNKSECHEFIDYFKXSIXKHYDWSXFGFEFXPTEXYNDI SEFYREVSDQGYXISFXKISKXYIDELVDNGYIYLFQIYNKDFSKYSKGTPNLHTLYFKMLFDERNLSNVVYKLNGEA EMFYREASINDKEKITHXANQPIENKNPDNEKKESVFEYDIVKDKRFTKRQFSLHVPITINFKAHGQEFLNYDVRK AVKYKDDNYVIGIDRGERNLIYISVIDSNGKIVEQMSLNEIISDNGHXVDYQKLLDTKEKERDKARKNWTSVENIKE LKEGYISQVVHKICELVVKYDAVIAMEDLNFGFKRGRFPVEKQVYQKFENMLISKLNLLIDKKADPTEXGGLLRAY QLTNKFDGVNKAKQNGIIFYVPAWDTSKIDPVTGFVNLLKPKYZTSVXEAKKLFETIDDIKYNTNTDMFEFCIDYG KFPRCNSDFKKTWTVCTNSSRILTFRNKEKNNMWDNKQIVLTDEFKSLFNEFGIDYKGNLKXSILSISNADFYRRLI KLLSLTLQMRNSITGSTLPEDDYLISPVANDRGEFYDSRNYKGXNAALPCDADANGAYNIARKALWAINVLKDTP DDMLNKAKLSITNAEWLEYTQK |

Wherein:
each X is independently selected from any naturally occurring amino acid; and
each Z is independently selected from absent and any naturally occurring amino acid.

TABLE S5F

Native Nucleotide Sequences Group 5

| SEQ ID NO | Corresponding AA | Sequence |
|---|---|---|
| 73 | 57 | ATGAAAGAACAGTTTATAAATCGTTATTCATTATCTAAAACTTTAAGATTCTCTTTAATTCCCGTT<br>GGGGAAACAGAAAATAATTTTAATAAAAATCTTTTGCTTAAAAAAGATAAACAACGAGCAGAA<br>AATTATGAAAAGGTTAAAGGCTATATTGATCGCTTTCACAAAGAATATATTGAATCCGTGTTGA<br>GCAAAGCAAGAATTGAAAAAGTTAATGAATATGCAAATTTATATTGGAAAAGCAACAAGGATG<br>ATTCCGATATAAAGGCTATGGAATCATTAGAAAATGATATGCGTAAGCAAATATCAAAACAGCT<br>CAAATCAAATGCACGCTATAAAAGACTGTTTGGAAAAGAACTTATATGTGAAGATTTACCGTCT<br>TTTTTAACGGATAAAGACGAGAGAGAAACAGTTGAGTGCTTTAGAAGCTTTACAACATATTTCA<br>AAGGCTTTAATACTAATCGAGAAAACATGTATTCAAGTGATGAAAAATCAACTGCAATAGCTTA<br>TCGTTGCATAAATGACAACCTACCACGCTTTTTAGATAATGTAAAAGTTTTCAAAAGTATTTG<br>ATAATCTTTCTGATGAAACTATCACAAAGCTAAACACAGATTTATATAATATATTCGGCAGAAAT<br>ATTGAAGATATTTTTTCTGTTGATTACTTTGAATTTGTTTTAGCTCAATCGGGCATTGAAATTTAT<br>AATTCTATGATTGGCGGATACACTTGCTCTGACAAAACTAAAATCCAAGGTCTTAATGAATACA<br>TAAATCTTTATAACCAGCAGATTTCAAAAAATGAAAAATCAAAAAGATTGCCATTGATAAAACC<br>TTTATATAAACAAATTTTGAGTGAAAAGGACAGCGTATCGTTCATTCCCGAGAAATTCAATTCA<br>GACAATGAAGTGTTGCTTGCGATTGATGATTATTATAACAACCACATTGGTGATTTTGATTTACT<br>AACAGAGCTTTTGCAATCATTAAACACTTATAATGCCAATGGAATATTTGTAAAATCAGGTGTG<br>GCCATTACTGATATTTCAAACGGTGCATTTAACTCATGGAATGTATTACGCTCAGCTTGGAATG<br>AGAAATACGAAGCATTGCATCCCGTAACAAGCAAACAAAAATTGATAAATATATTGAAAAAC<br>GAGACAAGGTATATAAAGCAATAAAAAGCTTTTCGCTTTTTGAGCTTCAAAGCCTTGGCAACGA<br>AAACGGCAACGAAATAACCGATTGGTATATTTCCTCAATCAATGAAAGTAACAGAAAAATAAA<br>AGAAGCTTATTTGCAGGCACAGGAATTACTGAAATCCGATTATGAAAAAAGCTACAATAAAAG<br>ACTTTATAAAAATGAAAAAGCAACAGAGTCAGTTAAAAACCTGCTTGACACAATAAAGGAATTT<br>CAAAAGCTTATTAAGCCGTTAAACGGTACCAGTAAGGAAGAAAACAAGGATGAACTTTTTTAC<br>GGCAAATTCACTTCACTTTATGACTCGGTAGCAGATATTGACAGGCTTTACGATAAGGTTAGAA<br>ACTATATTACCCAAAAGCCTTATTCCAAAGATAAAATTAAATTGAATTTTGACAATCCTACTTTCT<br>TAAACGGTTGGGCATTAGGAAACGAATTTGCAAATTCTGCACAATTGCTTAGAGATGGTGATA<br>ATTACTATCTTGCAATTATGGATAAAGAATTAAAAAACAATATACCAAAAAATACAATTCACCA<br>ACCAACGAAGAAGATATGCTGCAAAAGATTATTTATCAACAGGCTGCTAATCCGGCAAACGAT<br>ATTCCAAATCTTCTTGTTATTGATGGAGTAACTGTAAAAAGAACGGAAGAAAAGAAAAAACA<br>GGAATACATGCAGGTGAAAATATCATATTGGAAAATCTTAGAAACACCTATCTTCCCGACAACA<br>TAAATCGTATAAGAAAAGAAAAAACATTTTCAACATCAAGCGAAAACTTTTCAAAAGATGACTT<br>GTGCGAGTATATCCAATATTATATCTGCCGTGTACAAGAATACTATTCTTCATACAACTTCACCT<br>TTAAAAATGCCTCAGAATATAAAAACTTCCCAGAGTTTTCAGATGATGTAAACTCACAGGCATA<br>TCAAATTAGCTATGATAATATTTCAAAAAAGCAAATTATGGAACTTGTAGACAACGGATATATC<br>TATCTTTTCCAAATCTACAATAAAGACTTTTCAAAGTACAGCAAAGGAACTCCTAATTTACATAC<br>TCTGTATTTCAAAATGCTTTTTGACGAGAGAAACTTATCAAATGTAGTTTATAAACTCAACGGTG<br>AGGCAGAGATGTTCTACCGTGAAGCAAGTATCGGTGATAAAGAGAAAATAACTCACTATGCCA<br>ATCAACCGATAGAAATAAAAACCCTGATAACAAGAAAAAAGAAAGCGTTTTTGAGTATGATA<br>TTGTAAAAGACAAGAGATTTACCAAAAGGCAATTTTCACTTCACGTGCCTATTACAATCAACTTT<br>AAGGCACACGGTCAGGAATTTTTAAATTATGATGTTCGCAAGGCGGTTAAATACAAAGATGAT<br>AATTATGTTATCGGCATTGACCGAGGAGAGAGAAACCTGATTTATATAAGCGTTATTGATTCAA<br>ACGGTAAAATCGTTGAGCAAATGTCGCTTAATGAAATAATCAGTGATAACGGGCACAAAGTTG<br>ATTATCAAAAGCTTTTGGACACAAAAGAAAGGAAAGAGATAAAGCAAGAAAGAATTGGACCT<br>CTGTTGAAAATATAAAGGAACTCAAAGAAGGCTATATCAGTCAGGTTGTTCACAAAATTTGTGA<br>ATTAGTCGTCAAATATGACGCTGTTATCGCCATGGAGGATTTGAATTTTGGCTTTAAGCGTGGC<br>AGATTCCCTGTTGAAAAGCAAGTTTATCAAAAATTTGAAATATGCTTATTTCAAAACTCAATTT<br>GCTTATTGATAAAAAGGCAGACCCAACAGAAAACGGCGGACTTTTAAGAGCATATCAGCTTAC<br>GAATAAATTTGACGGTGTAAATAAGGCTAAGCAAAACGGTATCATCTTTTATGTTCCTGCGTGG<br>GATACAAGTAAAATAGACCCGGCAACAGGTTTTGTTAATCTTTTGAAGCCAAAATGCAACACAA<br>GCATGCCGGAGGCGAAAAACTTTTTGAAACAATTGATGATATCAAATATAATACAAACACCG<br>ATATGTTTGAGTTCTATATTGATTACAGCAAATTCCCAAGGTGCAATTCAGACTTCAAAAAATCT<br>TGGACTGTTTGCACTAATTCAAGCAGGATTTTAACCTTCCCAAACAAAGAAAAAATAATATGT<br>GGGACAATAAACAAATTGTTCTTACCGATGAATTTAAGTCGTTATTTAATGAATTCGGCATTGAT<br>TATAAAGGTAATCTTAAGAGCTCTATTTTAAGCATTTCAATGCTGATTTTTACAGGCGATTAAT<br>AAAGCTTCTTTCATTAACACTTCAAATGAGAAACAGTATTACCGGCAGCACATTACCGAAAGAT<br>GACTATCTCATCTCCCCTGTTGCAAATAAAAACGGTGAGTTCTATGACAGTCGTAATTATAAAG<br>GTACAAATGCCGCTTTGCCTTGCGATGCCGATGCCAACGGTGCATATAACATTGCAAGAAAAGC<br>ACTTTGGGCAATAAATGTATTAAAAGACACTCCGGACGATATGCTTAATAAAGCTAAGCTTAGT<br>ATAACTAATGCCGAATGGCTTGAATACACGCAAAAATGA |
| 74 | 58 | ATGAAAGAACAGTTTATAAATTGCTATCCATTATCCAAAACTTTAAGATTTTCTTTAATCCCTGTT<br>GGAAAAACCGAAGATAATTTCAATAAAAAGCTTTTGCTTGAAAGCGATAAACAAAGAGCGGAG<br>AATTATGAAAATGTCAAAAGCTATATTGACCGCTTTCATAAAGAATATATTAAATCTGCATTAGC<br>AAACGCAAGAATTGAAAAAATCAATGAATATGCGGCTTTATATTGGAAAACAATAAGGATGA<br>TTCTGACGCAAAAGCTATGGAATCGTTAGAAGATGATATAAGAAGCAAATATCCAAACAACTT<br>ACATCAACCGCAAACTTTAAAAGACTGTTTGGAAAAGAGTTGATATGTGAAGACTTACCGGCTT<br>TTTTAACAGATGAAAATGAAAAGAAACAGTTGAATGCTTTAGAAGCTTTACAACATATTTTAA<br>TGGTTTTAATACTAATCGAAAGAATATGTATTCGAGTGAAAAAAGTCAACTGCAATAGCTTAT<br>CGTTGTGTAAATGACAACCTTCCTCGCTTTTTAGATAATGTAAAACTTTCAAAAATATTCGA<br>TAATCTTTCTGATGAAACTATCACAAAACTAAACACAGATTTATATAATATATTCGGCAGAAAA<br>TTGAAGATATTTTTTCTGTTGATTATTTTGATTTTGTTTTGACTCAATCAGGCATTGATATTTATA<br>ATTATATGATCGGCGGATATACTTGCTCAGACGGAACCAAAATCCAAGGTCTTAATGAATGTAT<br>AAATCTTTATAACCAGCAGGTTGCCAAAAATGAAAAATCAAAAAGATTGCCGTTAATGAAACCG<br>TTACGTAAGCAAATCTTAAGTGAAAAGGACAGTGTATCGTTCATTCCCGAGAAATTCAATTCAG |

TABLE S5F-continued

Native Nucleotide Sequences Group 5

| SEQ ID NO | Corresponding AA | Sequence |
|---|---|---|
| | | ACAACGAAGTGTTGCTTGCGATTGAAGAATATTATAATAACCACATTAGTGATATCGATTCGCT
TACAGAGCTTTTGCAATCATTAAACACTTATAATGCCAATGGAATATTTATAAAATCAGGTGCTG
CCGTTTCCGATATTTCAAACGCTGCATTTAACTCATGGAATGTATTACGCTTAGCTTGGAATGAA
AAGTATGAAGCTTTGCATCCCGTAACAAGCACAACAAAAATCGATAAATATATTGAAAAGCGA
GACAAGGTATATAAATCAATAAAAAGCTTTTCGCTTTTTGAACTTCAAGAGCTTGGTGCGGAAA
ATGGGAATGAAATAACCGATTGGTATATTTCATCAATCAATGAATGTAACCGCAAAATAAAAGA
AACTTATTTGCAGGCACGGGAATTGCTGGAATCCGATTATGAAAAGGACTACGATAAAAGACT
TTATAAAAATGAAAAGCAACAGAGTTAGTAAAAAACCTGCTTGACGCAATAAAGGAATTTCA
ACAGCTTGTTAAACTGTTAAACGGCACAGGTAAAGAAGAAAACAAGGACGAGCTTTTTTACGG
CAAATTCACTTCACTTTATGACTCGGTAGCAGATATTGACAGGCTTTACGATAAGGTTAGAAAC
TACATTACTCAAAGACCTTATTCCAAAGATAAAATAAAGCTGAATTTTGACAATCCCCAACTTCT
TGGCGGATGGGATAAAAACAAAGAAAGCGATTACAGAACCGTTATTCTTCGCAAAAATGATTT
TTACTATCTTGCCGTTATGGACAAATCACACAGTAAGGTTTTTGTTAATGCACCTGAGATAACCT
CTGAAGACGAGGATTATTACGAAAAAATGGAATATAAGCTTTTGCCCGGTCCCAATAAAATGTT
GCCAAAGGTTTTCTTCGCCTCTAGAAATATTGACAAATTTCAACCGTCAGACAGAATACTTGATA
TTCGCAAAAGAGAAAGCTTTAAAAAAGGAGCGACATTTAACAAATCCGAATGTCATGAGTTTAT
AGATTATTTTAAGGAATCTATTAAGAAGCATGATGATTGGTCAAAATTCGGATTTGAGTTTTCTC
CTACAGAAAGCTATAACGATATTAGCGAATTTTATCGAGAAGTTTCAGATCAAGGCTATTATAT
TAGCTTTAGTAAAATATCAAAAAACTATATCGATAAGCTTGTAGAAAACGGATATCTTTATCTTT
TTAAAATCTATAATAAAGACTTTTCAAAGTACAGCAAAGGAACTCCGAATTTACATACTTTGTAT
TTCAAAATGCTTTTTGACGAGAGAAATTTATCAAATGTGGTATACAAGCTCAACGGTGAAGCCG
AGATGTTCTACCGTGAAGCAAGTATAAATGACAAAGAGAAAATAACTCATCATGCCAATCAACC
GATAAAAAACAAAAATCCTGATAACGAGAAAAAAGAAAGCGTTTTTGAGTATGATATTGTAAA
AGACAAAAGATTTACCAAAAGGCAATTTTCACTTCACGTGTCTGTTACAATCAACTTCAAGGCA
CACGGTCAGGAATTTTTGAACTATGATGTTCGCAAGGCGGTTAAATATAAAGATGATAATTACG
TTATCGGCATTGACCGTGGCGAAAGGAATCTGATTTATATCAGCGTTATCAATTCAAACGGTGA
AATTGTTGAACAAATGTCGCTTAATGAAATAATCGGTGACAACGGATACAGTGTTGATTATCAA
AAGCTTTTGGATAAGAAAGAAAAGGAAAGAGATAAAGCAAGAAAAAACTGGACCTCTGTTGA
AAATATAAAGGAACTGAAAGAAGGCTACATCAGCCAGGTTGTTCACAAAATCTGTGAATTAGT
CGTTAAATATGATGCCGTTATCGCTATGGAGGATTTAAACTTCGGCTTCAAGCGCGGTAGGTTT
CCTGTTGAAAAGCAAGTTTATCAAAAATTTGAAAATATGCTTATTTCCAAACTCAATTTGCTTATT
GATAAGAAGGCGGAACCGACCGAAACCGGCGGTCTTTTGCGAGCATATCAGCTTACGAATAAA
TTCGACGGCGTAAATAAGGCTAAGCAAAACGGTATCATCTTTTATGTTCCGGCTTGGGATACAA
GTAAAATAGATCCGGTAACGGGCTTTGTTAATCTTTTAAAGCCAAAATACACAAGTGTGCGGGA
AGCTAAAAAGTTATTTGAAACAATTGATGATATCAAATATAACACAAACACCGATATGTTTGAG
TTCTGTATTGATTATGGTAAATTCCCGAGATGCAATTCGGATTTCAAAAAAACTTGGACTGTTTG
CACTAATTCAAGCAGAATTTTATCCTTCCGGAATGAAAAAAAGAATAACGAGTGGGACAATAA
GCAAATTGTTCTTACCGATGAATTCAAATCGTTGTTTAATGAATTTGGCATTGATTATACAAGTG
ATCTTAAGGCTTCTATTTTAAGCATTTCCAATGCCGATTTTTACAATCGATTGATAAGACTTCTTT
CATTAACACTTCAAATGAGAAACAGTATTATCGGCAGCACATTACCGGAAGATGACTACCTTAT
TTCGCCTGTTGCAAATGACAGAGGTGAGTTCTATGACAGTCGTAATTATAAAGGCTCAAATGCC
GCTTTGCCTTGCGATGCCGATGCGAATGGCGCATATAATATTGCAAGAAAAGCGCTTTGGGCA
ATAAATGTTTTAAAAGACACTCCGGATGATATGCTTCAAAAAGCAAAACTTAGTATAACTAATG
CCGAATGGCTTGAATATACACAAAGATGA |
| 75 | 59 | ATGAAAGAACAGTTTATAAATTGCTATCCATTATCCAAAACTTTACAGTTTTCTTTAATTCCCGTC
GGAAAAACGGATGATAATTTTAATAAAAAGCTGTTACTTGAAAGGGATAAACAAAGAGCGGA
GAATTACGAAAAGGTTAAAGGTTATATTGACCGCTTTCACAAAGAATATATTGAATCCGTACTA
GTCAATGCAAGGGTTGAAAAAATCGATGAATATGCGGATTTGTATTGGAAAAGCAACAAGGAC
GATTCCGACGCAAAGGCTATGGAATCATTAGAAAATGATATGCGAAAGCAAATATCAAAACAG
CTTAAATCAAATGCACGCTATAAAAGGCTGTTTGGAAAAGAACTTATATGTGAAGATTTACCGT
CTTTTTTAACGGATAAAGAAGAGAGAGAAACAGTTGAGTGCTTCAGAAGCTTTACAACGTATT
CAAAGGCCTTAATACTAATCGAGAAAATATGTATTCAAGTGATGAAAAATCAACTGCAATATCT
TACCGTTGCATAAATGACAACCTGCCACGCTTTTTAGATAATGTAAAAAGTTTTCAAAAAGTATT
TGATAATCTTTCTGATGAAACTATCACAAAGCTAAACACAGATTTATATAATACATTCGGCAGAA
ATATTGAAGATGTTTTTTCTGTTGATTATTTTGAATTTGTTTTGGCTCAATCGGGCATTGATATTT
ATAATTCTATGATTGGCGGATATACTTGCTCTGACGGAACAAAAATCCAAGGTCTTAATGAATG
CATAAATCTTTATAACAAGCAGGATGCAAAAAATGAAAAATCAAAAAGATTGCCATTGATGAA
GCCGTTATATAAACAAATCTTGAGCGAAAAGGACAGCGTATCGTTCATTCCCGAGAAATTTAAT
TCAGACAATGAAGTGTTGCTTTCGATTGAAGATTATTATAGCAGCCACATTGGCGATTTGGATT
TGCTAACAGAGCTTTTGCAATCGTTAAACACTTATAATGCTAATGGAATATTTGTAAAATCCGGC
GCTGCCGTTTCCGATATTTCAAACGGTGCATTTAATTCATGGAACGTATTACGTTTAGCTTGGAA
CGAGAAATACGAGGCATTGCATCCCGTAACAAGCAAACAAACCTCGATAATTATATTGAAAA
GCGAGACAAGATATATAAAGCAATAAAAAGCTTTTCGCTTTTGAACTTCAAAGCCTCGGTAAC
GAAAACGGCAACGAAATAACAGATTGGTATATTTCCTCAAGCAAAGAATGTAACAGCAAAATC
AAAGAAGCTTATTTGCAGGCACGGGAATTGCTGAAATCCGATTATGAAAAAGCTACAATAAA
AGACTTTCTAAAAACGGAAAAGCAACACAGTCAATTAAAAACATCCTTGACGCAATAAAGGATT
TTCACCATCTGGTAAAGTCGTTAAACTGTACCGGTAAGGAAGAAAACAAGGATGAACTTTTTA
CGGCAAACTCACTTCGTATTATGACTCAATAACAGGCTTTACGATAAAGTTAGA
AACTACATTACCCAAAAGCCTTATTCCAAAGATAAAATTAAATTAAATTTTGACAATCCTCAACT
TCTCGGTGGATGGGATAAAAACAAAGAAAGCGATTACAGAACCGTTCTTCTTCGCAAAGATGA
TTTTTACTATCTTGCTGTTATGGACAAATTGCACAGCAAAGCTTTTGTTGATGCTCCTAATATAAC
CTCTAAAGACGAGGATTATTACGAAAAAATGGAATATAAGCTTTTACCCGGTCCCAATAAAATG
TTGCCAAAGGTTTTCTTTGCCGCTAAAAACATTGACACATTCCAACCGTCAGACAGAATACTTGA |

TABLE S5F-continued

Native Nucleotide Sequences Group 5

| SEQ ID NO | Corresponding AA | Sequence |
|---|---|---|
| | | CATTCGCAAAAGAGAGAGTTTCAAAAAAGGGGCAACATTTAATAAATCCGAATGTCATGAGTT<br>TATAGATTATTTTAAGAACTCCATTGAGAAGCACTATGATTGGTCGCAATTCGGCTTTGAGTTTA<br>CTCCTACCGAAAACTATAACGATATCAGCGAGTTTTATCGAGAAATTTCGGATCAGGGTTATTC<br>TGTAAGCTTTAATAAAATATCAAAAAGCTATGTTGATGAACTTGTAGACAACGGATATATCTAT<br>CTTTTTCCAAATCTACAATAAAGACTTTTCAAAGTACAGCAAAGGAACTCCGAATTTACATACTCT<br>GTATTTCAAAATGCTTTTTGATGAGAGAAACTTATCAAATGTAGTATACAAGCTCAACGGTGAA<br>GCCGAGATGTTTTACCGTGAAGCAAGTATAAATGACAAGGAAAAAATAACTCATCAAGCCAAT<br>CAACCGATAGAAAACAAAAATCCTGATAACGAGAAAAAAGAAAGCACTTTTGAGTATGACATT<br>ATTAAAGATAAAAGATTTACCAAAAGGCAATTTTCGCTTCACGTGCCTATTACAATCAACTTTAA<br>GGCACACGGTCAGGAATTTTTGAATTATGATGTTCGCAAGGCGGTTAAATATAAAGATGATAAT<br>TATGTCATCGGCATTGACCGAGGCGAAAGAAATCTGATTTATATCAGCGTTATTGATTCAAACG<br>GTAAAATCGTTGAGCAAATGTCGCTTAATGAAATAATCAGTGATAACGGACACAGAGTTGATT<br>ATCAAAAGCTTTTGGACACAAAAGAAAGGAAAGAGATAAAGCAAGAAAAAATTGGACTTCTG<br>TTGAAAATATAAAGGAACTCAAAGAAGGCTATATCAGTCAAGTTGTTCACAAAATTTGTGAATT<br>AGTCGTCAAATATGACGCTGTTTATTGCCATGGAGGATTTGAACTTTGGCTTTAAGCGTGGCAGA<br>TTCCCTGTTGAAAAGCAAGTTTATCAAAAATTCGAAAATATGCTTATTTCAAAACTCAATTTGCT<br>TATTGATAAAAAGGCAGACCCAACAGAAGACGGCGGGCTTTTAAGAGCATATCAGCTTACGAA<br>TAAATTTGACGGCGTAAATAAAGCCAAGCAAAACGGCATCATCTTTTATGTTCCGGCTTGGGAC<br>ACAAGCAAAATAGACCCGGTAACAGGTTTTGTTAATCTTTTGAAGCCAAAATACACAAGCGTAT<br>CGGAAGCAAAAAAGTTATTTGAAACAATTGATGACATTAAATATAATGCAAATACCGATATGTT<br>TGAATTTTGTATTGATTACGGTAAGTTCCCAAGATGCAATTCAGACTACAAAAATACTTGGACT<br>GTTTGCACTAATTCAAGCAGGATTTTAACTTGCAGAAACAAAGAAAAGAATAATATGTGGGAC<br>AATAAGCAAATTGTTCTTACCGATGAATTCAAATCGTTGTTCGGCGAATTCGGCATTGATTATAA<br>AGGTAATCTTAAAACTTCAATTTTAAGCATTTCCAATGCTGACTTTTACAGGCGATTGATAAAGC<br>TTCTTTCATTAACGCTTCAAATGAGAAACAGCATTACCGGCAGCACATTGCCGGAGGATGACTA<br>CCTCATTTCCCTGTTGCAAATGACAGAGGCGAATTCTATGACAGCCGTAATTATAAAGGAATG<br>AATGCCGCATTACCTTGCGATGCCGATGCAAACGGCGCATATAATATTGCGAGAAAAGCACTTT<br>GGGCAATAAATGTTTTAAAAAGCACTCCGGATGATATGCTTAATAAAGCAAATCTCAGTATAAC<br>TAATGCCGAATGGCTTGAATACACGCAAAAATGA |

F. Group 6 Type V nuclease and associated sequences (SEQ ID Nos: 76-99)

TABLE S6A

Enzyme Sequences Group 6

| SEQ ID NO | Sequence |
|---|---|
| 76 | MKNNNMLNFTNKYQLSKTLRFELKPIGKTKENIIAKNILKKDEERAESYQLMKKTIDGFHKHFIELAMQEVQKTK<br>LSELEEFAELYNKSAEEKKKDDKFDDKFKKVQEALRKEIVKGFNSEKVKYYYSNIDKKILFTELLKNWIPNEKMITEL<br>SEWNAKTKEEKEHLVYLDKEFENFTTYFGGFHKNRENMYTDKEQSTAIAYRLIHENLPKFLDNINIYKKVKEIPVL<br>REECKVLYKEIEEYLNVNSIDEVFELSYFNKTLTQKDIDVYNLIIGGRTLEEGKKKIQGLNEYINLYNQKEKKNRIPK<br>LKILYKQILSDRDSISWLPESFEDDNEKTASQKVLEAINLYYRDNLLCFQPKDKKDTENVLEETKKLLAGLSTSDLSKI<br>YIRNDRAITEISQSLFKDYGVIKDAIKFQFIQSLTIGKSGLSKKQEEAVEKHLKQKYFSIAEIENALFTYQNETDALKEL<br>KENSHPVVDYFINHFKAKKKEETDKDFDLIANIEAKYSCIKGLLNTPYPEDKKLYQRSKEDNDIDNIKAPLDALMEL<br>LHFVKPLALSNDSTLEKDQNFYSHFEPYYEQLELLIPLYNKVRNFAAKKPYSTEKFKLNFENSHFLSGWATEYSTKG<br>GLIIKKENDFYLLIVDKKLQEDVDLLKRNVSSNIAYRVVYDFQKPDNKNVPRLFIRSKGTNFAPAVEKYNLPIHNV<br>IEIYDNGFFKTEYRKVDPVKFKKSLVKLIDYFKEGFTKHDSYKHYDFGWKESNQYEDISEFYNDVVNSCYQLVDEEI<br>NYDNLLKLVDEGKLYLFQIYNKDFSPYSKGKPNMHTLYWKALFDPENLKDVVYKLNGQAEVFYRKKSIEQKNIVT<br>HKANEPIDNKNPKAKKKQSTFEYDLIKDKRYTVDKFQFHVPITLNFKATGNDYINQDVLTYLKNNPEVNIIGLDRG<br>ERHLIYLTLINQKGEILLQESLNTIVNKKYDIETPYHTLLQNKEDERAKARENWGVIENIKELKEGYISQVVHKIAKL<br>MVEYNAIVVMEDLNTGFKRGRFKVEKQVYQKLEKMLIDKLNYLVFKDKDPSEVGGLYHALQLTNKFESFSKIGK<br>QSGFLFYVPAWNTSKIDPTTGFVNLFNTKYESVPKAQEFFKKFKSIKFNSAENYFEFAFDYNDFTTRAEGTKTEW<br>TVCTYGDRIKTFRNPDKVNQWDNQEVNLTEQFEDFFGKNNLIYGDGNCIKNQIILHDKKEFFEGLLHLLKLTLQ<br>MRNSITNSEVDYLISPVKNNKGEFYDSRKADNTLPKDADANGAYHIAKKGLVLLNRLKENEVEEFEKSKKVKDGK<br>SQWLPNKDWLDFVQRNVEDMVVV |
| 77 | MTMKNFSNLYQVSKTIRFELKPIGSTLENIENKSLLKNDSIRAESYQKMKETIDEFHKYFIDLALNNKKLSYLNEYIA<br>LYTQSAEAKKEDKFKAEFKKVQDNLRKEIVSSFTEGEAKAIFSVLDKKELITIELEKWKNENNLAVYLDESFKSFTTY<br>FTGFHQNRKNMYSAEANSTAIAYRLIHENLPKFIENSKAFEKSSQIAELQPKIEKLYKEFEAYLNVNSISELFEIDYFN<br>EVLTQKGITVYNNIIGGRTATEGKQKIQGLNEIINLYNQTKPKNERLPKLKQLYKQILSDRISLSFLPDAFTEGKQVL<br>KAVFEFYKINLLSYKQDGVEESQNLLELIQQVVKNLGNQDVNKIYLKNDTSLTTIAQQLFGDFSVFSAALQYRYET<br>VVNPKYTAEYQKANEAKQEKLDKEKNKFVKQDYFSIAFLQEVVADYVKTLDENLDWKQKYTPSCIADYFTTHFIA<br>KKENEADKTFNFIANIKAKYQCIQGILEQADDYEDELKQDQKLIDNIKFFLDAILEVVHFVKPLHLKSESITEKDNAF<br>YDVFENYYEALNVVTSLYNMVRNYVTQKPYSTEKIKLNFENAQLLNGWDANKEKDYLTTILKRDGSYFLAIMDK<br>KHNKTFQQLTEDDENYEKMVYKLLPGVNKMLPKVFFSNKNIAFFNPSREILDNYKNNTHKKGATFNLKDCHALI<br>DFFKDSLNKHEDWKYFDFQFSETKTYQDLSGFYREVEHQGYKINFKKVSVSQIDTLIEEGKMYLFQIYNKDFSPYA<br>KGKPNMHTLYWKALFETQNLENVIYKLNGQAEIFFRKASIKKKNIITHKAHQPIAAKNPLTPTAKNTFAYDLIKDK<br>RYTVDKFQFHVPITMNFKATGNSYINQDVLAYLKDNPEVNIIGLDRGERHLVYLTLIDQKGTILLQESLNVIQDEK |

TABLE S6A-continued

Enzyme Sequences Group 6

| SEQ ID NO | Sequence |
|---|---|
|  | KATPYHTLLDNKEIARDKARKNWGSIESIKELKEGYISQVVHKITKMMIEHNAIVVMEDLNFGFKRGRFKVEKQI<br>YQKLEKMLIDKLNYLVLKDKQPHELGGLYNALQLTNKFESFQKMGKQSGFLFYVPAWNTSKIDPTTGFVNYFYT<br>KYENVEKAKTFFSKFESILYNKTKGYFEFVVKNYSDFNPKAADTRQEWTICTHGERIETKRQKEQNNNFVSTTIQL<br>TEQFVTFFEKVGLDLSKELKTQLIAQNEKSFFEELYHLLKLTLQMRNSESHTEIDYLISPVANEKGIFYDSRKATASL<br>PIDADANGAYHIAKKGLWIMEQINKTNSADDLKKVKLAISNREWLQYVQQVQKK |
| 78 | LIIILNLFKMTALLQNFTNQYQLSKTLRFELIPQGKTFDFIQEKGLLNQDKRRAESYQEMKKTIDKFHKYFIDLALSN<br>VKLTHLDAYLELYNTSAETKKESKFKDDLKKVQDNLRKEIVKSFSEGEAKSIFAILDKKELITVELEKWFESNEQEEIY<br>FDDKFKTFTTYFTGFHQNRKNMYSVEANSTAIAYRLIHENLPKFLENAKAFEKIQVPELQPKIAKIYKEFESYLNV<br>NSIDELFELDYFNDVLTQMGIDVYNNIIGGRTESDGKSKIQGLNEIINLYNQTKEKNQRLPKLKQLYKQILSDRISLS<br>FLPDAFTDGKQVLKAIFDFYKINLLSYTIEGQEESQNLLLLISQIVENLSGFDNQKMYLRNDTHLTTISQQLFGDFS<br>VFSTALNYWYETKVNPKFEAEYSKANEKKREALDKTKANFTKQDYFSIAFLQEVLANYVLTLDKTSDVVQKFTPT<br>CVADYFNNHFVAKKENETDKTFDLIANITAKYQCIQGILENADRYEDELKQDQKLIDDLKFFLDAIMELLHFIKPLH<br>LKSESITEKDTAFYDVFENYYEALSLLTPLYNMVRNYVTQKPYSTEKIKLNFENAQLLNGWDANKEADYLTTILKK<br>DGNYFLAIMDKKHNKAFQKFPEGTDNYEKMVYKLLPGVNKMLPKVFFSNKNIAYFNPSKELLENYKKETHKKG<br>DTFNLEHCHALIDFFKDSLNKHEDWKHFDFQFSETKSYQDLSGFYREVEHQGYKINFKNIDSEYIDGLVNEGKLYL<br>FQIYNKDFSPYSKGKPNMHTLYWKALFEEQNLQNVIYKLNGQAEIFFRKASIKPKNIITHKANQPIKAKNPLTPEA<br>KNTFEYDLIKDKRFTVDKFQPHVPITMNFKATGGSYINQTVLEYLQNNPEVKIIGLDRGERHLVLTLIDQQGNIL<br>KQESLNTISDTKIATPYHKLLDNKEKERDLARKNWGTVENIKELKEGYISQVVHKIATMMVEENAIVVMEDLNFG<br>FKRGRFKVEKQIYQKLEKMLIDKLNYLVLKNKQPHELGGLYNALQLTNKFESFQKMGKQSGFLFYVPAWNTSKI<br>DPTTGFVNYFYTKYENVEKAKAFFDKFQSIRFNTRANYFEFEVKKYSDFNPKAEDTKQEWMICTFGERIETKRQK<br>DQNNNFVSTTINLTEKTEDFFGKNNIVYGDGNCIKKQIAAKEDKDFFETLLYWFKMTLQMRNSVTGTDEDYLIS<br>PVMNADGIFYDSRKADNNLPKDADANGAYHIAKKGLWILEQINKPKTTEELKKIKLAISNKEWLQYVQE |
| 79 | MNTTYTNLFALSKTLRFELIPQGKTLHFIQEKGLITNDNKRAESYQKMKKTIDEFHKYFIDLALKNVRLSFLEDYLDL<br>YNQSADYKKEPKFKEELKVQDNLRKEIVLSFSKDEAKTIFSILDKKELITEELEKWFENQEKKDLHFDDKFKTFTTY<br>FTGFHQNRKNMYSSEPNSTAIAYRLIHENLPKFLENAKAFERIKQVPELQLKIEKIYKDFELYLNVNSIEELFELNYF<br>NDVLTQMGIDVYNNIIGGRTETDGKPKIQGLNEIINLYNQTKSKNERLPKLKQLYKQILSDRVSLSFLPDAFTDGK<br>QVLQAIFAFYKVNILSYTIDGQAESKNLLELIQQLLANISSFETERILKLQEIITEYSLSLDKDSELITKITPTCVADYFKNHFVAKKE<br>NETDKTFGFLANITAKYQCIQGTLENATNYNEELKQDQKLIDDIKLFLDTLLELLHFIKPLHLKSDSITEKDNAFYDL<br>FENYYEALSLLTPLYNMVRNYVTQKPYSTEKIKLNFENAQLLNGWDVNKEADYLTTILKKEGNYFLAIMDKKHNK<br>AFQKFPEGENNYEKMTYKLLPGVNKMLPKVFFSNKNIAYFNPSKELVENYKNETHKKGEKFNLLHCRQLIDFFKD<br>SINKHEDWKHFDFQFSETKSYQDLSGFYREVEHQGYKINFKNIDSAYIDSLVNEGKLFLFQIYNKDFSPFSKGKPN<br>MHTLYWKALFEDQNLKNVKYKLNGQAEIFFRKASIKPENIITHKANQSIKAKNPLTPDAKNTFDYDLIKDKRYTV<br>DKFQPHVPITLNFKATGGSFINQNVLEYLKENPEVKIIGLDRGERHLVYLTLIDQQGNILKQESLNTITDAKIATPYH<br>QLLDIKEKERDFARKNWGTVENIKELKEGYISQVVHKIATMMVEENAIVVMEDLNFGFKRGRFKVEKQIYQKLE<br>KMLIDKLNYLVLKDKQPTELGGLYNALQLTNKFESFQKMGKQSGFLFYVPAWNTSKIDPTTGFVNYFFTKYENV<br>DKAKVFFDKFQSIRYNTKANYFEFEVKKYSDFNPKAEGTLQEWTVCSYGERIETKRLKDQNNNFVSTPINLTEKIE<br>DFLGRNNIVYGDGTCIKSQIAEKNAKEFFEGLLYWFKMTLQMRNSATGTDEDYLISPVMNAQGEFYDSRKADE<br>TLPKDADANGAYHIAKKGLMWLEQIKSFDGNDWKKLELDKSNRGWLQYIQQRK |

TABLE S6B

Human Codon Optimized Nucleotide Sequences Group 6

| SEQ ID NO | Corresponding AA | Sequence |
|---|---|---|
| 80 | 76 | ATGAAGAACAACAACATGCTCAACTTCACTAACAAGTACCAGTTATCAAAAACCTTACGATTCGAG<br>CTGAAGCCAATCGGAAAGACTAAGGAGAATATCATTGCGAAGAATATCCTTAAGAAGGATGAGG<br>AAAGGGCTGAGTCCTATCAACTCATGAAGAAACCATTGATGGCTTTCATAAACATTTCATTGAGC<br>TGGCTATGCAAGAGGTACAAAAAACTAAACTGTCTGAGCTGGAAGAGTTCGCTGAACTGTACAAC<br>AAGTCAGCAGAGGGAAAAGAAAAAGGATGACAAGTTTGACGATAAGTTTAAGAAAGTTCAGGAA<br>GCCCTGCGAAAGGAGATTGTTAAAGGCTTCAATTCAGAGAAGGTCAAGTATTACTACAGCAACAT<br>CGATAAAAAGATCCTTTTTACCGAACTCCTTAAAAACTGGATCCCAAACGAGAAATGATCACTGA<br>GCTCTCTGAATGGAACGCTAAAACTAAAGAAGAGAAAGAGCACCTCGTCTACCTTGACAAGGAAT<br>TCGAGAACTTTACTACATACTTTGGAGGGTTTCATAAGAATCGTGAAAACATGTATACCGATAAA<br>GAACAGTCCACCGCTATTGCCTACCGCCTGATACACGAGAATTTGCCAAAGTTCCTGACAATATC<br>AACATTTACAAGAAGGTCAAAGAGATCCCGGTCCTGAGGGAAGAGTGTAAAGTTCTTTACAAAG<br>AGATTGAGGAGTACTTAAACGTGAATTCCATCGACGAGGTCTTCGAGTTGTCATATTTCAATAAAA<br>CACTCACTCAGAAGGACATCGATGTGTACAACTTAATTATTGGCGGCAGAACACTGGAGAAGGC<br>AAGAAAAAGATACAAGGGCTCAACGAGTATATTAATCTATACAACCAGAAGCAGGAGAAAACA<br>ACAGAATACCTAAGCTGAAGATCCTTTACAAGCAGATACTGAGCGATCGAGATAGTATAAGTGG<br>CTGCCTGAGAGCTTCGAGGATGATAATGAGAAGACTGCCAGCCAGAAAGTGCTTGAGGCCATCA<br>ATCTCTATTACAGAGATAACCTCCTTATGTTTTCAGCCTAAGGACAAAAAGGACACCGAGAACGTC<br>CTCGAGGGAAACAAAAAAACTGCTGGCTGGGTTGAGCACGAGGTGATCTGTCTAAGATTTACATCCGC<br>AACGACGAGCTATCACTGAGATTTCGCAGAGTCTGTTTAAAGACTATGGCGTAATCAAGGATGC<br>AATCAAGTTCCAGTTATACAGAGTCTGACAATTGGGAAGTCAGGGCTATCCAAAAAACAGGAG<br>GAGGCTGTGGAAAACATCTGAAACAGAAATACTTCTCCATTGCGGAAATCGAGAACGCACTTTT<br>TACCTACCAGAACGAAACAGATGCACTCAAAGAGTTGAAAGAAAATTCTCACCCAGTGGTGGACT |

TABLE S6B-continued

Human Codon Optimized Nucleotide Sequences Group 6

| SEQ ID NO | Corresponding AA | Sequence |
|---|---|---|
| | | ATTTCATCAACCACTTTAAAGCTAAGAAGAAGGAGGAGACAGACAAGGATTTTGACCTTATAGCG<br>AATATTGAGGCAAAGTATTCCTGCATTAAGGGACTTTTAAATACCCCCTATCCCGAGGACAAGAA<br>ACTGTATCAAAGGTCTAAAGAGGACAACGATATCGACAATATCAAAGCCTTTCTGGACGCCTTGA<br>TGGAGCTGCTGCACTTTGTGAAGCCTCTAGCCCTCAGCAATGACAGTACGTTGGAAAAAGACCAG<br>AATTTCTACTCTCACTTCGAGCCATATTACGAACAGCTGGAGTTGTTGATCCCCTTGTATAATAAG<br>GTCCGGAACTTTGCTGCAAAAAAGCCCTACTCTACGGAGAAATTCAAGCTGAACTTCGAAAATTC<br>CCACTTTCTATCGGGTTGGGCCACAGAATACTCCACCAAAGGAGGCCTCATCATTAAAAAGGAGA<br>ACGATTTCTACCTGCTTATTGTGGACAAGAAGCTTCAAAAAGAAGATGTCGATCTGCTGAAACGG<br>AATGTTTCTTCGAACATTGCTTATAGAGTCGTCTACGATTTTCAAAAGCCAGACAATAAGAACGTG<br>CCACGCTTATTCATCCGCTCAAAAGGAACCAATTTCGCTCCCGCAGTAGAAAAGTATAACCTGCCC<br>ATACATAACGTGATCGAAATTTATGACAACGGATTCTTTAAGACAGAGTACCGCAAAGTAGATCC<br>GGTGAAATTCAAGAAATCACTGGTTAAACTGATCGACTATTTTAAGGAGGGGTTCACAAAACATG<br>ACTCCTACAAACATTATGACTTTGGATGGAAAGAATCAAACCAGTACGAGGACATCAGTGAATTT<br>TACAACGATGTTGTGAACAGCTGCTACCAGCTAGTAGATGAAGAGATCAACTATGACAATCTGCT<br>GAAACTAGTTGATGAAGGCAAACTTTACCTCTTTCAGATCTACAACAAGGATTTTTCCCCGTATAG<br>TAAGGGTAAACCTAATATGCACACCCTGTATTGGAAAGCACTTTTTGACCCCGAGAACCTCAAAG<br>ATGTAGTCTATAAACTGAACGGGCAGGCGGAGGTCTTCTATCGAAAGAAGTCAATCGAGCAAAA<br>GAACATCGTGACACATAAGGCCAACGAACCTATTGACAATAAGAATCCTAAGGCCAAAAAGAAG<br>CAGTCCACCTTCGAGTATGACCTGATTAAGGATAAACGGTATACTGTGGACAAGTTTCAGTTCCAC<br>GTCCCTATTACCTTAAACTTCAAAGCGACCGGTAACGACTATATAAATCAAGACGTCCTTACCTAC<br>CTGAAGAATAATCCCGAGGTGAATATCATTGGCCTGGACAGAGGCGAACGTCACCTCATATATCT<br>CACCCTGATAAACCAGAAGGGGGAGATACTCCTGCAGGAGAGCTTGAACACCATAGTGAATAAG<br>AAATACGACATCGAAACCCCCTACCACACACTGCTACAGAACAAGGAGGATGAACGTGCCAAAG<br>CCAGGGAAAATTGGGGCGTCATTGAAAATATTAAGGAACTGAAGGAGGGATATATTAGCCAAGT<br>GGTGCATAAAATTGCCAAACTTATGGTGGAATACAACGCCATAGTAGTGATGGAAGACCTGAAC<br>ACAGGGTTCAAGAGGGGGCGGTTTAAAGTGGAAGCAGGTCTATCAGAAACTCGAGAAGATG<br>CTGATTGACAAGTTGAATTACTTAGTGTTCAAGGACAAAGACCCATCTGAGGTTGGCGGTCTATA<br>TCACGCGCTCCAATTGACTAACAAATTTGAGTCTTTCAGCAAGATCGGCAAGCAGTCTGGATTCCT<br>CTTCTACGTGCCAGCATGGAATACCAGCAAGATCGACCCTACTACAGGGTTCGTTAATCTGTTCAA<br>CACGAAGTACGAATCCGTCCCAAAGGCACAGGAGTTCTTCAAGAAGTTCAAGTCCATCAAGTTTA<br>ACAGCGCCGAAAATTATTTCGAATTCGCCTTCGATTACAATGACTTTACTACGAGGGCCGAAGGA<br>ACGAAAACAGAATGGACCGTGTGCACCTATGGCGATAGGATTAAGACTTTTCGGAATCCCGATAA<br>GGTAAATCAATGGGATAATCAAGAGGTTAATCTGACCGAACAGTTTGAGGACTTCTTTGGTAAAA<br>CAACCTGATTTACGGTGATGGTAACTGTATCAAAAACCAGATCATCTTGCACGATAAGAAGGAA<br>TTTTTTGAAGGACTCCTACACCTGTTGAAACTGACACTCCAGATGAGAAACAGTATCACAAATTCT<br>GAGGTGGATTACCTCATAAGCCCTGTGAAAAATAATAAAGGCGAATTCTACGACTCCCGGAAAG<br>TGATAATACTTTGCCCAAGGATGCCGATGCCAATGGCGCATATCATATCGCCAAAAAGGGACTGG<br>TGTTGCTTAATCGCCTGAAAGAGAATGAAGTTGAAGAGTTCGAGAAGAGCAAGAAGGTTAAGGA<br>CGGGAAGAGCCAGTGGCTGCCGAATAAGGACTGGTTAGACTTTGTGCAGCGGAATGTGGAAGAT<br>ATGGTGGTGGTGTGA |
| 81 | 77 | ATGACAATGAAGAACTTTAGCAACCTGTACCAGGTGAGCAAAACCATTAGGTTTGAGCTGAAGCC<br>AATCGGAAGCACACTGGAGAACATCGAAAACAAGTCACTGCTGAAAAATGATAGCATTAGAGCC<br>GAGAGCTACCAGAAGATGAAAGAGACAATTGACGAGTTCCACAAGTATTTCATCGATCTGGCTCT<br>GAACAATAAGAAGCTGAGCTACCTGAACGAGTATATCGCTCTCTACACCCAGAGCGCCGAAGCCA<br>AGAAGGAGGACAAATTTAAGGCCGAATTTAAGAAGGTGCAGGATAACCTGCGGAAAGAAATTGT<br>GAGCTCCTTCACCGAGGGTGAGGCTAAGGCCATCTTCAGCGTGCTGGACAAAAAGGAGCTGATT<br>ACAATTGAACTGGAAAAATGGAAGAACGAGAACAACCTGGCCGTGTACCTCGACGAGAGCTTCA<br>AGTCCTTCACTACATACTTCACAGGCTTCCACCAGAATAGAAAGAACATGTACAGCGCAGAGGCC<br>AACTCTACAGCCATCGCCTACCGGCTGATCCATGAGAACCTGCCCAAGTTTATCGAGAACTCCAAG<br>GCCTTTGAGAAGTCCAGCCAGATCGCCGAGCTGCAGCCAAAGATCGAAAAGCTGTACAAGGAGT<br>TCGAGGCCTATCTGAACGTGAATAGCATCAGCGAGCTGTTCGAAATTGACTACTTCAACGAGGTG<br>CTGACCCAGAAGGGCATTACAGTGTACAACAACATCATCGGGGGCAGGACTGCCACCGAGGGGA<br>AACAGAAGATTCAGGGCCTGAATGAGATTATCAATCTGTATAATCAGACAAAACCCAAGAACGAA<br>AGACTGCCAAAGCTGAAGCAGCTGTATAAGCAGATCCTGTCCGACAGAATCAGCCTGTCTTTCCT<br>GCCTGACGCCTTCACCGAAGGGAAGCAGGTGTTGAAAGCCGTGTTTGAGTTCTACAAGATCAACC<br>TTCTGTCTTACAAACAGGATGGCTGGAGGAAAGCCAGAACCTGCTGGAGCTGATCCAGCAGGT<br>GGTGAAGAACCTGGGCAACCAGGACGTGAATAAGATCTACCTGAAAAACGACACCTCCCTGACT<br>ACCATTGCCCAGCAGCTCTTTGGGGACTTTAGTGTGTTTAGCGCCGCCCTGCAATACAGGTATGA<br>GACCGTGGTGAACCCCAAGTACACTGCCGAATATCAGAAGGCCAACGAGGCCAAGCAGGAGAA<br>GCTCGACAAGGAGAAGAACAAGTTCGTGAAACAGGACTACTTCTCCATCGCCTTCCTGCAGGAGG<br>TGGTGGCAGATTACGTGAAGACCCTGGACGAAAACCTGGATTGGAAACAGAAGTACACCCCATC<br>CTGCATCGCCGACTACTTTACCACCCACTTCATCGCCAAGAAAGAACGAGGCCGATAAAACCT<br>TTAACTTTATTGCCAATATTAAGGCCAAGTATCAGTGCATCCAGGGCATTCTGGAGCAGGCCGAT<br>GATTACGAGGATGAGCTGAAGCAGGACCAGAAGCTGATCGATAACATCAAGTTTTTCCTGGACG<br>CTATACTGGAGGTGGTGCACTTCGTGAAGCCTCTGCACCTGAAGTCTGAGTCTATCACTGAGAAG<br>GATAATGCCTTTTACGACGTGTTTGAGAATTACTACGAGGCACTGAATGTGGTGACCTCACTGTAC<br>AATATGGTGAGAAATTACGTGACTCAGAAGCCTTACAGCACAGAGAAGATTAAGCTGAACTTTGA<br>AAACGCCCAGCTGCTGAACGGCTGGGACGCTAATAAGGAGAAGGATTACTTGACCACTATTCTGA<br>AGCGGGATGGAAGTTATTTCCTGGCTATTATGGATAAAAAGCACAATAAGACCTTCCAGCAGCTG<br>ACAGAGGACGACGAGAACTACGAGAAGATGGTCTATAAGCTGCTGCCCGGCGTGAACAAGATGC<br>TGCCCAAGGTGTTTTTCTCTAATAAAAACATCGCCTTCTTTAACCCCAGCAGAGAGATCCTGGACA<br>ATTATAAGAACAACACCCACAAGAAGGGCGCCACATTTAACCTGAAAGACTGTCATGCCCTGATT<br>GACTTCTTCAAGGACTCCCTGAACAAGCACGAGGACTGGAAGTACTTCGACTTCCAGTTCTCTGA |

TABLE S6B-continued

Human Codon Optimized Nucleotide Sequences Group 6

| SEQ ID NO | Corresponding AA | Sequence |
|---|---|---|
| | | GACAAAGACCTACCAGGACCTGTCCGGCTTTTACCGCGAAGTGGAACACCAGGGCTACAAAATCA<br>ATTTTAAAAAGGTGAGCGTGTCCCAGATCGACACCTTGATCGAAGAGGGAAAAATGTATCTGTTC<br>CAGATCTACAACAAGGACTTCAGTCCTTACGCAAAGGGCAAACCAAACATGCACACACTGTACTG<br>GAAGGCACTGTTTGAAACCCAGAACCTGGAGAACGTGATCTACAAGCTGAACGGCCAGGCCGAG<br>ATCTTTTTTCGCAAGGCCTCCATCAAGAAGAAGAACATCATTACCCACAAAGCACATCAGCCCATC<br>GCCGCCAAGAATCCACTGACCCCAACCGCCAAGAACACCTTCGCCTACGACCTGATCAAGGACAA<br>GAGATATACAGTGGACAAGTTTCAGTTTCATGTGCCCATCACCATGAACTTCAAGGCCACTGGCA<br>ATAGCTACATTAACCAGGACGTGCTCGCCTATCTGAAGGATAATCCTGAAGTGAATATCATTGGC<br>CTGGATAGGGGCGAGCGCCACCTTGTGTATCTGACCCTGATCGACCAGAAAGGAACCATCCTGCT<br>GCAGGAAAGCCTGAACGTGATTCAGGACGAGAAAAAGCCACACCCTACCACACCCTGCTGGAC<br>AACAAGGAGATTGCCAGGGACAAGGCCCGCAAGAACTGGGGGTCCATCGAGTCCATTAAGGAA<br>CTCAAGGAGGGGTACATCTCACAGGTGGTGCATAAAATTACCAAAATGATGATTGAGCACAACG<br>CCATCGTGGTGATGGAGGACCTGAATTTCGGCTTCAAACGCGGAAGGTTTAAGGTGGAGAAGCA<br>GATTTATCAGAAGCTGGAGAAAATGCTGATCGACAAGCTGAACTACCTGGTGCTGAAGGACAAG<br>CAGCCCCACGAGCTGGGAGGGCTCTATAACGCTCTGCAGCTGACCAACAAGTTCGAGTCATTCCA<br>GAAAATGGGAAAACAGAGCGGCTTCCTGTTCTATGTGCCCGCCTGGAACACCAGCAAGATCGAC<br>CCTACCACCGGTTTCGTGAACTATTTTTACACTAAATACGAGAATGTTGAGAAGGCTAAGACGTTT<br>TTCTCTAAATTCGAGAGCATTCTGTATAATAAGACAAAGGGATATTTTGAGTTTGTGGTGAAGAAT<br>TATTCCGACTTCAACCCCAAGGCAGCTGACACCAGACAGGAGTGGACCATTTGCACCCACGGGGA<br>AAGAATCGAAACCAAAAGACAGAAGGAACAGAACAATAATTTCGTGAGCACTACAATCCAGCTG<br>ACCGAGCAGTTCGTCACTTTTTTCGAGAAGGTGGGACTGGACCTCAGCAAAGAGCTGAAGACCCA<br>GCTGATTGCCCAAAATGAGAAGAGCTTTTTTGAGGAGCTGTATCACCTGCTGAAACTGACCCTGC<br>AGATGAGAAACAGCGAGTCTCACACTGAGATTGATTACCTGATCTCCCCCGTGGCTAACGAGAAA<br>GGAATTTTTTACGACTCCCGGAAGGCCACCGCCTCGCTGCCCATCGACGCTGACGCCAACGGGGC<br>TTACCACATCGCTAAGAAGGGCCTGTGGATCATGGAGCAAATTAACAAAACCAACTCCGCTGACG<br>ATCTGAAAAAGGTCAAGCTGGCAATCTCCAACAGAGAGTGGCTGCAGTACGTGCAACAGGTGCA<br>GAAAAAGTGA |
| 82 | 78 | CTGATTATTATCTTGAACCTGTTCAAGATGACAGCCCTGCTGCAGAACTTCACCAACCAGTATCAG<br>CTCTCCAAGACCCTGAGGTTCGAGCTGATCCCCCAGGGCAAGACTTTTGATTTTATCCAGGAGAA<br>GGGGCCTGCTGAACCAGGACAAACGCAGAGCCGAGAGCTACCAGGAGATGAAAAAGACCATCGA<br>CAAATTTCACAAATACTTCATCGACCTGGCTCTCTCCAACGTGAAACTGACCCACCTGGATGCTTA<br>CCTGGAGCTCTACAATACCTCCGCCGAGACCAAAAAGGAGAGCAAGTTCAAGGACGACCTGAAG<br>AAAGTGCAGGATAACCTGAGGAAGGAAATCGTGAAAGTTTCAGCGAGGGGGAGGCCAAGTCT<br>ATCTTTGCCATCCTGGACAAAAAGGAGCTGATCACTGTGGAGCTGGAGAAGTGGTTTGAGAGCA<br>ATGAGCAGGAGGAAATCTATTTTGACGATAAATTCAAAACGTTTACCACCTACTTTACCGGCTTTC<br>ACCAGAACAGAAAGAACATGTATTCTGTGGAAGCCAACTCCACCGCCATAGCCTACAGACTGATC<br>CACGAGAATCTGCCTAAATTCCTGGAAAATGCTAAGGCATTCGAGAAAATTAAACAGGTCCCAGA<br>GCTGCAGCCTAAGATAGCTAAGATTTACAAGGAGTTTGAATCCTACCTGAATGTGAATTCTATCGA<br>CGAGCTGTTTGAGCTGGACTACTTCAATGACGTGCTGACACAGATGGGCATCGACGTGTACAACA<br>ATATCATCGGCGGCAGAACCGAGAGCGACGGCAAGAGCAAGATCCAAGGCCTGAATGAGATCAT<br>CAATCTGTATAATCAGACAAAAGAGAAGAATCAGAGACTGCCAAAACTGAAGCAGCTGTACAAA<br>CAGATTCTGTCTGACCGTATCTCTCTGTCCTTCCTGCCAGATGCCTTCACTGACGGCAAGCAGGTG<br>CTGAAGGCCATCTTCGACTTTTACAAGATCAACCTGCTGAGTTACACAATTGAAGGACAGGAAGA<br>GAGCCAGAATCTGCTGCTGCTGATCTCTCAGATTGTGGAGAATCTGAGCGGATTCGATAACCAGA<br>AAATGTACCTGAGAAACGACACCCATCTGACAACCATCTCCCAGCAGCTGTTCGGCGACTTCAGC<br>GTTTTTCAGCACCGCACTGAATTATTGGTATGAGACCAAAGTGAATCCAAAATTTGAAGCCGAGTA<br>CTCAAAGGCCAACGAGAAGAAACGCGAGGCCCTGGACAAGACCAAGGCCAACTTTACAAAGCAG<br>GACTATTTCAGTATCGCCTTCCTGCAGGAAGTGCTGGCAAACTACGTGCTGACACTGGATAAAAC<br>CAGCGACGTGGTGCAGAAGTTCACCCCCACCTGTGTGGCCGACTACTTCAATAATCACTTCGTGG<br>CCAAAAAGGAGAATGAGACCGACAAGACATTCGACCTGATCGCCAATATTACAGCCAAGTACCA<br>GTGCATCCAGGGCATTCTGGAGAATGCCGACAGGTACGAAGACGAGCTCAAACAGGATCAGAAG<br>CTGATCGACGATCTGAAGTTTTTCCTGGATGCTATCATGGAGCTGCTCCACTTCATTAAGCCACTC<br>CACCTGAAATCTGAATCCATTACCGAGAAGGACACCGCCTTCTATGACGTGTTTGAGAACTATTAC<br>GAAGCACTGAGCCTCCTGACACCTCTGTACAACATGGTCAGAAACTATGTGACCCAGAAGCCCTA<br>CTCCACCGAGAAAATCAAGCTGAACTTTGAGAACGCCCAGCTGCTCAACGGATGGGACGCTAATA<br>AGGAGGCCGACTACCTGACAACCATTCTGAAGAAGGATGGCAATTACTTCCTGGCTATCATGGAT<br>AAGAAGCACAATAAGGCCTTCCAGAAATTCCCTGAAGGAACCGACAACTACGAGAAGATGGTGT<br>ATAAGCTGCTGCCTGGCGTCAACAAAATGCTGCCCAAGGTGTTTTCTCAACAAAAACATCGCAT<br>ACTTCAACCCATCAAAGGAGCTGCTGGAGAACTACAAGAAGGAGACCCACAAAAAGGGCGACAC<br>CTTTAATCTGGAGCACTGCCACGCCCTGATTGACTTTTTCAAAGATTCTCTGAATAAGCACGAGGA<br>CTGGAAACACTTCGATTTTCAGTTCAGCGAAACTAAGAGCTACCAGGATCGTCTGGATTTTACCG<br>GGAAGTGGAGCACCAGGGCTACAAGATTAACTTCAAGAATATCGACAGTGAGTATATCGATGGC<br>CTGGTGAATGAGGGCAAGCTGTACCTGTTTCAGATCTATAACAAAGACTTTTCTCCCTATAGTAAA<br>GGGAAGCCAAACATGCACACCCTCTACTGGAAGGCTCTGTTTGGGAACAGAATCTGCAGAACG<br>TGATCTACAAACTGAACGGGCAGGCCGAGATCTTCTTTCGCAAGGCCAGCATCAAGCCAAAGAAT<br>ATCATCACCCACAAGGCCAACCAGCCCATCAAGGCCAAGAATCCCCTGACCCCCGAGGCCAAGAA<br>CACCTTCGAGTACGATCTGATTAAGGACAAGCGGTTCACCGTGGACAAGTTCCAGTTCCACGTGC<br>CTATCACTATGAACTTTAAGGCCACCGGCGGAAGCTACATCAACCAGGACGTGCTGGAGTACCTG<br>CAGAATAACCCAGAGGTGAAGATCATCGGACTGGACCGCGGAGAGAGGCACCTGGTGTACCTGA<br>CACTCATAGACCAGCAGGGAAATATCCTGAAGCAGGAGTCTCTGAACACCATCTCCGACACAAAG<br>ATTGCCACACCATACCACAAGCTGCTGGACAACAAGGAAAAAGAGCGCGATCTGGCCAGGAAGA<br>ACTGGGGCACAGTGGAGAATATCAAAGAGCTGAAGGAAGGATACATCAGCCAGGTGGTGCACA<br>AGATTGCCACAATGATGGTGGAGGAGAACGCAATCGTGGTGATGGAAGATCTGAACTTTGGATT |

TABLE S6B-continued

Human Codon Optimized Nucleotide Sequences Group 6

| SEQ ID NO | Corresponding AA | Sequence |
|---|---|---|
| | | CAAGCGCGGCAGATTCAAGGTGGAAAAACAGATTTACCAGAAGCTGGAAAAGATGTTGATCGAC<br>AAGCTGAACTACCTGGTGCTCAAAAACAAGCAGCCCCACGAACTGGGCGGCTTGTATAACGCCCT<br>GCAGCTGACAAACAAATTCGAGTCTTTCCAGAAAATGGGCAAGCAGAGCGGCTTTCTGTTTTACG<br>TGCCTGCCTGGAATACCTCAAAGATCGATCCCACAACAGGCTTCGTGAACTATTTTTACACCCAAAT<br>ATGAGAATGTGGAGAAAGCCAAAGCCTTTTTCGATAAGTTCCAGAGCATCCGCTTCAACACCCGG<br>GCAAACTACTTCGAGTTCGAGGTGAAAAAGTACTCTGATTTCAACCCTAAAGCCGAAGACACAAA<br>GCAAGAGTGGATGATCTGCACCTTCGGCGAGCGGATCGAGACCAAGAGACAGAAGGACCAGAA<br>CAACAATTTCGTGAGTACAACCATCAACCTGACCGAGAAACAGAGGATTTTTTCGGAAAGAACA<br>ACATCGTGTACGGCGACGGGAACTGTATCAAAAAGCAGATCGCCGCCAAGGAAGACAAGGACTT<br>CTTCGAGACCCTGCTGTATTGGTTTAAGATGACACTGCAGATGAGAAACTCAGTGACAGGAACCG<br>ATGAGGACTACCTGATCAGCCCCGTGATGAACGCCGATGGCATCTTCTACGACAGCAGGAAAGCC<br>GACAACAACCTGCCAAAGGATGCCGACGCCAACGGCGCTTATCACATCGCTAAAAAGGGACTCTG<br>GATACTGGAACAGATCAATAAGCCCAAGACCACAGAAGAACTGAAAAAGATCAAGCTGGCCATT<br>TCCAATAAGGAGTGGCTGCAGTACGTCCAGGAATGA |
| 83 | 79 | ATGAATACCACATACACCAACCTGTTTGCTCTGAGCAAGACACTGCGGTTCGAACTGATCCCTCAG<br>GGCAAGACCCTGCACTTTATCCAGGAGAAGGGCCTGATCACAAACGACAACAAGCGCGCCGAGT<br>CCTACCAGAAGATGAAGAAGACCATTGACGAGTTCCACAAGTATTTCATTGACCTGGCCCTGAA<br>AATGTGCGCCTGTCCTTTCTCGAGGACTATCTGGACCTGTACAATCAGAGCGCCGATTACAAAAA<br>GGAGCCCAAGTTCAAGGAGGAACTGAAGAAAGTCCAGGACAACCTGAGAAAGGAGATTGTGCT<br>GAGCTTCAGTAAGGATGAGGCAAAGACAATCTTCTCCATTCTGGATAAGAAAGAGCTGATAACCG<br>AGGAACTGGAGAAGTGGTTCGAAAACCAGGAGAAAAAGGACCTGCACTTCGACGACAAGTTCAA<br>AACATTCACTACCTACTTCACCGGGTTCCACCAGAATCGGAAGAACATGTATTCTTCAGAACCCAA<br>TTCCACCGCCATCGCCTACCGGTTGATCCACGAAAACCTGCCAAAATTTCTGGAAAACGCTAAGGC<br>CTTCGAACGCATTAAGCAGGTGCCTGAGCTGCAGCTGAAAATCGAAAAGATCTACAAGGATTTCG<br>AGCTGTATCTGAATGTCAACTCTATCGAGGAACTGTTCGAGCTGAATTACTTCAATGACGTGCTGA<br>CCCAGATGGGAATCGACGTGTATAACAATATCATCGGCGGGCGGACAGAAACAGATGGCAAGCC<br>AAAAATCCAGGGACTGAACGAGATCATCAACCTGTACAACCAGACCAAGTCCAAAAACGAAGA<br>CTGCCCAAGCTGAAGCAGCTGTATAAACAGATCCTGAGCGACCGGGTGTCCCTGTCATTTCTGCCT<br>GACGCCTTCACAGACGGAAAACAGGTGCTGCAGGCCATCTTCGCCTTCTATAAAGTGAACATTCT<br>GTCCTATACGATCGACGGCCAGGCCGAGAGCAAGAATCTGCTGGAGCTGATTCAGCAGCTCCTG<br>GCCAACATCTCTTCCTTCGAGACAGAGCGGATCCACCTGAAGAACGACACCAATCTGACAACCAT<br>CTCCCAGCAGCTGTTCGGAGACTTTTTCTGTGTTCAGCACGGCCCTGAACTACTGGTACGAAACCAA<br>AGTGTACCCCAAGTTCGAAGCAGAGTATACCAAGGCCACCGAGAAGAAGAGGGAAACGCTGGA<br>GAAGACCAAAGCCGTGTGTTTACCAAGCAGGATTACTTTTCTATTGCCTTTCTGCAGGAAATCATTAC<br>TGAGTATAGTCTGTCACTGGATAAGGACTCAGAGCTGATCACTAAAATCACCCCCACATGTGTGG<br>CCGACTACTTCAAAAATCACTTCGTGGCCAAGAAGGAGAACGAGACCGATAAAACCTTCGGGTTC<br>CTGGCTAACATCACAGCCAAGTACCAGTGCATCCAGGGTACTCTGGAAAATGCCACAAACTATAA<br>CGAGGAGCTGAAGCAGGATCAGAAGCTGATTGATGACATCAAGCTGTTCCTGGATACCCTGCTG<br>GAACTGCTGCACTTCATCAAGCCACTGCACCTCAAGAGCGACTCCATCACTGAAAAAGACAACGC<br>ATTTTACGACCTGTTCGAGAATTACTACGAGGCACTGTCTCTGCTGACCCCCCTGTACAACATGGT<br>CAGAAATTACGTGACACAGAAGCCATATAGCACCGAGAAAATTAAGCTGAATTTCGAAAACGCCC<br>AGCTGCTGAACGGATGGGACGTTAACAAGGAGGCCGATTACCTCACCACCATCCTGAAGAAGGA<br>GGGAAACTACTTTCTGGCCATTATGGATAAGAAACACAACAAGGCTTTTCAGAAGTTTCCCGAGG<br>GCGAGAACAACTACGAGAAGATGACCTATAAGCTGCTGCCAGGCGTGAACAAGATGCTGCCCAA<br>GGTGTTTTTCAGCAACAAGAATATCGCATACTTCAATCCTTCCAAGGAGCTGGTGGAGAATTATAA<br>GAACGAGACCCATAAGAAAGGCGAGAAATTTAACCTGCTGCATTGCAGGCAGCTGATCGATTTCT<br>TTAAGGACTCAATCAACAAGCATGAGGATTGGAAACACTTTGATTTCCAGTTCAGCGAGACCAAA<br>AGCTACCAGGATCTGAGCGGCTTTTACCGGGAGGTGGAGCATCAGGGCTATAAAATTAACTTCAA<br>AAACATCGACAGTGCCTATATCGACAGCCTGGTGAATGAGGGGAAGCTGTTTCTGTTCCAGATCT<br>ATAACAAGGACTTTTCTCCATTCTCTAAGGGGAAGCCAAATATGCACACCCTGTACTGGAAAGCCC<br>TGTTTGAGGACCAGAATCTGAAGAACGTGAAGTACAAGCTGAACGGGCAGGCTGAGATCTTTTTC<br>AGAAAGGCCAGCATCAAACCGGAGAACATCATCACTCACAAGGCAAACCAGTCTATCAAAGCAA<br>AGAATCCCCTGACCCCTGACGCCAAAAATACTTTCGATTACGACCTGATCAAGGATAAGAGGTAC<br>ACAGTGGACAAATTCCAGTTCCACGTGCCTATCACCCTGAACTTTAAGGCCACCGGGGGATCTTTT<br>ATCAACCAGAATGTGCTGGAATACCTGAAAGAGAACCCTGAGGTCAAGATTATCGGACTGGACA<br>GGGGCGAGCGCCACCTCGTGTATCTGACCCTGATCGACCAGCAGGGTAATATTCTGAAGCAGGA<br>GTCCCTGAACACTATCACTGATGCAAAGATCGCCACCCCTTATCACCAGCTCCTGGACATCAAGGA<br>GAAGGAGCGGGACTTTGCCAGGAAGAATTGGGGCACCGTGGAGAACATCAAGGAGCTGAAAGA<br>GGGATATATCTCACAGGTGGTGCATAAAATCGCTACCATGATGGTGGAGGAGAACGCAATCGTG<br>GTCATGGAGGACCTGAACTTTGGCTTCAAGCGCGGAAGATTCAAGGTGGAAAAGCAGATCTACC<br>AGAAGCTCGAAAAGATGCTGATCGACAAACTGAATTACCTGGTTCTGAAAGACAAGCAGCCCACC<br>GAGCTCGGCGGGCTGTACAACGCCCTGCAGCTGACAAACAAGTTTGAGAGCTTCCAGAAGATGG<br>GAAAGCAGAGTGGCTTCCTGTTCTACGTGCCTGCTTGGAACACCAGCAAATTGATCCCACAACC<br>GGCTTCGTGAACTACTTTTTCACAAAATATGAGAATGTGGACAAGGCCAAGGTGTTCTTCGACAA<br>GTTTCAGTCTATCAGATACAATACAAAGGCCAACTACTTCGAGTTTGAGGTGAAGAAATATTCCG<br>ACTTCAACCCTAAGGCCGAAGGGACCCTGCAGGAGTGGACCGTCTGTAGCTACGGCGAACGCAT<br>TGAGACCAAACGGCTGAAGGACCAGAATAACAACTTCGTGTCCACACCTATCAACCTGACCGAGA<br>AAATCGAGGACTTCCTGGGCAGGAACAACATCGTGTACGGCGACGGCACATGCATCAAAAGCCA<br>GATTGCAGAGAAGAATGCAAAGGAGTTCTTTGAAGGACTGCTGTACTGGTTCAAAATGACTCTGC |

TABLE S6B-continued

Human Codon Optimized Nucleotide Sequences Group 6

| SEQ ID NO | Corresponding AA | Sequence |
|---|---|---|
| | | AGATGAGAAACAGCGCCACCGGAACAGACGAGGATTACCTGATTTCTCCGGTGATGAATGCCCAGGGCGAGTTCTACGACTCCAGGAAGGCCGACGAAACCCTGCCTAAGGATGCCGACGCTAATGGCGCTTACCACATCGCCAAGAAAGGACTGATGTGGCTGGAACAGATCAAGAGCTTCGACGGAAATGACTGGAAGAAGCTGGAGCTGGACAAAAGCAATAGGGGATGGCTGCAGTACATCCAGCAGAGGAAGTGA |

TABLE S6C

Direct Repeat Group 6

| SEQ ID NO | Direct Repeat (Variant #1) | SEQ ID NO | Direct Repeat (Variant #2) |
|---|---|---|---|
| 84 | GGCTACAAAACCTTTTAAATTTCTACTATTGTAGAT | 85 | GCTACAAAACCTTTTAAATTTCTACTATTGTAGAT |
| 86 | ATCTACAATAGTAGAAATTTAGTTTGTCTTTAAAAC | 87 | ATCTACAATAGTAGAAATTTAGTTTGTCTTTAAAAC |
| 88 | GTTTTTAAGACCAATTAAATTTCTACTATTGTAGAT | 89 | GTTTTTAAGACCAATTAAATTTCTACTATTGTAGAT |
| 90 | ATCTACAATAGTAGAAATTTAAAAGGTCTTGAAAAC | 91 | ATCTACAATAGTAGAAATTTAAAAGGTCTTGAAAAC |

TABLE S6D crRNA Sequences Group 6

Figure 6A:
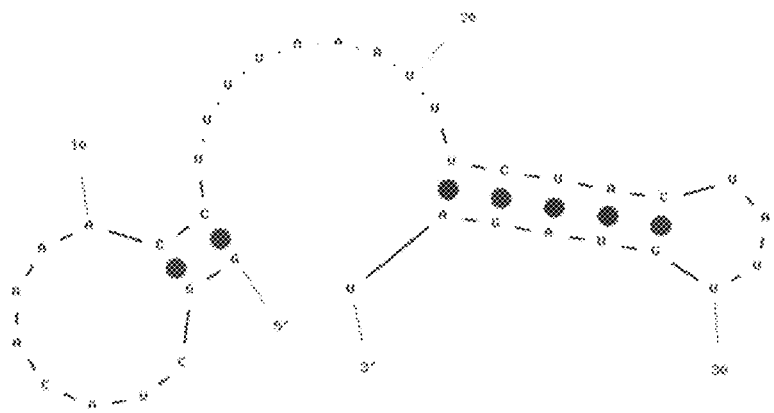
FIG. 6A-6D (SEQ ID NOs:92-95) are schemes depicting the predicted stem loop structures of crRNA sequences of the present disclosure corresponding to Group 6 sequences.
Figure 6B:
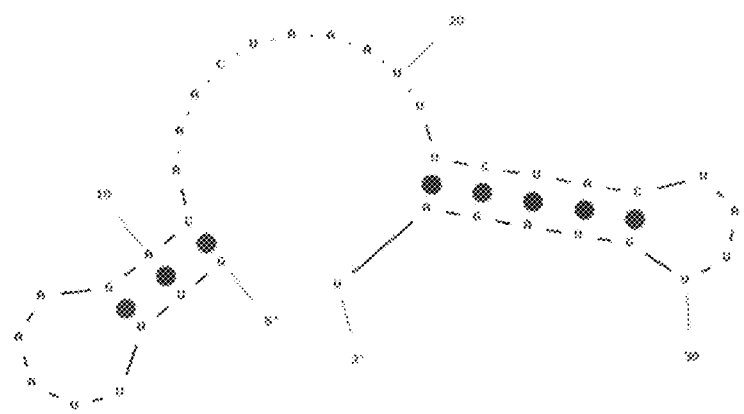
Figure 6C:
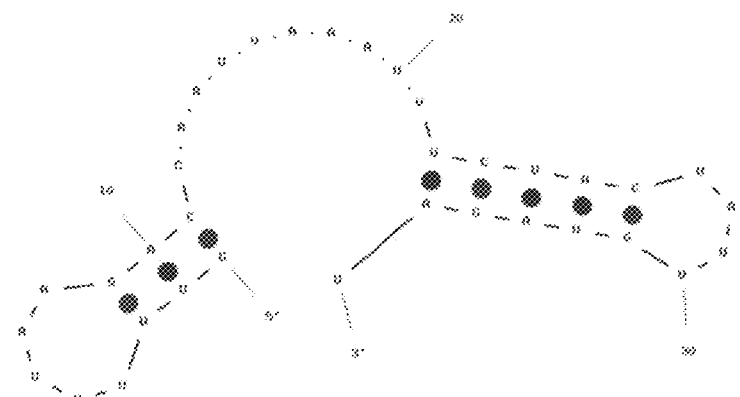
Figure 6D:
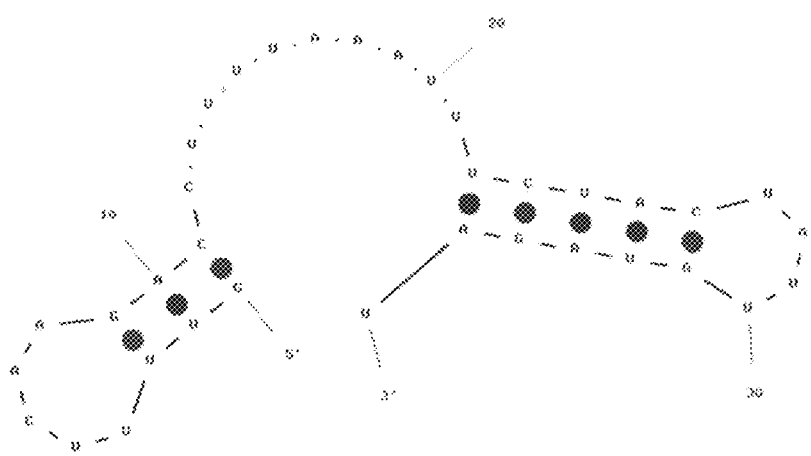

| SEQ ID NO | Sequence | FIG. |
|---|---|---|
| 92 | GGCUACAAAACCUUUUAAAUUUCUACUAUUGUAGAU | FIG. 6A |
| 93 | GUUUUAAAGACAAACUAAAUUUCUACUAUUGUAGAU | FIG. 6B |
| 94 | GUUUUUAAGACCAAUUAAAUUUCUACUAUUGUAGAU | FIG. 6C |
| 95 | GUUUUCAAGACCUUUUAAAUUUCUACUAUUGUAGAU | FIG. 6D |

G. Group 7 Type V Nuclease and Associated Sequences
(SEQ ID Nos: 100-117)

TABLE S7A

Enzyme Sequences Group 7

| SEQ ID NO | Sequence |
|---|---|
| 100 | MKEIKELTGLYSLTKTIGVELKPVGKTQELIEARKLIEQDDQRAEDYKIVKDIIDRYHKDFIDKCLNCVKIKKDDLEKYVSLAENSNRDAEDFDNIKTKMRNQITEAFRKNSLFTNLFKKNLIKEYLPAFVSEEEKSVVNKFSKFTTYFDAFNDNRKNLYSGDAKSGTIAYRLIHENLPMFLDNIASENTISEIGVNEYFSGIEAEFTDTLDGKHLVDFFQVDYFNNTLTQKKIDNYNYVVGAVNKAVNLYKQQHKNVRIPLLKTLHKMILSDRVTPSWLPERFECDEEMLTAIKAAYESLKEVLVGDDDDSLRNLLLNIDNFDLEHIYIAKDSGLTSISQQIFGYYDTYTLAIKDQLQRENPNLYDERIDKLYKKEGSFSIAYLNRLVDTKEHITINEYYRLLGSYCREEGKRKDDFFKQIDGAYCAISHLFWGKHGEIAQSDSDIELIQKLFDDYKGLQRFIKPLLGHGDEADKDNEFDAKLRKVWDELDIITPLYDKVRNWLSRKIYNPEKIKLCFENNGKLLSGWSDNQTKSDNGTQYGGYIFRKKNEIGEYDFYLGISADAKLFRRDENICYEDGMYERFDYYHLTPNTLLGKSYIGNYGEDSKAVLSAFNAAITKLQLEKKLVPKDNEKVPTYLKRLKQNYANFYQILMNDDNVVDAYKSMKQHIFATLTSLIRVPAAIELATQTDLDIDELIDEILNLSSESFGYFPVATAAIEEANKREKKPLFLFKMSNKDLSYAAKSSEGLRKSRGTENLHTMYLKALLGMTQNVFSIGSGMVFFRHKTKGLAETTARHKANEFVANKNLNDKKKSIFAYEIVKNKRYTVDKYLFKLSVKLNYSQPNNNKIDVNSEVREIISNGGIKHIIGIDRGERNLLYLSLIDLKGNIVMQKSLNILKNEHNVKGTDYKGLLTEREGERQDARRNWKKIANIKDLKRGYLSQVVHIISKMMVEYNAIVVLEDLNPGFIRGRQKIERNVYEQFERMLIDKLNFYVDKHKDANETGGLLHALQLTSEFENFKKSEHQNGCLFYIPAWNTSKIDPATGFANLFDTRYTNAVEAQKFFSKFDEIRYNE |

TABLE S7A-continued

Enzyme Sequences Group 7

| SEQ ID NO | Sequence |
|---|---|
| | EKDWFEFEFDYDKFTQKAHGTRTKWTLCTYGMRLRSFKNPAKQYNWDSEVVALTDEFKRILGKAGIDIHENLKD AICNLEGKKDLEPLMQFMKLLLQLRNSRKNPEEDYILSPVADENGIFYDSRSCGDTLPKNADANGAYNIARKGLM LIEQIKNTEDLDTIKFDISSKAWLNFAQQKPYKNG |
| 101 | MKEIKELTGLYSLTKTIGVELKPVGKTQELIEAKKLIEQDDQRAEDYKIVKDIIDRYHKDFIDKCLNCVKIKKDDLEKY VSLAENSNRDAEDFDNIKTKMRNQITESFKKNPLFVGLFKKELITNYLPNFVSEEERVVVNKFSKFTTYFDAFNDN RKNLYSGDAKSGTIAYRLIHENLPMFLDNIASFNKISETGVNKYFSDIENEFTAILYEMHLSDLFQIDYFNNTLTQKKI DNYNYIVGAVNKAVNLYKQQHKTVRVPLLKTLHKMILSERVTPSWLPERFESDEEMLTAIKETYESLKDVLVGGN DDSLRNLLLNIDNFDLEHIYIANDSGLTSISQQIFGYYDTYTLAIKDQLQRENPATKKQRENPATKKQRENPNLNDD CIDKLYKKEGSFSIAYLNRLVDTKEHITINEYYRLLGSYWREEGKRKDDFFKQIDGAYSDMLYLFSTEHGEIAQSDSD TAVVQQLLEAYKGLQRFIKPLLGHGDEADKDNEFDAKLRKVWDELNIITPLYDKVRNWLSRKIYNPEKIKLYFENN GKLLSGWSDSQTEKDNGTQYGGYIFRKKNEIGEYDFYLGISTDAKLFRRDETICYEDGMYERFDYYHLKPTTLLGKS YIGNYGEDSNAVLSAFKNAVTKLHLEKKLVPKDNEKVPTYLKRLKQKYANFYQILMNDVNVVDAYKSMKQHILAT LASLIRVPAAIELAAQTDLDIDELIDEIMNLPSESFGYFPVATAAIEEANKREKKPLFLFKMSNKDLSYAAKSSEGLRK SRGTENLHTMYLKALLGMTQNVFSIGSGMVFFRHKTKGLAETTARHKANEFVANKNKLNDKKKSIFAYEIVKNKR FTVDKYLFKLSVKLNYSQPNNNKIDVNSEVREIISNGGIKHIIGIDRGERNLLYLSLIDLKGNIVMQKSLNILKDDHNA KGTDYKGLLTEREGERQDARRNWKKIANIKDLKRGYLSQVVHIISKMLVEYNAIVVLEDLNPGFIRGRQKIERNVY EQFERMLIDKLNFYVDKHKDINEVGGLLHAFQLTSEFKKFKKSEYQNGCLFYIPAWKTSKIDPATGFANLLDTRYT NADKALEFFRKFDAIRYNEEKDWFEFEFDYDKFTQKAHGTRTKWILCTHGKRLRFKRNSTRVQEVVVLTDEFKKIL GEAGIDIHVNLKEAICNLEGKKNLEPLMQFMKLLLQLRNSKAGTDEDYILSPVADENGIFYDSRSCGEQLPENADA NGAYNIARKGLMLIRQIKEAKELDKVKFDISNKAWLNFAQQKPYKNG |
| 102 | MKEIKELTGLYSLTKTIGVELKPVGKTQELIEARKLIEQDDQRAEDYKIVKDIIDRYHKDFIDKCLNCVKIEKDDLEKY VSLTENSNREAVDFDNIKTKMRNQITESFKKNPLFVGLFKKELITNYLPNFVSEEERVVVNKFSKFTTYFDAFNNNR KNLYSGDAKSGTIAYRLIHENLPMFLDNIASFNKISETRVNEYFSSIEAEFTDTLNGKHLADLFQIDYFNNTLTQKKI DNYNYIVGAVNKAVNLYKQQHKNIRIPLLKKIHKMILSDRVTPSWLPERFESDEEMLTAIKAAYESLKEVLVGDDD DSLRNLLLLNIDNFDLEHIYIAKDSGLTSISQQIFGYYDTYTLAIKDQLQRKNPATKKQRENPNLYDERIDKLYKKEGSF SIAYLNRLVDTKEHITINEYYRLLGSYCREGGKSNDDFFKQIDGAYSAISYLFSAEHGEIAQSDSDTAVVQKLLEAYK GLQRFIKPLLGHGDEADKDNEFDVKLRKVWDELNIITPLYDKVRNWLSRKIYNPEKIKLYFENNGKLLSGWSDSQT EYDNGTQYGGYIFRKKNEIGEYDFYLGISADAKLFRRDETICYEDGMYERLDYYNLKPNTLLGNSYIGNYGEDSNA VLSAFNDAVTKLHLEKKLVPKDNEKVPTYLKRLKQDYANFYQILMNDNNVVDAYKSMKQHILATLASLIRVPAAIE LTTQTNLDIDKLIDEIINLPSESFGYFPVATAAIEEANNREKKPLFLFKMSNKDLSYAEKFSKGDRKSRGTENLHTMY LKALLGMTQNVFSIGSGMVFFRHNTEGLAETTARHKANEFIANKNKLNDKKKSIFDYEIVKNKRFTVDKYLFHLSL KLNYTQPNKFDINSKVREIIRNGGIKHIIGIDRGERNLIYLSLIDMEGNIVMQKSLNILKDDHNAKGTDYKGLLTERE GENKEARRNWKKIANIKDLKRGYLSQVVHIISKMMVEYNAIVVLEDLNPGFIRGRQKIERNVYEQFERMLIDKLN FYVDKHKDANETGGLLHALQLTSEFKNFKKSEHQNGCLFYIPAWNTSKIDPATGFVNLFDTRYTNAEKALEFFRKF DAIRYNEEKDWFEFEFDYDEFTQKAHGTRTRWTLCTHGKRLRSFRNPAKQYNWDSEVVALTDEFKRILGEAGIDI HENLKDAIRNLEGKRRKYLEPLMQFMKLLLQLRNSRKNPEEDYILSPVADENGVFYDSRSCGDTLPKNADANGAY NIARKGLMLIRQIKEAKELGKVKYDISNKAWLNFAQQKPYKNE |

TABLE S7B

Human Codon Optimized Nucleotide Sequences Group 7

| SEQ ID NO | Corresponding AA | Sequence |
|---|---|---|
| 103 | 100 | ATGAAGGAGATAAAAGAGCTCACTGGCCTTTATTCCCTTACCAAGACAATCGGCGTCGAGCTAAA ACCTGTAGGGAAGACACAGGAGCTGATTGAGGCCCGAAAACTCATAGAGCAGGATGACCAAAG AGCAGAGGATTACAAGATAGTAAAGGACATCATCGATCGCTATCATAAGGACTTTATTGACAAGT GCTTAAACTGTGTCAAGATAAAAAAGGACGATTTAGAGAAGTACGTCTCGCTGGCGGAAAACTC CAACCGTGATGCCGAGGATTTTGACAACATAAAGACCAAATGCGGAATCAGATCACGGAGGCT TTTCGAAAGAACTCACTGTTTACAAACCTCTTCAAGAAAAACCTCATTAAGGAGTATCTCCCCGCT TTCGTTTCTGAGGAGGAGAAATCAGTGGTGAATAAGTTTTCAAGTTCACAACCTATTTCGATGC TTTCAACGATAACCGTAAAAACCTGTACAGCGGCGACGCCAAATCTGGGACCATAGCTTATCGTC TCATCCATGAAAACCTTCCAATGTTTCTCGACAATATCGCCAGTTTTAACACTATTAGCGAGATCG GTGTGAACGAATATTTCAGCGGCATTGAAGCAGAGTTTACAGATACCCTGGATGGCAAGCATCT GGTCGATTTTTTCCAGGTCGATTACTTCAACAATACACTTACGCAGAAAAAGATCGATAACTACA TTACGTGGTTGGGGCCGTCAACAAAGCTGTGAATCTGTATAAGCAGCAACACAAGAACGTTCGT ATTCCCTTGTTAAAGACGCTCCATAAAATGATTCTTAGTGACGAGTGACTCCGTCATGGCTGCCC GAGCGGTTTGAATGCGATGAGGAGATGCTGACCGCCATTAAAGCCGCATACGAGAGTCTAAAAG AAGTGCTCGTGGGCGACGATGATGACAGTCTGCGCTCAATATCGCAACCTTGAC CTTGAACATATCTATATTGCGAAAGATAGCGGGTTAACCTCTATCAGCCAGCAGATTTTCGGTTAT TATGACACCTACACACTGGCCATCAAAGATCAGCTTCAACGAGAGAACCCCAATTTATACGACGA AAGGATTGACAAACTCTACAAAAAGGAGGGCTCTTTTTCTATTGCCTATTTGAACAGGCTGGTGG ATACCAAGGAGCATATAACAATCAACGAGTACTATAGGCTGTTAGGATCATATTGTAGGGAAGA GGGGAAGAGAAAAGATGACTTTTTCAAGCAAATCGACGGGGCTTACTGTGCAATTTCCCATTGT TTTGGGGTAAGCATGGTGAGATCGCACAATCAGACTCAGACATAGAACTCATCCAGAAACTATTT GATGACTACAAAGGACTGCAGAGATTATCAAGCCTCTGCTCGGCCACGGAGATGAGGCTGACA AGGATAACGAATTTGATGCTAAATTGCGAAAGTCTGGGACGAATTGGATATTATCACCCCATTG TATGACAAAGTCAGAAATTGGCTTTCAGAAAAATCTACAACCCGGAAAAGATCAAATTGTGCTT |

TABLE S7B-continued

Human Codon Optimized Nucleotide Sequences Group 7

| SEQ ID NO | Corresponding AA | Sequence |
|---|---|---|
| | | CGAGAATAACGGCAAGTTACTGTCTGGCTGGTCTGATAATCAAACTAAAAGCGATAACGGGACT<br>CAGTATGGAGGCTATATTTTTCGGAAGAAAAACGAAATCGGGGAGTACGACTTCTATCTGGGCA<br>TCTCCGCGGACGCAAAACTCTTCCGGCGCGATGAGAACATCTGCTATGAAGATGGCATGTACGA<br>AAGATTCGATTACTATCACCTGACTCCAAACACCCTGCTTGGTAAATCATACATCGGAAATTATGG<br>GGAGGATAGCAAAGCAGTACTATCAGCCTTCAATGCAGCCATAACTAAACTACAACTGGAGAAG<br>AAACTGGTACCCAAAGATAATGAGAAAGTACCTACATACCTTAAGCGGCTGAAGCAGAATTACG<br>CAAATTTCTACCAAATCCTGATGAATGACGACAATGTGGTGGATGCTTATAAAAGCATGAAACAG<br>CACATCTTCGCCACGCTCACCTCCCTTATCCGCGTCCCTGCAGCTATTGAACTCGCCACCCAGACT<br>GACCCTGGACATTGACGAGCTGATCGACGAAATCTTGAATTTGAGCAGTGAGTCTTTCGGGTACTT<br>CCCAGTGGCCACCGCCGCTATTGAGGAAGCCAACAAAAGAGAAAAAAAGCCGCTGTTCCTCTTC<br>AAGATGAGTAATAAAGACCTATCATACGCCGCAAAGTCCTCTGAAGGATTGAGAAAGAGTAGGG<br>GAACCGAGAACCTGCATACTATGTATCTGAAAGCGCTACTGGGGATGACACAAAACGTGTTCAG<br>CATTGGGAGCGGTATGGTCTTCTTCAGGCACAAAACAAAAGGCCTGGCGGAAACTACGGCTAGG<br>CACAAAGCCAATGAGTTCGTGGCCAACAAGAATAAGCTCAATGATAAGAAGAAGAGCATCTTCG<br>CTTACGAAATTGTCAAGAATAAACGGTATACTGTAGATAAGTACCTCTTCAAACTGTCAGTCAAG<br>CTGAATTACTCCCAGCCCAACAATAATAAGATCGATGTGAATTCCGAGGTGCGGGAAATAATCTC<br>TAATGGAGGTATTAAGCACATTATCGGAATCGATAGGGGAGAGAGGAATCTTCTCTATCTTAGCC<br>TGATCGACCTAAAAGGAAATATTGTGATGCAGAAGTCCCTCAACATTTTAAAGAACGAACATAAC<br>GTGAAGGGCACAGACTACAAAGGCCTTTTAACAGAACGCGAAGGCGAACGCCAGGATGCCAGA<br>CGCAATTGGAAGAAAATTGCGAACATCAAGGATCTGAAGAGGGGCTACTTGAGTCAGGTTGTGC<br>ACATTATCAGCAAGATGATGGTGGAGTACAATGCAATAGTTGTGTTAGAAGACTTGAACCCCGG<br>ATTCATACGAGGACGCCAGAAGATAGAAAGGAACGTTTACGAGCAGTTTGAGCGGATGCTCATT<br>GACAAGCTTAACTTTTACGTTGACAAGCACAAGGACGCCAACGAAACAGGTGGCCTGTTGCACG<br>CTCTGCAGTTGACGTCTGAGTTTGAGAATTTTAAGAAGTCTGAACACCAGAACGGCTGCCTATTC<br>TATATCCCTGCCTGGAACACTTCCAAGATCGACCCCGCCACCGGATTTGCTAATCTGTTCGACACT<br>CGGTACACCAATGCCGTTGAGGCGCAGAAGTTTTTTTCCAAATTCGACGAAATTCGTTACAACGA<br>AGAGAAGGATTGGTTCGAAATTTGAGTTCGATTACGACAAATTCACACAGAAGGCACACGTACC<br>CGAACAAAGTGGACCCTCTGCACTTATGGGATGAGGCTGCGGAGCTTTAAGAACCCTGCCAAAC<br>AATATAATTGGGATAGTGAGGTTGTGGCTTTGACAGACGAATTCAAGAGAATACTGGGGAAGGC<br>TGGAATCGATATTCACGAAACCTGAAAGACGCCATTTGTAACCTCGAGGGTAAAAAGGACCTG<br>GAACCTCTGATGCAGTTTATGAAGCTGCTGCTGCAGCTTCGCAATTCTCGGAAGAACCCAGAAGA<br>GGATTACATTCTGTCGCCTGTGCAGACGAGAATGGCATTTTTTACGACTCCCGCAGTTGTGGCG<br>ACACCTTGCCAAAGAATGCCGACGCCAATGGGGCATATAACATCGCAAGAAAAGGGCTGATGCT<br>GATTGAGCAGATCAAAAATACCGAGGACCTCGACACTATCAAATTCGATATAAGCTCCAAGGCTT<br>GGCTGAACTTTGCTCAACAGAAGCCATATAAGAATGGATGA |
| 104 | 101 | ATGAAGGAGATTAAGGAACTGACCGGGCTGTACAGCCTCACCAAGACAATCGGGGTGGAGCTG<br>AAGCCCGTGGGGAAGACACAGGAGCTGATCGAGGCCAAAAAGCTGATCGAACAGGACGACCAG<br>CGTGCCGAGGACTACAAAATAGTGAAAGATATCATCGACCGGTACCACAAGGACTTCATTGATA<br>AGTGCCTGAATTGTGTGAAGATCAAGAAGGATGACCTGGAGAAGTACGTCAGTCTGCTGAGAA<br>TTCTAACAGAGACGCCGAGGATTTCGATAATATTAAAACCAAGATGCGGAATCAGATCACAGAA<br>AGCTTCAAGAAGACCCACTCTTCGTGGGCTGTTTAAGAAGGAGCTGATCACGAATTACCTGCC<br>AAACTTCGTGAGCGAGGAGGAAAGAGTCGTGGTGAATAAATTCAGCAAGTTCACCACCTATTTC<br>GATGCCTTTAATGACAATCGGAAGAACCTGTACTCCGGCGATGCCAAGTCCGGCACCATCGCATA<br>TCGGCTGATCCACGAGAACCTGCCCATGTTTCTGGACAATATCGCCAGCTTCAACAAAATCAGCG<br>AAACCGGCGTGAACAAATACTTCTCAGACATCGAGAACGAGTTCACAGCCATCCTGTACGAGAT<br>GCACCTGTCCGATCTGTTCCAGATCGACTACTTTAATAATACCCTGACCCAGAAGAAGATTGACA<br>ACTACAACTACATCGTGGGTGCTGTGAACAAGGCCGTGAACCTCTATAAGCAGCAGCACAAGAC<br>CGTGAGGGTACCTCTGCTCAAGACCCTGCACAAGATGATCCTGTCCGAGCGGGTGACACCCAGC<br>TGGCTGCCAGAGCGCTTCGAAAGCGATGAGGAGATGCTGACCGCCATCAAAGACCTACGAGT<br>CCCTGAAGGATGTGCTGGTGGGCGGGAACGACGATAGTCTGCGCAACCTGCTGCTCAACATCGA<br>CAACTTCGACCTGGAGCACATTTACATCGCCAACGATAGCGGCCTGACCAGCATCAGCCAGCAGA<br>TCTTCGGGTACTACGACACTTACACACTGGCCATCAAGGACCAGCTGCAGAGAGAATCCTGCC<br>ACCAAGAAACAGAGAGAGAATCCTGCTACCAAAAAGCAGAGAGAAAATCCAAACCTGAATGAT<br>GACTGCATCGACAAGCTGTATAAGAAGGAGGGCTCTTTCAGCATTGCCTACCTGAATAGGCTGGT<br>GGACACCAAGGAGCACATCACCATTAACGAATATTATCGACTGCTGGGGAGCTATTGGAGGGAG<br>GAGGGAAAAAGAAAGGACGACTTCTTCAAGCAGATTGATGGCGCCTACAGCGACATGCTGTATC<br>TTTTTTTCCACAGAACACGGGGAGATCGCACAGTCTGACAGCGACACAGCCGTGGTGCAGCAGCT<br>GCTGGAGGCCTACAAGGGCTGCAGAGATTTATCAAACCTCTGCTGGGCCACGGGACGAGGC<br>TGACAAGGATAACGAATTTGACGCCAAACTGAGGAAGGTGTGGGATGAACTGAATATTATCACC<br>CCCCTGTACGACAAGGTGAGGAATTGGCTGAGCAGAAAATTTATAATCCAGAGAAGATCAAGC<br>TGTACTTTGAGAACAATGGGAAGCTGCTGAGCGGGTGGTCAGATAGCCAGACCGAGAAGGACA<br>ACGGCACTCAGTACGGCGGCTACATCTTTCGGAAAAAAAATGAAATAGGAGAATACGATTTCTAC<br>CTGGGAATCAGTACCGACGCCAAGCTCTTCCGCAGAGACGGACAATCTGCTACGAGGACGGCA<br>TGTACGAGAGGTTTGATTATTATCACCTGAAGCCAACCACACTGCTCGGCAAGAGCTACATTGGC<br>AATTACGCGAGGACAGTAACGCCGTTCTGAGCGCCTTCAAAAACGCAGTGACCAAGCTGCACC<br>TGGAGAAGAAGCTGGTCCCTAAGGACAACGAAAAGTCCCTACCTACCTGAAGAGGCTCAAGCA<br>GAAATACGCTAACTTCTACCAGATCCTGATGAATGATGTGAATGTGGTGGACGCCTACAAGTCTA<br>TGAAGCAGCACATCCTGGCTACCCTGGCTTCCCTGATCAGATGCCCTGCCGCCATTGAACTGGCA<br>GCCCAGACCGACCTGGACATCGATGAGCTGATCGACGAGATCATGAACCTGCCTTCTGAGAGCTT<br>CGGATACTTTCCCGTGGCAACCGCCGCCATCGAGGAAGCTAACAAAAGAGAAAAGAAGCCCCTG<br>TTTCTGTTCAAGATGTCCAATAAAGACCTGAGCTACGCCGCTAAGTCTTCCGAGGGCCTTAGAAA<br>GAGCAGAGGGACAGAGAACCTGCACACAATGTACCTTAAGGCCCTGCTGGGCATGACACAGAAC<br>GTCTTTAGCATCGGCTCTGGCATGGTGTTCTTTAGACACAAGACCAAGGGACTGGCCGAAACCAC |

TABLE S7B-continued

Human Codon Optimized Nucleotide Sequences Group 7

| SEQ ID NO | Corresponding AA | Sequence |
|---|---|---|
| | | AGCCCGGCACAAGGCCAACGAGTTTGTGGCCAATAAAAATAAGCTGAACGACAAGAAAAAGAG<br>TATCTTCGCTTACGAGATTGTGAAGAACAAGAGATTTACAGTCGACAAGTACCTGTTTAAGCTGA<br>GCGTGAAGCTCAACTACTCCCAGCCCAATAACAACAAAATCGACGTGAACAGCGAGGTGAGAGA<br>AATCATCTCTAACGGCGGGATCAAGCACATCATCGGCATCGACCGGGGGGAGCGCAACCTCCTG<br>TACCTGAGCCTGATCGACCTGAAGGGCAATATCGTGATGCAGAAGAGCCTGAATATCCTGAAAG<br>ATGATCATAACGCAAAAGGAACCGACTACAAGGGGCTGCTCACTGAGCGGGAGGGCGAGAGGC<br>AGGACGCCAGACGCAACTGGAAGAAGATCGCCAACATCAAGGATCTGAAAAGAGGATACCTGT<br>CCCAGGTGGTGCATATTATCTCCAAGATGCTCGTGGAGTACAACGCTATCGTGGTGCTGGAGGA<br>CCTGAATCCAGGCTTTATTCGGGGACGGCAGAAGATCGAGAGAAATGTGTACGAGCAGTTCGAG<br>AGAATGCTGATTGACAAACTGAACTTTTATGTGGATAAGCACAAGGATATCAATGAGGTGGGCG<br>GACTGCTGCACGCTTTTCAGCTCACCAGTGAGTTCAAGAAGTTCAAAAAATCAGAATATCAGAAT<br>GGCTGCCTCTTCTACATCCCTGCATGGAAGACAAGCAAGATTGATCCAGCTACCGGCTTCGCTAA<br>CCTGCTGGACACCCGCTACACAAACGCCGATAAGGCCCTGGAGTTTTTTCGCAAGTTCGACGCCA<br>TCAGATACAACGAGGAGAAAGATTGGTTTGAGTTTGAGTTTGACTATGACAAATTTACACAGAAA<br>GCTCACGGCACACGGACCAAGTGGATTCTGTGCACCCATGGAAAGAGACTGCGGTTCAAGAGAA<br>ATAGCACCAGAGTGCAGGAAGTGGTGGTGCTGACAGACGAGTTTAAGAAAATCCTGGGGGAGG<br>CAGGAATTGATATCCACGTGAACCTCAAAGAAGCCATCTGCAACCTGGAGGGCAAAAAGAACCT<br>GGAGCCCCTGATGCAGTTTATGAAGCTGCTGCTGCAGCTGAGGAATAGCAAGGCCGGCACAGAC<br>GAGGACTACATTCTGTCCCCTGTGGCTGACGAAAACGGCATCTTTTACGATTCCAGGTCCTGCGG<br>CGAACAGCTGCCAGAGAACGCTGACGCTAATGGCGCCTATAATATCGCCAGGAAGGGGCTGATG<br>CTGATTCGGCAGATCAAGGAGGCCAAAGAGCTGGACAAAGTGAAGTTCGACATCAGCAACAAG<br>GCCTGGCTGAACTTTGCCCAGCAGAAGCCTTACAAGAATGGCTAG |
| 105 | 102 | ATGAAAGAAATTAAAGAGCTGACCGGACTGTACTCCCTGACCAAGACCATCGGGGTGGAACTGA<br>AGCCTGTGGGAAAGACCCAGGAGCTGATCGAGGCCCGTAAACTGATTGAGCAGGACGATCAGA<br>GAGCCGAGGATTACAAGATCGTGAAAGACATCATCGATAGATACCACAAGGACTTTATCGATAA<br>GTGTCTGAACTGTGTGAAAATTGAAAAAGACGACCTGGAGAGTATGTGTCCCTGACCGAAAAT<br>TCCAACAGAGAGGCTGTGGACTTCGACAATATCAAAACAAAAATGAGGAACCAAATCACCGAGA<br>GCTTTAAGAAGAACCCTCTGTTCGTTGGGCTGTTCAAGAAGGAGCTGATCACAAACTATCTGCCA<br>AACTTCGTGTCCGAAGAGGAGCGGGTGGTGGTGAACAAGTTCAGTAAGTTTACCACATACTTCG<br>ACGCCTTCAATAACAACCGGAAGAATCTGTACTCAGGCGACGCCAAGAGCGGGACCATCGCCTA<br>TAGGCTGATCCACGAAAACCTGCCTATGTTTCTGGACAACATCGCCAGCTTCAACAAAATCAGCG<br>AGACCCGGGTGAACGAGTATTTCAGCAGCATTGAGGCTGAGTTCACCGACACCCTGAATGGCAA<br>GCACCTGGCCGATCTGTTCCAGATCGATTACTTCAACAATACCCTGACACAGAAGAAAATCGATA<br>ATTACAATTATATCGTCGGCGCCGTGAACAAGGCAGTGAACCTGTATAAGCAGCAGCATAAGAA<br>CATCAGGATCCCACTGCTGAAAAAAATCCACAAAATGATCCTCTCCGACAGGGTGACCCCTTCAT<br>GGCTGCCTGAGCGGTTCGAGTCCGATGAGGAGATGCTGACCGCCATCAAAGCAGCCTACGAGA<br>GCCTGAAGGAGGTGCTGGTGGGCGACGACGATGACTCTCTGAGGAACTTGCTGCTTAACATTGA<br>TAATTTCGACCTGGAGCATATCTACATCGCTAAGGACTCCGGCCTGACCTCTATTTCCCAGCAGAT<br>TTTTGGGTACTATGACACATACACCTCTGGCCATCAAAGATCGCTGCAGAGAAAAAATCCTGCCA<br>CCAAGAAGCAGCGGGAAAACCCCAACCTGTATGACGAAAGAATTGACAAGCTGTATAAGAAAG<br>AGGGGAAGCTTTTCCATCGCCTATCTGAACCGGCTGGTGGATACCAAGGAACACATTACCATTAAC<br>GAGTACTATAGGCTGCTGGGAAGCTACTGCAGGGAAGGAGGCAAGTCCAATGATGATTTCTTTA<br>AGCAGATCGACGGAGCCTATTCAGCCATCAGCTACCTGTTCTCTGCCGAGCACGGCAGATCGCA<br>CAGAGCGACAGCGATACCGCCGTGGTGCAGAAGCTGCTGGAGGCCTACAAAGGCCTGCAGCGC<br>TTCATCAAGCCACTGCTGGGACACGGGACGAAGCCGATAAGGACAACGAGTTTGACGTGAAG<br>CTGCGGAAGGTGTGGGATGAGCTGAACATCATCACGCCACTGTATGACAAGGTGCGAAATTGGC<br>TGTCTCGCAAAATTTATAATCCCGAAAAGATCAAGCTGTACTTCGAGAACAACGGCAAGCTGCTG<br>TCTGGATGGTCCGATAGTCAGACCGAGTACGACAACGGGACACAGTACGGCGGCTATATCTTTA<br>GGAAGAAGAACGAGATCGGGGAGTACGACTTCTACCTGGGCATTTCCGCCGACGCCAAGCTGTT<br>CAGAAGGGATGAAACAATCTGTTACGAAGACGGAATGTACGAACGCCTGGACTATTATAATCTG<br>AAACCGAACACCCTGCTGGGCAATAGCTACATCGGGAACTACGGCGAGGATTCGAACGCTGCTG<br>TGAGCGCCTTTAACGATGCCGTGACCAAGCTACACCTGGAGAAGAAACTGGTGCCCAAAGACAA<br>CGAGAAGGTGCCAACTTATCTGAAGAGGCTGAAGCAGGATTATGCTAACTTCTACCAAATCCTGA<br>TGAACGATAATAACGTGGTGGATGCCTATAAGAGCATGAAGCAGCATATCCTGGCCACACTGGC<br>CTCACTGATTAGAGTGCCCGCCGCTATCGAGCTGACTACACAGACCAATCTGGATATTGACAAGC<br>TCATCGACGAAATTATCAATCTGCCTAGCGAGAGCTTCGGGTACTTCCCAGTGGCCACCGCAGCG<br>ATCGAGGAGGCCAACAATCGGAGAAAAAGCCTCTCTTCCTGTTTAAAATGTCCAATAAAGATCT<br>GTCCTATGCCGAAAAGTTTTCCAAGGGCGACCGGAAATCCCGCGGCACCGAAAACCTGCACACA<br>ATGTACCTGAAGGCCCTGCTGGGAATGACACAGAACGTGTTCTCCATCGGATCCGGCATGGTGTT<br>TTTCCGGCACAACACTGAGGGTCTGGCAGAGACCACAGCACGGCACAAGGCCAATGAGTTCATT<br>GCTAACAAGAATAAGCTGAACGACAAGAAGAAGTCCATCTTTGACTATGAGATCGTTAAGAACA<br>AAAGGTTCACTGTGGACAAATACCTGTTCCACCTGTCACTGAAACTGAACTACACCCAGCCCAAT<br>AAGTTTGACATTAACAGCAAGGTGCGGGAGATCATCCGGAACGGGGGAATCAAGCACATCATTG<br>GAATCGATAGAGGCGAGAGAAACCTGATCTATCTGTCCCTGATCGACATGGAGGGGAATATCGT<br>GATGCAGAAATCCCTGAATATCCTGAAAGACGACCACAATGCCAAGGGAACCGACTACAAGGGA<br>CTGCTGACCGAGAGGGAGGGGAGAATAAGGAGGCTCGGAGAAACTGGAAAAGATCGCCAA<br>CATCAAGGATCTGAAAAGAGGCTACCTGTCCCAGGTGGTGCATATTATCAGCAAGATGATGGTC<br>GAGTATAATGCCATTGTGGTGCTGGAGGACCTGAACCCAGGCTTCAAGAGAGGACGGCAGAAAA<br>TTGAAAGAAACGTGTACGAGCAGTTTGAGCGTATGCTGATCGATAAGCTGAATTTCTACGTGGAC<br>AAGCACAAGGACGCCAATGAGACAGGGAGGGCTGCTGCATGCCCTGCAGCTGACAAGCGAATTC<br>AAAAACTTCAAGAAGTCTGAACACCAAAACGGCTGCCTGTTCTACATCCCTGCCTGGAACACATC<br>CAAGATCGACCCAGCCACAGGCTTCGTGAATCTGTTCGATACCAGGTACACTAACGCCGAGAAG<br>GCCCTGGAGTTCTTCAGAAAATTCGACGCAATCCGATACAACGAGGAAAAAGATTGGTTCGAGT |

TABLE S7B-continued

Human Codon Optimized Nucleotide Sequences Group 7

| SEQ ID NO | Corresponding AA | Sequence |
|---|---|---|
| | | TCGAATTTGACTATGACGAGTTTACTCAGAAGGCTCACGGCACACGCACCAGGTGGACCCTGTGC
ACCCACGGAAAACGCCTGAGGTCCTTCCGGAACCCAGCCAAGCAGTACAACTGGGACAGCGAAG
TGGTGGCCCTGACTGACGAGTTTAAGAGGATCCTGGGCGAGGCAGGAATTGATATCCACGAGAA
TCTGAAGGACGCCATCCGGAATCTGGAAGGGAAGCGCCGCAAGTACCTGGAACCTCTGATGCAG
TTTATGAAACTGCTGCTGCAGCTGAGGAATTCACGCAAGAATCCTGAGGAAGACTATATTCTGAG
CCCCGTGGCCGACGAAAATGGGGTGTTTTACGATAGCAGGAGCTGCGGGGATACCCTGCCCAAA
AACGCCGACGCCAACGGAGCTTATAATATCGCTAGGAAGGGCCTGATGCTGATCAGGCAGATCA
AGGAAGCTAAGGAGCTGGGCAAGGTGAAATATGATATCTCCAACAAGGCCTGGCTGAACTTTGC
CCAGCAGAAGCCATACAAGAACGAGTGA |

TABLE S7C

Direct Repeat Group 7

| SEQ ID NO | Direct Repeat (Variant #1) | SEQ ID NO | Direct Repeat (Variant #2) |
|---|---|---|---|
| 106 | ATCTACAATAGTAGAAATTATTAGAGCTTACTAGCC | 107 | ATCTACAATAGTAGAAATTATTAGAGCTTACTAGCC |
| 108 | GGCTAGTATGCTTCAATAATTTCTACTATTGTAGAT | 109 | GGCTAGTATGCTTCAATAATTTCTACTATTGTAGAT |
| 110 | ATCTACGATAGTAGAAATTATCAAGTCCGTATAGAC | 111 | ATCTACGATAGTAGAAATTATCAAGTCCATAGAC |

TABLE S7D crRNA Sequences Group 7

Figure 7A:
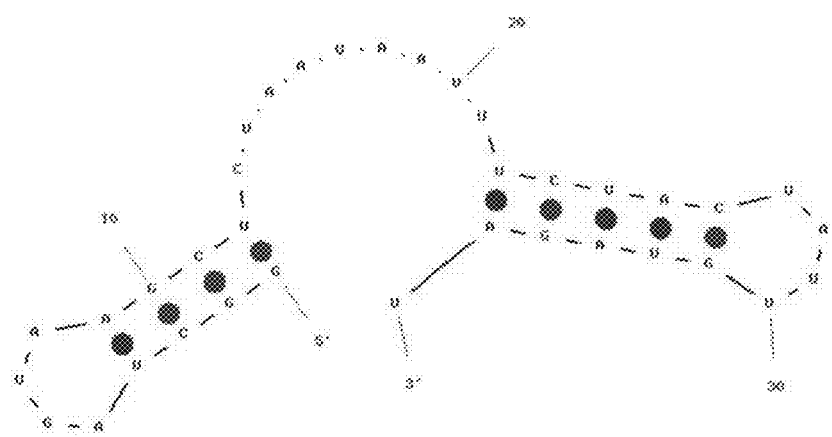
FIG. 7A-7C (SEQ ID NOs:112-114) are schemes depicting the predicted stem loop structures of crRNA sequences of the present disclosure corresponding to Group 7 sequences.
Figure 7B:
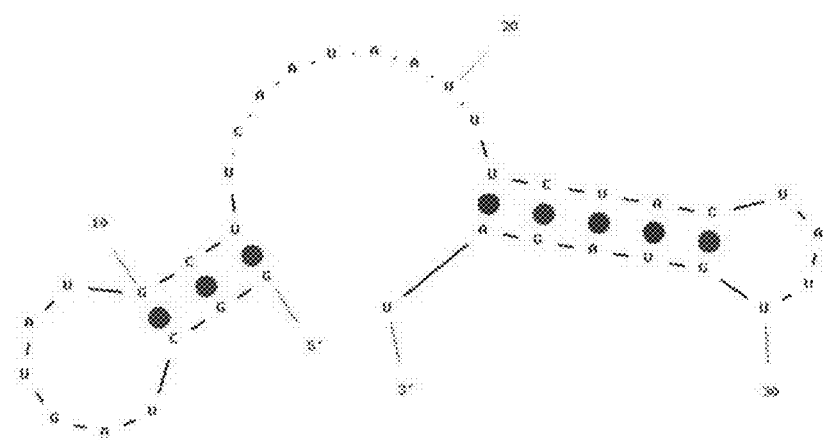
Figure 7C:
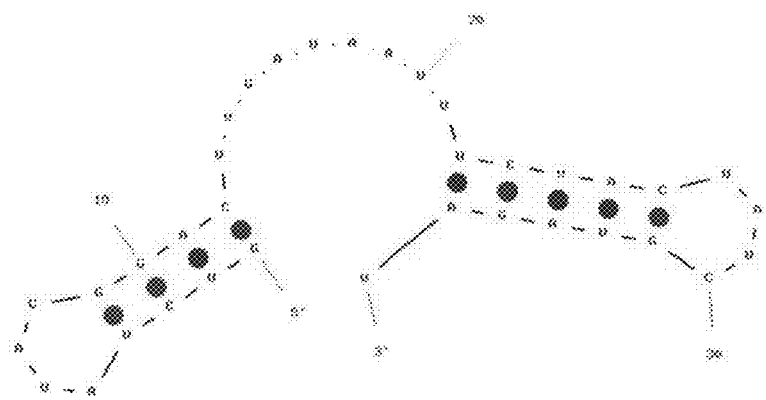

| SEQ ID NO | Sequence | FIG. |
|---|---|---|
| 112 | GGCUAGUAAGCUCUAAUAAUUUCUACUAUUGUAGAU | FIG. 7A |
| 113 | GGCUAGUAUGCUUCAAUAAUUUCUACUAUUGUAGAU | FIG. 7B |
| 114 | GUCUAUACGGACUUGAUAAUUUCUACUAUCGUAGAU | FIG. 7C |

H. Group 8 Type V Nuclease and Associated Sequences
(SEQ ID Nos: 118-130)

TABLE S8A

Enzyme Sequences Group 8

| SEQ ID NO | Sequence |
|---|---|
| 118 | MNSIEQFTGLYSLSKTLRFELKPIGKTQENIEKNGILERDNERAVAYKSVKKYIDEYHKAFIERVMNSFPHNLSDEE
QDIWEEALNNYYTSYHLPATNPQRKETLTEAQDTLRTLISNSFLRDRQYKRLFGKELFQEDLAEFVNTALFETYIR
SQKGNNNLTEEEVRQIQENTIREISLFRNFTVYFSGYNENRKNMYVADDKATSIANRMITENLPKFVDNMEVF
GKIAASEVANHFETLYKSMEAYLNVISIDEMFKLDYYPILLTQKQIDVYNTIIGGKVLEDGSKIQGLNEYVNLYNQ
QQKDKANRLPKLKPLFKQILSEHNAISWLPDTFSTDNEMLESIEKCYQNLRTQVFEGEISLKKLLDNLGDYDLEHI
YIPNDLQLTNIVQKVYGDWSMVKKAMEEDVKAKNPQRKNETGEKYEERIVKILKSDESFSIAQINNLLKPYLGEK
YVPLEKYFITKGAEDNNNVQKPNLFIRIENAYIEAKSLLNTQYPKDRTMSQDKQNVERIKILLDAIKDLQHFVKPL
LGKGSEGQKDNTFYGEFIPLWEALDQITPLYNMVRNRMTQKPYSDDKIKLFFENNGSFLNGWVDSKTESDNA
TQYGGYLFRRKNSIGEYDYYLGISSATKLFRSFNHVSESDKSIFERLDYYQLKGKTFYGALYKGDYEKESSAIKLAID
KFITNNGNTIIREKINTEKRKRQPKVSTAIGYLKFLRQQGVELFDSLLKDGCFEESNQAMITSIKATLASMARIPNA
QDYAHKDYSLFSDAMDDVEELLQDVIFSYFPISQKEMDKVLEREEKPMYLFKITNKDLSFAETHEKGLRKSRGTD
NLHTMYFKALMSGTQNVFDIGSGTVFFRERKIVYSEEQLGKGHHHEMLKDKFDYPIISNKRYAYDKFQFHLSINI
NYKADKHKDINLLVNEYLKESKVTHIIGIDRGERHLLYLSVIDLQGNIVEQYSLNEIVNEYNDCNYRTNYHDLLDIR
EKQRDEARRSWLTIESIKELKEGYMSQVVHLIAQLIVKYNAIVVLEDLNTGFIRGRQKVEKQVYQKFEKMLIDKL
NYLVDKKKDIYDLGGALNALQLTNKFESFQKIGKQCGFLFYVPAWNTSKMDPTTGFVNMLDTRYENMDKAKA |

TABLE S8A-continued

Enzyme Sequences Group 8

| SEQ ID NO | Sequence |
|---|---|
| | FFAKFRSIRQNVSKGWFEFAIDYNDFTSKAAGTKTQWTLCTYGTRIETKRDTKQNNNFVSDEFDLTDKFKVLFN<br>KYNIDVNGNLMEQICSQNDATFFKELLHMLHLTLQMRNSITGTEVDYLISPVMNASGKFYDSRTCENNLPKNA<br>DANGAYNIARKGLWIVEQIKHSDNISKLKIAISNKEWLRYTQGLVD |
| 119 | MNDLSQFTNLYSLSKTLRFELKPIGKTLENIEKNGILERDNRRSIGYKSIKKVIDEYHKAFIDRVLNDYERKLDETGR<br>IVWRDSLNELYRLYHLSSTEAKRNEEIRKTQEILRKQISECFKKDRQYSRLFGKELIREDLTEFVNTPLFEQYILSQK<br>GNEDLSIDDVRHIQEDVIEDIAQFRDFTTYFSGFYENRRNMYVADDKATSIANRLIMENLPKFIDNIDVFERIAQS<br>EVSGNLETLCKEMEAYLNVNSIAEIFCLDYFSMVLTQKQIDVYNAIIGGMSLEDGTKIKGLNVYVNLYNKKQKEK<br>TCRLPKLKPLFKQILSERNAISWLPDEFTSDKELLESIEKCYQDLKNSVFEGKDSLMVLLKELGEYDLEHIYLHNDS<br>QLTNIAQKQYGDWATIKRAFEESVKAATPAKRNETTEKYAARIEKILKATDSLSLSQINRMLKAYMGDDPFKTIES<br>YFTAMGAEDTVDGQKPNLFIRIENAYADVQPLLNTPYPEDKKLSQDKANVAKIKNLLDTIKDLLHFVKPLLGNGT<br>KGEKDNRFYGEFIPLWELLDQITPLYNMVRNRLTKKECSDEKIKLFFENNNGRFLSGWTDNQTESDNGTQYGG<br>YLFRKRNGIGEYDYYLGVSDAKKLFRSFKSVPDSDKSDYERLDYYQLKGKTFYGALYKGDYESESANIKRSIDYFIS<br>HNGNSEIKGKINTERRKQQPRISTAIGYLKFIRQHDFGLYKLLLQDAEFEKSNQEMIASIRETLLSLVRIPSAHEYA<br>DKTYTLFSNMMDDVEILLKSKVFSYFTVSQSELDEVLVREEKPLYLFKITNKDLSYAETHEKGLRKTRGTDNLHTL<br>YFKALMSGNQSVFDIGSGAIFFREKKINYTDEQMRKGHHHEMLKDKFNYPIISNKRYAFDKFQFHLSISINYNAD<br>KNKDINPMVNAYLKESNSTHIIGIDRGERHLLYLSLIDLQGDIVEQYTLNEIGNTNYHDLLGIKEKQRKEARPNW<br>MEIENIRELKEGYMSQVIHIIAQLMVKYNAIVVLEDLNMGFMRGRQKVEKQVYQKFEKMLIDKLNYLVDKQC<br>NATELGGVLNAYQLTNTHKKFLEQYGNQKNALGKQCGFIFYIPAWNTSKMDPTTGFVNLLDTHYENMEKAKA<br>FFGKFPKSIRNNAAKGWFEFEFDYDNFTTKAADTRTPWTLYTHGTRIETKRDPKQKNNFVSEEFDLTSKFKELFVK<br>YKIDLNDNLMEQICLQNDASFFKELLHLLQLTLQMRNSKIGTDVDYLISPVMNDKGKFYDSRNCGKNLPENAD<br>ANGAYNIARKGLWIIDQIKRTDDLSRLRLAISNKEWLQYAQKMV |

TABLE S8B

Human Codon Optimized Nucleotide Sequences Group 8

| SEQ ID NO | Corresponding AA | Sequence |
|---|---|---|
| 120 | 118 | ATGAACTCGATCGAACAATTTACCGGTCTATATTCTCTCTCAAAAACGCTGCGATTTGAACTGAA<br>ACCCATTGGAAAGACCCAAGAAAACATCGAGAAGAACGGAATCCTGGAGCGCGACAATGAGC<br>GGGCCGTAGCGTACAAATCAGTGAAAAAGTACATTGACGAATACCATAAGGCGTTCATCGAAA<br>GGGTTATGAATAGCTTCCCTCACAATTTAAGCGACGAAGAACAGGACATCTGGGAGGAAGCTC<br>TAAATAACTATTACACAAGCTACCACCTGCCCGCGACAAACCCTCAGCGGAAAGAGACGTTGAC<br>CGAAGCTCAAGATACATTGCGTACCCTGATATCAAATTCTTTCCTTCGCGATAGACAGTACAAAC<br>GGCTCTTCGGGAAAGAGCTGTTCCAGGAGGACCCTTGCTGAGTTCGTGAATACAGCCCTGTTCG<br>AAACCTACATCAGGTCACAGAAAGGGAATAACAATCTCACCGAGGAGGAAGTGCGGCAGATC<br>CAGGAGAATACTATACGGGAGATATCCCTGTTTAGGAACTTCACCGTTTACTTTTCTGGGTATA<br>ATGAGAACAGAAAGAATATGTACGTGGCCGACGATAAGGCTACAAGCATTGCCAATAGAATGA<br>TAACCGAGAACTTACCAAAATTCGTGGACAACATGGAAGTTTTCGGCAAAATCGCCGCCGACGCG<br>AAGTGGCTAATCACTTCGAGACTTTGTACAAGAGCATGGAGGCTTATCTGAACGTGATTTCCAT<br>TGACGAGATGTTTAAACTGGACTATTACCCAATCCTTCTAACGCAGAAGCAAATTGACGTGTAT<br>AACACCATCATCGGAGGTAAGGTGTTGGAGGACGGTTCAAAAATCCAGGGCTGAATGAATAC<br>GTGAACCTGTATAATCAGCAACAGAAGGACAAGGCTAATAGACTCCCTAAGCTTAAACCACTGT<br>TTAAGCAGATTCTTAGCGAACATAATGCAATCAGTTGGCTGCCTGACACATTTTCTACAGATAAT<br>GAGATGCTAGAGAGCATAGAAAAGTGCTACCAGAACTTAAGGACTCAGGTGTTCGAGGGGGA<br>AATCTCTCTCAAAAAACTTCTAGACACCTCGGGGATTACGACCTGGAGCATATTTACATTCCAA<br>ATGACTTACAGCTGACGAACATTGTGCAGAAGGTCTACGGAGACTGGTCCATGGTGAAGAAGG<br>CGATGGAGGAAGATGTAAAGGCTAAGAACCCACAACGAAAGAATGAAACTGGGGAAAAATAC<br>GAGGAGAGAATTGTCAAGATTCTGAAAAGCGATGAATCTTTCTCCATTGCACAAATTAACAACC<br>TGCTAAAGCCCTATCTGGGGGAAAAGTATGTGCCGCTCGAGAAGTATTTTATTACAAAGGGCG<br>CAGAGGACAACAACAACGTGCAGAAGCCGAACCTGTTCATCCGGATCGAAATGCCTATATCG<br>AAGCTAAGAGCTTACTGAATACTCAATATCCCAAAGACCGCACAATGAGTCAGGACAAGCAAA<br>ATGTTGAACGTATCAAAATCCTCCTGGATGCAATCAAGGATCTGCAGCATTTTGTTAAACCCCTG<br>CTCGGGAAGGGAAGCGAGGGACAGAAAGATAATACCTTTTATGGGGAGTTTATCCCCCTGTGG<br>GAGGCCCTGGATCAGATAACGCCCCTTTACAATATGGTCCGCAATAGGATGACCCAGAAGCCA<br>TACAGTGACGATAAAATAAAGCTCTTCTTCGAGAATAACGGCTCGTTTCTTAACGGCTGGGTGG<br>ACTCGAAAACTGAGTCCGATAACGCTACTCAGTACGGCGGATACTTGTTTCGGCGCAAGAACTC<br>CATAGGCGAGTACGATTATTATCTCGGCATCAGCTCAGCCACAAAATTATTCCGATCCTTCAACC<br>ATGTTAGCGAAAGTGACAAGAGTATTTTTGAACGGCTGGACTACTATCAATTAAAAGGGAAGA<br>CCTTCTATGGCGCACTGTACAAAGGTGACTACGAAAAAGAATCATCGGCAATCAAACTCGCAT<br>AGACAAGTTCATCACAAATAACGGCAATACCATCATCAGGGAAAAGATAAACACAGAGAAGCG<br>AAAAAGACAGCCTAAGGTCAGTACCGCCATTGGGTATTTGAAGTTTCTGCGGCAACAGGGTGT<br>TGAGCTATTTGACAGTCTACTGAAAGATGGCTGTTTTGAAGAGAGTAACCAGGCAATGATCACT<br>TCTATCAAGGCCACTCTTGCCTCTATGGCCAGAATTCCTAACGCCCAGGATTACGCTCACAAAG<br>ATTACTCATTATTCTCAGACGCTATGGACGATGTGGAGGAGCTGCTGCAGGATGTTATCTTCTC<br>CTACTTCCCCATCTCCCAAAGGGAAATGGACAAAGTGTTGGAAAGGGAAGAGAAGCCTATGTA<br>CCTTTTTAAGATCACCAACAAGGATCTGTCCTTCGCCGAGACGCATGAGAAAGGATTAAGGAA<br>AAGTCGGGGTACTGACAACCTCCATACAATGTATTTCAAAGCACTCATGTCCGGAACCCAAAAC<br>GTCTTTGATATAGGCTCCGGCACCGTGTTTTTCAGAGAGCGGAAGATTGTCTATAGCGAGGAG |

TABLE S8B-continued

Human Codon Optimized Nucleotide Sequences Group 8

| SEQ ID NO | Corresponding AA | Sequence |
|---|---|---|
| | | CAACTGGGTAAGGGACATCATCACGAGATGCTCAAGGACAAATTCGACTACCCTATTATCTCTA<br>ACAAGCGCTATGCATACGATAAGTTTCAGTTCCACCTCTCCATTAACATCAACTATAAGGCAGAC<br>AAACACAAGGATATTAACCTCCTTGTAAACGAATATCTCAAGGAGAGTAAAGTCACTCACATCA<br>TCGGGATTGACAGAGGGGAGAGGCACCTTTTGTATTTGTCCGTCATTGATCTCCAGGGTAATAT<br>TGTTGAACAATACTCTCTCAACGAGATCGTGAATGAGTACAACGACTGCAATTATAGAACCAAT<br>TACCATGATCTGCTGGATATCCGCGAAAAACAGAGGGACGAGGCACGACGCTCTTGGTTGACC<br>ATAGAGTCAATTAAAGAGCTCAAGGAGGGCTATATGAGCCAGGTAGTTCACCTTATCGCGCAG<br>CTTATTGTGAAATATAATGCTATCGTCGTGCTGGAAGATCTCAACACTGGTTTTATTCGTGGAA<br>GACAGAAGGTGGAAAAGCAGGTGTACCAGAAGTTTGAGAAAATGCTGATAGATAAGCTGAAT<br>TATCTGGTCGATAAGAAGAAAGATATCTACGATCTCGGGGGTGCACTGAATGCCTTGCAGTTG<br>ACCAACAAGTTCGAAAGCTTCCAGAAAATAGGCAAGCAGTGTGGCTTCCTGTTTTACGTACCAG<br>CCTGGAATACCTCTAAAATGGACCCGACAACCGGATTTGTAAACATGTTGGATACACGGTACGA<br>AAATATGGATAAGGCCAAAGCGTTCTTTGCCAAGTTTAGATCAATTAGGCAGAACGTATCTAAA<br>GGCTGGTTCGAATTTGCCATTGACTACAACGATTTTACTAGCAAAGCCGCAGGCACTAAAACAC<br>AGTGGACGCTTTGTACATATGGAACTCGTATTGAGACAAAGCGTGATACCAAGCAGAATAATA<br>ATTTCGTGTCTGACGAGTTTGACTTGACCGATAAGTTCAAAGTGCTGTTCAACAAGTACAATATC<br>GATGTCAACGGAAACTTGATGGAACAAATCTGCAGCCAGAACGACGCAACGTTTTTTAAGGAG<br>CTGCTGCACATGCTGCACCTGACATTACAAATGCGCAACTCCATTACCGGGACTGAGGTCGATT<br>ATCTCATAAGCCCAGTCATGAACGCTTCAGGCAAATTCTATGACAGTCGAACCTGCGAAAATAA<br>TTTGCCCAAGAACGCTGACGCCAATGGAGCGTACAATATCGCCAGGAAAGGCCTGTGGATCGT<br>GGAGCAGATTAAACACTCCGACAATATCTCCAAACTGAAGATTGCTATATCTAATAAGGAGTGG<br>CTTCGCTATACTCAGGGACTCGTCGATTGA |
| 121 | 119 | ATGAACGACCTGTCCCAGTTTACAAACCTGTATTCACTGAGCAAGACACTGAGGTTTGAACTGA<br>AGCCCATCGGGAAGACCCTGGAGAACATTGAAAAGAACGGCATACTGGAGAGGGACAATAGA<br>CGATCTATCGGCTATAAGAGCATCAAGAAGGTGATCGACGAGTACCACAAAGCCTTCATCGAC<br>AGAGTGCTGAACGATTACGAAAGGAAGCTGGACGAAACCGGTAGGATTGTGTGGAGGGATAG<br>CCTGAACGAGCTCTACAGACTGTATCACCTGAGCAGCACCGAGGCCAAACGCAATGAGGAGAT<br>TCGGAAGACTCAGGAGATTCTGAGGAAACAGATCAGCGAGTGCTTTAAGAAGGACAGGCAGT<br>ATTCTAGACTGTTCGGCAAGGAGCTGATCAGAGAGGACTTGACCGAGTTTGTGAACACACCAC<br>TGTTTGAGCAGTACATTCTGAGCCAGAAGGGCAACGAGGATCTGTCAATTGACGACGTGAGAC<br>ATATCCAGGAGGACGTGATTGAGGACATTGCCCAGTTTCGCGACTTTACCACGTATTTTTCGG<br>CTTCTATGAGAACAGACGCAACATGTACGTGGCCGATGATAAGGCTACCTCCATCGCCAATCGG<br>TTGATTATGGAGAACCTGCCTAAGTTCATTGATAACATCGACGTGTTCGAAAGAATCGCCCAGT<br>CTGAAGTGTCTGCCAACCTGGAGACACTGTGCAAGGAGATGGAGGCCTACCTGAATGTGAATA<br>GCATCGCCGAGATTTTCTGTCTGGACTACTTCAGTATGGTGCTGACACAGAAACAGATCGACGT<br>GTACAATGCAATTATCGGAGGAATGTCACTGGAGGACGGGACCAAAATCAAAGGCCTGAACG<br>TGTATGTGAATTTGTACAACAAGAAGCAGAAGGAGAAGACATGCAGACTGCCCAAACTTAAGC<br>CACTGTTTAAACAGATCCTGTCAGAGAGGAACGCCATCAGCTGGCTGCCCGACGAATTTACAA<br>GTGACAAAGAGCTGCTGGAGTCAATCGAGAAGTGCTACCAGGATCTGAAGAACAGTGTGTTTG<br>AAGGCAAAGACAGCCTGATGGTCCTGCTCAAGGAGCTGGGGGAGTATGACCTGGAGCATATC<br>TACCTGCATAATGACAGCCAGCTGACTAACATTGCCCAGAAGCAGTACGGCGACTGGGCCACC<br>ATCAAGAGGGCTTTCGAGGAGAGTGTGAAGGCCGCAACCCCTGCCAAACGGAACGAGACCAC<br>CGAAAAGTACGCTGCCAGGATTGAGAAGATTCTGAAAGCCACCGATTCCCTGAGCCTGAGCCA<br>GATCAACAGGATGCTGAAGGCCTACATGGGCGACGACTTCAAGACCATTGAGAGCTACTTCAC<br>CGCCATGGGAGCCGAGGATACCGTGGATGGCCAGAAACCAAACCTGTTTATCCGGATCGAGAA<br>CGCCTACGCCGACGTCCAGCCTCTGCTTAATACCCCTTACCCAGAGGACAAAAAGCTGTCCCAG<br>GATAAGGCCAATGTGGCCAAAATCAAGAATCTCCTGGACACTATCAAGGACCTGCTGCACTTCG<br>TGAAACCCCTGCTGGGCAATGGCACAAAGGGGGAGAAAGACAACCGCTTCTACGAGAGTTC<br>ATTCCCCTGTGGGAGCTGCTGGACCAGATCACCCCCCTGTACAACATGGTGCGCAATAGACTGA<br>CAAAGAAGGAGTGCTCCGACGAGAAAATCAAGCTGTTCTTTGAGAACAATAATGGCAGGTTCC<br>TGAGCGGCTGGACCGACAACCAGACCGAGAGCGACAATGGACACAGTATGGCGGCTACCTG<br>TTTAGAAAGAGGAATGGAATCGGTGAGTACGACTACTATCTGGGCGTGAGCGATGCCAAGAA<br>GCTGTTCAGATCCTTTAAGTCTGTGCCAGATTCCGATAAGTCCGATTATGAGAGGCTGGACTAC<br>TACCAGCTGAAAGGCAAACTTTTTACGGCGCCCTGTATAAGGGGGACTATGAAAGCGAGTCA<br>GCCAATATCAAGCGGAGCATCGATTATTTCATCAGTCACAACGGGAATAGCGAGATCAAAGGC<br>AAGATTAATACCGAGCGGCGTAAACAGCAGCCTAGGATCTCCACCGCCATCGGATACCTGAAG<br>TTTATTAGGCAGCACGACTTTGGCCTGTATAAGCTGCTGCTGCAGGACGCCGAGTTTGAGAAG<br>AGTAACCAGGAAATGATCGCTTCCATCAGGGAGACCCTGCTCTCCCTGGTGAGGATCCCCTCTG<br>CTCACGAGTATGCCGACAAGACCTATACCCTGTTTAGCAACATGATGGACGATGTGGAGATCCT<br>GCTGAAAAGTAAAGTGTTCAGCTATTTCACAGTGTCTCAGAGCGAGCTGGACGAGGTGCTGGT<br>GAGAGAGGAGAAGCCTTTGTACCTGTTCAAGATCACCAATAAGGACCTGAGCTACGCCGAGAC<br>TCATGAAAAGGCCTTAGGAAGACTCGCGGGACAGATAACCTGCACACCCTGTACTTTAAGGC<br>CCTCATGAGCGGGAACCAATCCGTCTTCGATATTGGCAGCGGAGCCATTTTCTTCAGGGAGAA<br>GAAGATTAATTACACCGACGAACAGATGCGGAAAGGCCACCACCGAGATGCTCAAAGACA<br>AGTTCAATTACCCTATCATTAGTAACAAAAGGTACGCCTTCGACAAAATTCCAGTTTCACCTGTCA<br>ATCAGCATTAACTACAACGCCGATAAGAACAAGGATATTAACCCCATGGTGAATGCTTACCTGA<br>AGGAGTCAAACTCCACACACATCATTGGGATTGATAGGGGCGAGAGGCATCTGCTGTACCTGA<br>GCCTGATTGATCTCCAGGGGGATATCGTCGAGCAGTACACTCTGAACGAGATCGGCAACACAA<br>ACTACCACGACCTGCTGGGCATCAAGGAGAAGCAGAGGAAGGAGGCCAGGCCCAATTGGATG<br>GAGATCGAGAACATCCGCGAGCTGAAGGAGGGGTACATGAGCCAGGTGATCCACATTATCGC<br>TCAGCTGATGGTCAAATACAACGCTATTGTGGTGCTCGAAGACCTGAATATGGGCTTCATGCGG<br>GGCCGGCAGAAGGTGGAAAAACAGGTGTATCAGAAATTCGAAAAGATGCTGATCGACAAGCT<br>GAATTACCTGGTGGATAAGCAGTGTAATGCCACCGAGCTGGGTGGGGTGCTGAATGCTTACCA |

TABLE S8B-continued

Human Codon Optimized Nucleotide Sequences Group 8

| SEQ ID NO | Corresponding AA | Sequence |
|---|---|---|
| | | GCTGACCAATACACACAAGAAGTTCCTGGAGCAGTATGGCAATCAGAAAAATGCGCTGGGTAA<br>GCAATGCGGCTTCATCTTCTACATCCCCGCTTGGAACACTAGCAAGATGGACCCCACCACAGGC<br>TTCGTGAATCTGCTGGATACCCATTATGAGAACATGGAGAAAGCCAAAGCCTTCTTCGGGAAAT<br>TCAAGAGCATCAGAAATAACGCCGCCAAGGGATGGTTTGAGTTCGAGTTCGACTACGATAACT<br>TCACCACCAAGGCCGCCGATACAAGAACTCCTTGGACCCTGTATACCCATGGGACCAGAATTGA<br>GACTAAGAGGGACCCTAAGCAGAAGAATAACTTCGTGAGCGAGGAGTTCGACCTGACCAGCA<br>AATTCAAGGAGCTGTTTGTGAAATACAAGATCGATCTGAATGATAATCTGATGGAGCAGATCT<br>GCCTGCAGAACGACGCCTCATTCTTTAAAGAGCTGCTGCACCTGCTGCAGCTGACCCTGCAGAT<br>GAGAAACAGCAAGATTGGCACCGATGTGGATTACCTGATCAGTCCAGTGATGAACGATAAGG<br>GGAAATTCTATGACTCCCGCAATTGTGGGAAGAATCTGCCAGAGAATGCTGATGCCAATGGCG<br>CCTATAATATCGCCAGAAAGGGACTGTGGATTATTGATCAGATTAAACGCACCGATGACCTGTC<br>AAGGCTGAGACTGGCCATCTCTAACAAAGAGTGGCTGCAGTACGCCCAGAAAATGGTGTGA |

TABLE S8C

Direct Repeat Group 8

| SEQ ID NO | Direct Repeat (Variant #1) | SEQ ID NO | Direct Repeat (Variant #2) |
|---|---|---|---|
| 122 | GGCTATAGGCCAAACATAATTTCTACTATTGTAGAT | 123 | GGCTATAGGCCAAACATAATTTCTACTATTGTAGAT |
| 124 | ATCTACAATAGTAGAAATTATGTGTGGTTTTACACC | 125 | ATCTACAATAGTAGAAATTATGTGTGGTTTTACACC |

TABLE S8D crRNA Sequences Group 8

Figure 8A:
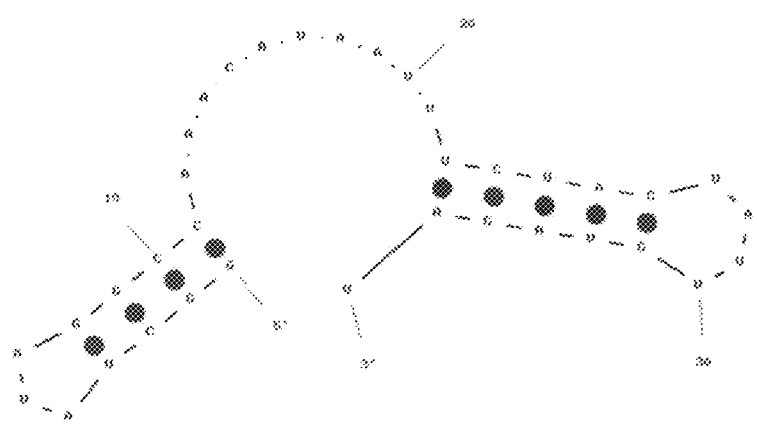
FIG. 8A-8B (SEQ ID NOs:126-127) are schemes depicting the predicted stem loop structures of crRNA sequences of the present disclosure corresponding to Group 8 sequences.
Figure 8B:
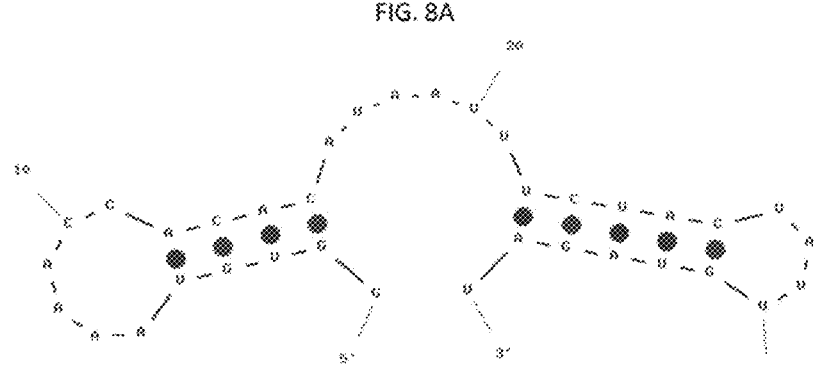

| SEQ ID NO | Sequence | FIG |
|---|---|---|
| 126 | GGCUAUAGGCCAAACAUAAUUUCUACUAUUGUAGAU | FIG. 8A |
| 127 | GGUGUAAAACCACACAUAAUUUCUACUAUUGUAGAU | FIG. 8B |

TABLE S8E

Consensus Sequence Group 8

| SEQ ID NO | Consensus Sequence |
|---|---|
| 128 | MNXJXQFTXLYSLSKTLRFELKPIGKTXENIEKNGILERDNX<br>RXXXYKSXKKXIDEYHKAFIXRVXNXXXXXLXXXXXXXWXXX<br>LNXXYXXYHLXXTXXXRXEXJXXXQXXLRXXISXXFXXDRQY |

TABLE S8E-continued

Consensus Sequence Group 8

| SEQ ID NO | Consensus Sequence |
|---|---|
| | XRLFGKELXXEDLXEFVNTXLFEXYIXSQKGNXBLXXXXVRX<br>IQEBXIXXIXXFRBFTXYFSGXXENRXNMYVADDKATSIANR<br>XIXXENLPKFXDNXXVFXXIAXSEVXXXXETLXKXMEAYLNVX<br>SIXEXFXLDYXXXXLTQKQIDVYNXIIGGXXLEDGXKIXGLN<br>XYVNLYNXXQXKXXRLPKLKPLFKQILSEXNAISWLPDXFX<br>XDXEXLESIEKCYQBLXXXXVFEGXXSLXXLLXXLGXYDLEHI<br>YJXNDXQLTNIXQKXYGDWXXXKXAXEEXVKAXXPXXXNETX<br>EKYXXXRIXKILKXXXSXSJXQINXXLKXYXGXXXXXJEXYFX<br>XXGAEDXXBXQKPNLFIRIENAYXXXXXLLNTXYPXDXXXSQ<br>DKXNVXXIKXLLDXIKDLXHFVKPLLGXGXXGZKDNXFYGEF<br>IPLWEXLDQITPLYNMVRNRXTXKXXSDXKIKLFFEXNNGXF<br>LXGWXDXXTESDNXTQYGGYLFRXXNXIGEYDYYLGXSXAXK<br>LFRSFXXVXXSDKSXXERLDYYQLKGKTFYGALYKGDYEXES<br>XXIKXXIDXFIXXNGNXXIXXKINTEXRKXQPXXSTAIGYLK<br>PJRQXXXXLXXXLLXDXXFEXSNQXMIXSIXXTLXSXXRIPX<br>AXXYAXKXYXLFSBXMDDVEXLLXXXXFSYFXXSQXEXDXVL<br>XREEKPXYLFKITNKDLSXAETHEKGLRKXRGTDNLHTXYFK<br>ALMSGXQXVFDIGSGXXFFREXKIXYXXEQXXKGHHHEMLKD<br>KFBYPIISNKRYAXDKFQFHLSIXINYXADKXKDINXXVNXY<br>LKESXXTHIIGIDRGERHLLYLSXIDLQGBIVEQXYXLNEIXN<br>XXXXXXXXTNYHDLLXIXEKQRXEARXXWXXIEXIXELKEGY<br>MSQVXHJIAQLXVKYNAIVVLEDLNXGFXRGRQKVEKQVYQK<br>FEKMLIDKLNYLVDKXXBXXXLGGXLNAXQLTNXXXXFXXXX<br>XXXXXXJGKQCGFJFYXPAWNTSKMDPTTGFVNXLDTXYENM<br>XKAKAFFXKFXSIRXNXXKGWFEFXXDYBBFTXKAAXTXTXW<br>TLXTXGTRIETKRDXKQXNNFVSXEFDLTXKFKXLFXKYXID<br>XNXNLMEQICXQNDAXFFKELLHXLXLTLQMRNSXXGTXVDY<br>LISPVMNXXGKFYDSRXCXXNLPXNADANGAYNIARKGLWIX<br>XQIKXXDBJSXLXJAISNKEWLXYXQXXVD |

Wherein:

each X is independently selected from any naturally occurring amino acid.

TABLE S8F

Native Nucleotide Sequences Group 8

| SEQ ID NO | Corresponding AA | Sequence |
|---|---|---|
| 129 | 118 | ATGAATTCCATTGAACAATTCACCGGATTATACTCCTTATCAAAGACCTTGCGCTTTGAGTTGAA<br>ACCTATAGGAAAAACGCAAGAAACATAGAAAAAAACGGTATTCTTGAAAGAGACAACGAGA<br>GAGCTGTTGCGTACAAAAGTGTAAAGAAATACATCGACGAGTATCACAAGGCATTTATTGAAA<br>GGGTTATGAATTCTTTTCCCCACAATTTAAGCGATGAGGAGCAAGATATTTGGGAAGAAGCGTT<br>GAATAACTATTATACATCATACCATTTACCTGCAACTAATCCTCAAAGAAAGGGAAACGTTAACA<br>GAAGCCCAGGATACTTTACGAACTCTTATTTCTAATAGTTTTCTTAGGGATAGACAGTACAAAA<br>GACTATTTGGAAAAGAACTGTTTCAAGAGGATTTGGCGGAATTTGTAAATACTGCCCTTTTTGA |

TABLE S8F-continued

Native Nucleotide Sequences Group 8

| SEQ ID NO | Corresponding AA | Sequence |
|---|---|---|
| | | AACTTATATCCGTTCTCAAAAAGGTAATAATAACTTGACCGAGGAAGAAGTCCGTCAGATACAA<br>GAGAATACAATCAGGGAGATCTCGCTCTTCAGAAACTTTACCGTCTATTTTTCGGGTTATAACG<br>AGAATAGGAAAAATATGTATGTTGCAGATGACAAGGCAACTTCTATTGCCAACCGCATGATTAC<br>AGAGAATCTTCCTAAGTTTGTCGACAACATGGAGGTGTTTGGGAAAATTGCCGCTAGTGAAGT<br>CGCAAATCATTTCGAAACTCTTTACAAGTCAATGGAAGCTTATTTAAATGTCATATCTATTGACG<br>AAATGTTCAAGTTGGATTATTATCCAATATTGCTGACGCAAAAACAAATAGATGTATACAATAC<br>AATAATTGGAGGAAAGGTGTTGGAGGATGGGAGTAAAATACAAGGCTTGAATGAATATGTGA<br>ATCTTTACAACCAACAGCAAAAAGACAAGGCGAATAGACTCCCTAAACTAAAACCACTTTTTAA<br>GCAGATACTTAGTGAACACAATGCTATTTCGTGGTTGCCCGATACGTTTTCAACTGACAACGAG<br>ATGCTGGAAAGCATTGAAAAGTGTTATCAGAACCTTAGGACGCAAGTTTTCGAAGGGGAAATT<br>TCATTAAAGAAACTCTTGGATAATTTGGGAGATTATGATTTGGAACATATCTATATTCCCAATGA<br>CCTCCAATTGACCAATATTGTCCAAAAGGTATATGGAGATTGGTCAATGGTCAAGAAGGCAAT<br>GGAAGAGGATGTGAAAGCAAAGAATCCCCAAAGGAAAAATGAGACAGGCGAAAAGTATGAG<br>GAGAGGATTGTAAAGATACTGAAATCTGATGAAAGTTTTTCTATAGCACAAATCAATAACTTGC<br>TGAAACCTTATCTTGGAGAAAAATACGTGCCGCTTGAAAAGTATTTTATTACTAAAGGTGCCGA<br>GGATAATAATAATGTGCAAAAACCTAATCTCTTTATTCGTATAGAGAATGCATACATAGAGGCA<br>AAATCTCTGTTGAACACCCAGTATCCAAAAGACAGAACAATGTCGCAGGACAAGCAAATGTT<br>GAGAGAATTAAGATTTATTGGATGCAATCAAAGACTTGCAACACTTTGTAAAACCTTTGTTGG<br>GGAAGGGGTCTGAGGGACAAAAAGACAACACCTTCTATGGCGAGTTCATTCCACTTTGGGAAG<br>CACTTGATCAAATTACGCCGTTGTACAATATGGTGCGTAACCGAATGACACAGAAGCCTTATTC<br>TGATGATAAAATTAAACTTTTTTTCGAGAACAATGGCTCATTTCTAAATGGATGGGTCGACAGC<br>AAAACAGAATCGGATAATGCTACTCAGTATGGCGGATATTTGTTCAGAAGGAAAAATAGTATC<br>GGCGAATATGATTACTATCTAGGAATCTCGTCTGCCACAAAACTTTTCAGAAGTTTTAATCATGT<br>GTCGGAATCGGATAAAAGCATTTTTGAAAGATTGGATTATTACCAATTGAAAGGAAAGACTTTT<br>TATGGCGCTTTGTACAAAGGAGACTATGAAAAAGAATCTTCTGCTATCAAGCTGGCAATTGATA<br>AATTCATTACTAATAATGGAAATACCATTATTAGAGAAAAGATAAATACTGAGAAAAGAAAAC<br>GACAGCCCAAGGTGTCAACTGCCATTGGTTATTTGAAATTTCTCAGACAGCAGGGAGTTGAATT<br>GTTTGATTCTTTATTAAAAGATGGTTGCTTTGAGGAGAGTAATCAAGCTATGATCACTTCCATTA<br>AAGCTACATTGGCGTCTATGGCGCGCATTCCTAATGCACAGGACTATGCACATAAGGATTATTC<br>ATTGTTCTCAGACGCTATGGATGATGTAGAAGAATTGTTGCAAGATGTTATTTTTTCATATTTCC<br>CAATTAGTCAGAAAGAGATGGACAAAGTTCTTGAGAGAGAAGAAAAGCCCATGTATTTGTTCA<br>AGATAACGAATAAGGATCTTTCTTTTGCTGAAACTCACGAAAAGGGGTTGAGGAAATCAAGAG<br>GAACAGATAATTTGCACACCATGTACTTCAAAGCATTGATGAGTGGCACTCAAAATGTTTTCGA<br>TATTGGTTCTGGCACCGTTTTCTTTAGAGAACGCAAGATAGTGTATTCTGAAGAGCAATTGGGA<br>AAGGGACACCACCACGAAATGCTGAAGGATAAGTTTGATTATCCTATCATATCAAACAAGAGAT<br>ATGCATACGATAAGTTCCAATTTCATTTGTCAATAAATATTAACTATAAAGCAGATAAACATAAA<br>GACATCAATCTTTTGGTCAATGAATATCTGAAAGAATCAAAAGTCACGCATATCATTGGTATTG<br>ACCGTGGAGAAAGACACCTATTATATTTGTCTGTAATAGATTTGCAGGGTAATATCGTTGAGCA<br>ATATTCATTAAACGAGATTGTGAATGAATATAACGACTGTAATTATCGTACTAACTATCATGATT<br>TATTAGATATCAGAGAAAGCAAAGGGATGAGGCCAGGCGCAGTTGGCTAACCATTGAAAGT<br>ATCAAGGAATTAAAGGAGGGCTATATGAGCCAGGTGGTTCATTTAATTGCACAACTAATTGTAA<br>AATACAACGCAATAGTCGTGCTTGAAGACTTGAATACTGGCTTTATTAGAGGGAGGCAAAAGG<br>TTGAGAAACAGGTTTATCAGAAGTTTGAAAAAATGCTGATTGACAAGTTGAATTATCGGTAGA<br>CAAGAAAAAGATATTTACGACCTGGGTGGTGCGTTGAATGCATTGCAGTTGACAAATAAATTT<br>GAGAGTTTTCAGAAGATAGGTAAACAATGTGGTTTCCTGTTCTATGTCCCTGCTTGGAATACCA<br>GTAAAATGGATCCTACAACAGGATTTGTCAATATGCTTGATACACGTTACGAGAATATGGATAA<br>AGCTAAAGCCTTTTTTGCAAAATTTAGGAGTATTCGACAAAATGTCAGTAAGGGATGGTTCGAA<br>TTTGCTATTGATTATAATGATTTTACCTCGAAAGCAGCTGGAACCAAAACACAATGGACACTTTG<br>TACCTATGGCACACGTATTGAAACCAAACGCGATACGAAGCAAAATAACAATTTTGTTAGCGAT<br>GAGTTTGACTTGACAGACAAGTTCAAGGTCTTGTTTAATAAATACAACATAGATGTAAACGGCA<br>ATCTAATGGAGCAGATTTGCTCACAAAATGACGCTACATTCTTCAAAGAATTACTACACATGCTA<br>CATTTGACCTTGCAGATGCGAAATAGTATTACTGGAACAGAAGTGGATTATTTAATTTCACCTGT<br>TATGAATGCTTCTGGTAAGTTCTACGATAGTCGTACTTGTGAAAATAATCTACCTAAGAATGCTG<br>ATGCCAACGGGGCCTACAACATTGCTAGAAAAGGATTGTGGATTGTCGAACAGATAAAACATT<br>CGGACAATATATCGAAATTAAAAATAGCAATCAGCAACAAGGAATGGCTACGATATACACAAG<br>GGTTGGGTAGACTAA |
| 130 | 119 | ATGAACGACCTTTCGCAATTCACCAATTTATATTCTTTATCAAAAACTTTGCGTTTTGAGTTGAAG<br>CCCATCGGCAAGACTTTGGAGAATATTGAAAGAATGGTATTCTTGAAAGAGACAACCGTCGT<br>TCTATAGGATACAAATCCATTAAGAAGGTAATAGATGAATATCACAAGGCGTTTATCGACCGCG<br>TTCTGAATGACTATGAACGCAAATTGGATGAAACAGGAAGAATCGTTTGGAGAGATTCATTAA<br>ATGAACTGTATCGTCTGTATCATCTTTCTTCTACCGAAGCAAAGAGAAATGAAGAAATCCGCAA<br>AACACAAGAAATATTACGGAAACAAATTTCAGAATGCTTTAAGAAAGACAGACAATATAGCCG<br>TTTGTTCGGGAAAGAATTAATTCGAGAGGACCTAACAGAATTTGTAAACACTCCTTTATTTGAG<br>CAATATATCCTCAGTCAGAAAGGCAACGAAGACTTAAGTATGATGATGTACGCCATATTCAAG<br>AAGATGTTATTGAGGATATTGCCCAATTCAGAGACTTCACAACATATTTCTCTGGCTTTTATGAA<br>AACAGACGGAATATGTACGTTGCCGACGACAAAGCGACCTCTATAGCAAATCGTCTGATTATG<br>GAGAACCTCCCAAAATTCATTGACAACATAGATGTGTTCGAAAGAATTGCACAGAGCGAGGTG<br>TCCGGCAATCTTGAAACTTTATGTAAGGAAATGGAAGCTTATCTAAATGTCAATTCCATTGCAG<br>AAATATTTTGTCTTGATTATTTTTCGATGGTATTGACGCAAAAACAGATAGACGTATATAATGCA<br>ATTATTGGCGGGATGTCGTTGGAAGACGGTACAAAAATCAAGGGACTAAACGTGTATGTGAAT<br>CTTTATAATAAAAAACAAAAAGAGAAGACCTGCCGCTTGCCCAAACTGAAGCCTCTTTTCAAAC<br>AAATTCTAAGCGAACGCAACGCCATCTCGTGGCTGCCTGATGAATTTACAAGTGACAAGGAGTT<br>GCTTGAAAGTATTGAAAAATGCTATCAAGACCTTAAGAATTCTGTTTTCGAGGGTAAAGATTCT |

TABLE S8F-continued

Native Nucleotide Sequences Group 8

| SEQ ID NO | Corresponding AA | Sequence |
|---|---|---|
| | | CTAATGGTGTTATTGAAAGAACTCGGCGAGTATGATTTAGAGCATATCTATCTACATAATGACT
CTCAGCTAACAAACATTGCCCAGAAACAATATGGCGATTGGGCGACAATAAAAAGGGCTTTTG
AGGAATCGGTCAAGGCTGCGACTCCCGCAAAGCGCAACGAAACCACCGAAAAGTATGCGGCT
CGAATAGAGAAAATCTTAAAAGCTACCGACAGCTTGTCTTTGTCGCAGATTAACCGAATGCTGA
AGGCTTATATGGGTGATGACTTCAAAACAATTGAGTCATACTTCACAGCAATGGGTGCAGAAG
ATACTGTGGACGGACAAAAGCCTAATCTTTTCATACGTATTGAAAACGCCTACGCAGATGTACA
GCCTTTACTAAATACACCTTATCCAGAAGACAAAAAGCTGTCGCAAGACAAAGCCAATGTTGCA
AAGATAAAGAACCTATTAGATACCATCAAAGACTTGCTGCACTTTGTAAAACCATTACTAGGGA
ATGGGACAAAAGGCGAAAAAGACAATCGCTTCTATGGTGAATTCATTCCTTTATGGGAACTGCT
TGACCAAATTACGCCATTGTATAACATGGTGAGAAACAGGCTAACAAAGAAGGAGTGTTCTGA
CGAGAAAATCAAACTGTTTTTCGAAAACAATAATGGTAGATTTTTAAGTGGGTGGACGGACAA
TCAGACAGAATCCGATAACGGCACTCAATATGGTGGCTATTTGTTCAGAAAGAGGAATGGCAT
CGGAGAATACGATTATTATCTGGGAGTGTCTGATGCCAAAAAACTCTTTCGTAGTTTCAAATCA
GTGCCAGATAGCGATAAAAGTGACTACGAAAGACTGGATTACTATCAGTTGAAAGGTAAAACC
TTTTATGGTGCTTTGTATAAAGGCGACTATGAATCAGAATCCGCAAATATCAAGCGATCTATCG
ATTATTTTATCTCGCATAACGGTAACTCCGAAATCAAAGGGAAAATCAATACAGAAAGGAGAA
AACAGCAACCAAGAATATCAACAGCCATTGGATATCTTAAGTTTATCAGACAACACGATTTCGG
ATTGTATAAATTGCTTTTACAAGATGCGGAATTTGAGAAAAGCAATCAGGAGATGATTGCTTCT
ATTAGGGAGACACTATTATCTCTTGTCCGTATTCCATCGGCACATGAGTATGCAGATAAGACAT
ACACCTTGTTCTCTAATATGATGGATGATGTCGAGATTTTACTTAAAAGTAAGGTGTTTTCATAC
TTCACAGTAAGCCAAAGTGAACTCGACGAAGTCCTCGTTAGAGAAGAAAAACCATTGTATCTGT
TCAAGATTACGAATAAAGACTTGTCTTATGCCGAGACTCACGAGAAAGGATTAAGAAAGACTC
GCGGTACCGACAATTTGCATACTCTTTATTTCAAAGCATTGATGAGTGGAAACCAGAGTGTCTT
TGACATAGGATCTGGGGCGATTTTCTTCAGAGAAAAAAAGATCAACTACACGGATGAACAGAT
GAGGAAGGGACATCACCATGAAATGCTAAAAGACAAATTCAATTATCCAATTATTTCAAACAAA
AGGTACGCTTTCGACAAGTTTCAGTTTCATTTGTCAATATCGATAAACTATAATGCGGATAAGA
ATAAAGACATAAACCCCATGGTGAATGCCTATCTGAAAGAATCCAACTCCACTCATATCATTGG
TATTGACCGAGGAGAAAGGCACCTGCTGTACTTGTCGCTTATTGACCTTCAGGGAGATATCGTC
GAACAATACACTCTGAATGAGATTGGAAACACCAATTATCACGACCTGCTGGGCATAAAAGAA
AAACAGCGCAAAGAAGCTCGCCCCAATTGGATGGAGATAGAAACATTAGGGAGCTGAAAGA
GGGCTATATGAGCCAGGTGATTCACATAATTGCCCAACTGATGGTGAAATACAATGCTATTGTG
GTACTTGAGGATTTGAACATGGGATTTATGCGTGGTCGTCAGAAAGTGGAAAAGCAGGTGTAT
CAGAAGTTCGAGAAGATGCTGATCGACAAATTGAACTATTTAGTGGATAAACAATGCAATGCA
ACTGAACTAGGGGGAGTTTTGAACGCCTACCAATTAACAAATACCCATAAGAATTCTTAGAAC
AATATGGGAATCAGAAAATGCATTAGGCAAACAGTGTGGTTTCATATTTTACATTCCAGCATG
GAACACAAGCAAATGACCCTACTACCGGCTTTGTCAACCTATTGGATACTCACTATGGACTAT
ATGGAAAAGCAAAAGCTTTCTTTGGCAAGTTCAAGAGCATTCGCAATAATGCTGCCAAAGGC
TGGTTCGAGTTCGAGTTTGATTACGATAACTTCACCACAAAGGCCGCAGACACAAGAACACCTT
GGACGCTCTACACCCATGGTACTCGCATAGAGACAAAACGTGACCCTAAGCAGAAAACAACT
TCGTTAGTGAAGAGTTTGATTTGACAAGCAAATTCAAGGAACTGTTTGTTAAATACAAGATTGA
TTTGAACGACAACCTGATGGAGCAAATATGCTTACAAAATGATGCTTCGTTTTTTAAAGAATTG
CTTCACCTGCTACAACTAACACTTCAAATGCGAAACAGCAAGATTGGAACTGATGTTGATTATCT
TATATCGCCTGTAATGAACGACAAAGGAAAGTTTTACGATAGTCGTAATTGTGGCAAGAATCTA
CCGGAAAATGCTGATGCAAATGGTGCCTACAACATTGCCAGAAGGGATTGTGGATTATCGAC
CAGATTAAGCGCACGGATGACTTGTCGAGATTGAGGTTGGCCATCAGCAACAAGGAATGGCTG
CAATATGCGCAGAAAATGGTGTGA |

I. Group 9 Type V Nuclease and Associated Sequences (SEQ ID Nos: 131-330)

TABLE S9A

Enzyme Sequences Group 9 (SEQ ID Nos: 131-170)

| SEQ ID NO | Sequence |
|---|---|
| 131 | MDMKSLNSFQNQYSLSKTLRFQLIPQGKTLDNINESRILEEDQHRSESYKLVKKIDDYHKAYIEQALGSFELKIAS
DSKNDSLEEFYSQYIAERKEDKAKKLFEKTQDNLRKQISKKLKQGEAYKRLFGKELIQEDLLEFVATDPEADSKKRLI
EEFKDFTTYFIGFHENRKNMYAEEEAQSTAIAYRIIHENLPKFIDNIRTFEELAKSSIADVLPQVYEDFKAYLKVESVK
ELFSLDYFNTVLTQKQLDIYNAVIGGKSLDENSRIQGLNEYINLYNQQHKDKKLPFLKPLFKQILSDRNSLSWLPEA
FDNDKQVLQAVHDCYTSLLESVFHKDGLQQLLQSLPTYNLKGIYLRNDLSMTNVSQKLLGDWGAITRAVKEKLQ
KENPAKKRESDEAYQERINKIFKQAGSYSLDYINQALEATDQTNIKVEDYFINMGVDNEQKEPLFQRVAQAYNQ
ASDLLEKEYPANKNLMQDKESIEHIKFLLDNLKAVQHFIKPLLGDGNEADKDNRFYGELTALWNELDQVTRLYN
KVRNYMTRKPYSVDKIKINFKNSTLLNGWDRNKERDNTAVILRKDGKFYLAIMHKEHNKVFEKFPVGTKDSDFE
KMEYKLLPGANKMLPKVFFSKSRIDEFKPSAELLQKYQMGTHKKGELFSLNDCHSLIDFFKASIEKHDDWKQFNF
HFSPTSSYEDLSGFYREVEQQGYKLTFKSVDADYINKMVDEGKIFLFQIYNKDFSEHSKGTPNLHTLYWKMLFDE
RNLQNVVYKLNGEAEVFFRKKSLTYTRPTHPKKEPIKNKNVQNAKKESIFDYDLIKNKRFTVDSFQFHVPITMNF
KSEGRSNLNERVNEFLRQNNDAHIIGIDRGERHLLYLVVIDRHGNIVEQFSLNSIINEYQGNTYATNYHDLLDKRE
KEREEARESWQSIENIKELKEGYLSQVVHKIADLMVKYHAIVVLEDLNMGFMRGRQKVEKQVYQKFEKMLIDKL |

TABLE S9A-continued

Enzyme Sequences Group 9 (SEQ ID Nos: 131-170)

| SEQ ID NO | Sequence |
|---|---|
| | NYLVDKKQDAETDGGLLKAYQLTNQFESFQKLGKQSGFLFYVPAWNTSKIDPCTGFTNLLDTRYESIEKAKKFFQ<br>TFNAIRYNAAQGYFEFELDYNKFNKRADGTQTLWTLCTYGPRIETLRSTEDNNKWTSKEVDLTDELKKHFYHYGI<br>KLDADLKEAIGQQTDKPFFTNLLHLLKLTLQMRNSKIGTEVDYLISPIRNEDGTFYDSRQGNKSLPANADANGAY<br>NIARKGLWVINQIKQTPQDQKPKLAITNKEWLQFAQEKPYLKD |
| 132 | MDHFTNLYPVSKTLRFELIPDKRTKAILERTDLIAQDEHRAESYKLVKKIIDRYHKKFIDSVLGTLKLPLDELDSLHEL<br>YSKSQKSDADKKALEKIQDKLRKLIADALTKDSRYKRIDKKELIREDILSVIEPEEQALIDEFRDFTTYFTGFHENRRN<br>MYSAEAQSTAIAYRLIHENLPKFIDNMATFEKIAASPVAEHFPQLYQEMAEYLNVREIGDLFKLDYYTELLTQSQI<br>EAYNAVIGGRTVEESGKKIQGINEYVNLYNQQQPSRDTRLPKLKPLFKQILSDREAVSWLPEEFESDKDMLTAVK<br>ECYHSLNDHVFDPLRELLTNLSSYNLDGIYIPNDLSLTDISQAMFKDWSVIKKAIAEDVKRNCPLKRNEKADNYEE<br>RISKLIKRENSFSIGYMNHCIQEKDICDHFATLGASDNGEEQTVNLFLQIQNAYTDAQSLIENDYPEDRNLAQDKE<br>NVARLKALLDAVKALQRFVKPLRGNGDEPDKDERFYGELAVLWEELDHITPLYNKVRNRMTRKPYSIEKFKLNF<br>QNSTLLDGWDLNKERDNTGVIMRKDGKYFLAIMNKQFNRIFVDAPQAGHDEDTFEKMEYKLLPGANKMLPK<br>VFFSKSRIEEFKPSPELLEHYEKGTHKKGDNFSLKDCHELIDFFKASIAKHEDWSKFDFHFSPTDTYEDLSGFYREVE<br>QMGYKISYKQIPVSYIDKMVEEGKLFLFQIYNKDFSPYSKGTPNLHTLYWKMLFDERNLANVVYKLNGQAEVFY<br>RKKSLDYDRPTHPANQAIKNKNPETTKKKESTFDYDIIKDKRFTMDKFQFHVPITINFKATGSGSINPLVNQYIHDH<br>DDLHFIGIDRGERHLLYVTVIDSKGCIKEQFSLNEIVNEYQGNTYKTNYRSLLDKRDDERQRERQSWNTIEGIKEL<br>KQGYLSQVIHKIVSLMVKYHAVVVLEDLNMGFKRGRQKVESSVYQQFEKALIDKLNLLIDKKIDADQPGGLLHAY<br>QLTNKFTSFRDMGRQNGFLFYIPAWNTSKIDPVTGFVDLLHPRYESVDKSRSFFCKFKSIRYNQDKGWYEFTMD<br>YNDFTTKAEGTRTEWTLCTHGTRVETFRNAEKNSSWDSREVNLTDEFNALFATYGVEPQGNLKQAIAERSQKE<br>FFDKLTHLLALTLQMRNNITGTEVDYMISPVADENGKFFDSRTCGKELPENADANGAYNIARKGLWVARQIQA<br>AHVDEKVNMAISNKEWLSFAQSKPYLND |
| 133 | MKQLNDLTGLYSLSKTLRFELKPIGKTLEHIESKGFITQDEKRAEEYKRVKDIIDRYHKSFITMCLCGFKFNQEDLDT<br>YAALAEDFNRDEKAFEESKKTLRKQIVGAFKKGGGYSDLFKKELIQKHLPEIVTDDEEKKMVENFSKFTTYFTGFN<br>ENRKNMYSDEEKSTAIAYRLIHDNLPMFLDNTRSFSRIADSDVRQSFCKIESSFSEYLNVEHLAEMFQLDYFSETL<br>TQEQIAVYNHVVGGRTLEDGTKIQGINEYVNLYNQQHKDNRLPLLKPLYKMILSDRVALSWLPDEFANDKEMID<br>AIKETYDSLKENLTGDGDGSLRNLLLNINNYDIEHIYIANDLGLTDISQQMFGQYDVYTSAIKQELRNSVTPTAKE<br>RREPELYAERINKLFKSTKSFSVAYLNSLVDAEHTIQNYYQQLGAYDRDGEQRINLFTQLEMAYVAAKDILSGKH<br>GNISQTDAEIAIIKNLLDAYKSLQHFIKPLLGNGDEADKDNEFDAKLREVWDALDIVTPLYNKVRNWLTRKPYSTE<br>KIKLNFENAQLLNGWDLNKNETDCTSVLLRKDGKYFLAIMDKKANRAFDVEDLPCDGICFEKMNYKQIALPMGL<br>GAFVRKCTGSAKKLGWTCPSSLLNKDMKIIIKDDEATNVLPSLIECYKDFLNIYEKDGFKYKDFNFKFKPTHEYKKL<br>SHFFAEVPTQGYKITFRKVSESFINQLVDEGKLYLFQIWNKDFSEFSKGSPNMHTLYWKMLFDERNLADVVYKL<br>NGQAEVFYRKSSLDVANTTIHKAHQPILNKNQENKKQQSTFDYDIIKNRRYTVDKFQFHVPISINFKATGRDNV<br>NSQVLDIIRNGGIKHIIGIDRGERHLLYLSLIDLKGNIVKQMTLNDIVNEYGNTYATNYRDLLAEREGNRTEARK<br>NWKKIENIKDIKQGYLSQVVHIISKMMVEYDAIVVLEDLNMGFMRGRQKIERSVYEQFEKMLIDKLNYYVDKQK<br>DVNEAGGLLHALQLTSRFESFKKLGKQSGCLFYIPAWNTSKIDPVTGFVNLFDTRYTNADQARKFFSLFDSIRYNA<br>EKNWFEFAFDYDKFTTKAKGTRTRWTLCTYGTRIRTFRNPAKLNQWDNKEVVLTDEFKKAFADAGIDIHGNLKE<br>AICSLEDKKYLEPLMHLMKLLLQMRNSITNTEVDYLLSPVADKNGSFYDSRVCSYALPKDADANGAYNIARKGL<br>WAIRQIQETPVGERPNLAIKNNEWLKFAQQKPYRDE |
| 134 | LLNYKYYIVMKTYDELTGLYSLSKTLRFELKPVGKTLEYIENKGIIAQDEKRAEEYKLVKGIIDRYHKSFIRLCLYNFKL<br>KLESDNGLDSLEEYVEYASIQRRTDTQDAEFKKVKENLRKQIVSAFKNGATYGDLFKKELIQQILPDFADNDEERQ<br>LVDNFSKFTTYFTGFHENRKNMYSEDDKATAIAFRLIHENLPLFIDNMKSFAKIAETVVAEHFADIETAFEDCLNA<br>LIPDMFALPYFTKTLTQEQIEVYNNIIGGRVLEDGTKIQGINEYVNLYNQQQKDKSARLPLLKPLYKMILSDHVAIS<br>WLPEEFASDEEMLSAINGAYDMLKDVLSEKNEDSLFNLLKNINEYDTEHIFIANDLGLTDISQQIFGQYDVYSSVI<br>KAELRNQASMTAKEKKNPELYEDRIAKLYKSAKSFSIDYLNSFVDSEKSIQNYYAQLGAYDRDGEQRINLFAQIEM<br>KHIAVADILAGKVANLNQSEQGIKLIKDFLDAFKALQHFIKPLLGNGDETDKDNAFDARLRVAWDTLDIITPLYNK<br>VRNWLTRKPYSEEKIKLNFENAQLMNGWDLNKEPDCTSIILRKDDKFYLAIMDKKANHSFDTDELPNEGDCYEK<br>VDYKLLPGANKMLPKVFFSKSRIDEFAPSQSLLDAYEKGSHKKGTNFSLNDCHNLIDFFKQSIAKHEDWKKFPFD<br>FSDTSSYEDISGFYREVEQQGYMLSYRNVSAAYIDKLVDEGKLFLFQIWNKDFSEYSKGTPNMHTLYWKMLFDE<br>KNLANVVYKLNGQAEVFYRKKSLDIANTTVHTANRPIANKNKKKESTFEYDIIKNRRYTVDKFQFHVPITMN<br>FKSIGNDNINESVLNVIRNNGIKHIIGIDRGERHLLYLSLIDLKGNIVKQMTLNDIVNEYNGNTYSTNYKDLLATRE<br>GDRTDARRNWQKIENIKDLKEGYLSQVVHVIAKMMVEYKAIVVLEDLNMGFMQGRQKIERNVYEQFERKLIEK<br>LNFYVDKQKKADEVGGLLNAYQLTSKFDSFKKLGKQSGCLFYIPAWNTSKIDPVTGFVNMLDTRYENTEKARCF<br>FSKFDSIRYNTQKDWFEFAFDYGNFTTKADGTQTKWTLCSFGTRVKTFRNPEKVNQWDNVEVVLTEEFKSLFA<br>DAGINIINGNLKEQICNLSDKKYLEPLMGLMKLLLQLRNSITNSEVDYLLSPVCDNKGNFYDSRTCSNKLPKDADA<br>NGAYNIARKGLWALARIVDSAEGERPNLAISNKDWLCFAQQKPYLND |
| 135 | MERFDELTGLYSLSKTLQFELKPIGKTLEQIERKGIIAQDEKRAEEYEIAKCIIDEYHKAFISMCLKGLRLNLSSTGSLD<br>SLEEYVEQASKLRRSESEEKNFDTIKQNLRRQIVNSFKSRGGSFTDLFKKELITQHLPEFVSEKNKKQIVENFSKFTT<br>YFTGFHENRKNLYSEEEKSTAIAYRLIHENLPMFIDNIKTFAKIADSDVANYFVEIETTFSEYLDGSHITDMFKLEYF<br>TETLTQEQISLYNNVIGGVSNEDGTKKKGLNEYVNLYNQQNKTRLPLLKPLYKMLLSDKVSLSWLPDDFVSDEE<br>MIYAINEMQLSLKDLLYSDGENSLKYLLTHIGDYDTEHIYISNDLGLTDISQQIFGQYDVYTSGIKTELCNQIKQSAK<br>EKREPELYKERINKLFKSAKSFSINYLNSFAEGDKTIQAYYARLGAHDLEGEQSTNLFTQIEMASIAASDILAGKHT<br>NINQSEEDTKLIKDLLDTYKALQHFIKPLLGNGDEADKDNEFDARLRNAWDALSVVTPLYNKVRNWLTRKPYST<br>EKIKLNFDNAQLLGGWDLNKEPDCTSVLLRKDDMFYLAIMDKKYNHAFDIDELPCEGECYEKVDYKLLPGANK<br>MLPKVFFSKSRISEFAPSLAIQKSYNEGTHKKGSNFSISDCHRLIDFFKQSIAKHEDWSKFPFSFSDTKRYEDISGFY<br>REVEQQGYMLSYRNVSVSFINQLVDEGKLYLFQIWNKDFSKYSKGTPNMHTLYWKMLFDEVNLADTVYKLNG<br>QAEVFYRKSSLKLENTTIHKANQTIKNKNVQNEKKTSTFDYDIVKNRRYTVDKFQFHVPITLNFKATGGDNINAN<br>VQDIIRNNGIEHIIGIDRGERHLLYLSLIDLKGNIVKQMTLNDIINEYKGNIYKTNYKDLLVTREGDRTEARRNWHK<br>IENIKDLKEGYLSQVVHIIARMMAEYKAIVVLEDLNMGFMRGRQKIERNVYEQFERMLIDKLNYYVDKQKKATE<br>NGGLLHALQLANKFESFKKLGKQSGCLFYIPAWNTSKIDPVTGFVNLFEIHYENVDKARCFFSKFDIIQYNEERD<br>WFEFAFDYNDFGTKAEGTKSKWTLCTYGTRIKTFRNPNKLNQWDNEEVVLTEEFKKIFNEAGIDINGNIKDAIC |

TABLE S9A-continued

Enzyme Sequences Group 9 (SEQ ID Nos: 131-170)

| SEQ ID NO | Sequence |
|---|---|
| | QLKEKKHLESLMHLMKLLLQMRNSVSNSEIDYLLSPVADENGEFYDSRTCAPTLPKDADANGAYNIARKGLWVI<br>EQIKQTADKPRLAMTNKEWLKFAQDKPYLNE |
| 136 | MNTFNELSGLYSLRKTLQFELKPIGKTLENIEKKGIIEQDTQRDVEYKKVKGIIDNYHKAFIKMCLWNLELKLESDG<br>HSDSLEDYVRLASIIRRGELDEIEFSKVKDNLRKQIVSAFKNGNSYGDLFKEELIQEHLPNFVTDEAEKQMVDNFS<br>KFTTYFSEFHKNRKNMYSDEKKSTAIAYRLIHENLPIFIDNIKTFKKIANTEIVNHFADIKQAFQECLNVENIDEMF<br>QLNYFTKTLPQEHIETYNNIIGGKTNEDGSKIQGLNEYINLYNQQQKDHSNRLPLFKPLYKMILSDREALSWLPEE<br>FASDEEMINAINEVYDSLKNVLANDNNGLKHLLLNINQYDTEQIYIANDLGLTDISQQMFGKYDVFTSGIKNELR<br>GQISPSAKEKREPELYEEKINKIFKSARSFTINYLNSFVQDGKTIQSYFAQLGATNTDSAQCIDIFTKIEMAHIAATDI<br>LEGKHNSIDQSDSDIKLIKDLLDAYKELQHFIKPLLGSGDEAMKDNEFDAQLHYAWDSLNIITPLYNKVRNWLTR<br>KPYSTEKIKLNFENAQLLGGWDMNKETDCTSVLLRKDNMYYLAIMDKKSNHAFDIDVLPNEGDCYEKVDYKLLP<br>DAYKMLPKVFFSKSRINEFAPSKDIQNAYQKGTHKKGPNFSISDCHRLIDFFKQSIAKHEDWQKFPFSFSDTDSY<br>DDISGFYREVKQQGYMLGYRKVSVSFINQLIDDGKLYLFQIWNKDFSEHSKGMPNIHTLYWKMLFDERNLSNII<br>YRLNGKAEVFYRQNSLKLENTTIHKANQPIKNKNIQNSKECSTFDYDIIKNRRYTADKFQFHVPITLNFRSTGSDNI<br>NNKVNDVIRNNDIEHIIGIDRGERHLLYLSLIDLKGNIVKQMTLNDIVNEYNGNITYKNYKDLLVQREGDRTEAR<br>RNWQKIENIKEIKEGYLSQVIHIITKMMVEYKAIVVLEDLNMGFMRGRQKIERNVYEQFEKKLIDKLNYYVDKQK<br>DITDAGGLMHALQLANKFESFKKLGKQSGCLFYIPAWNTSKIDPVTGFVNLLDTHYENIDKARCFFSKFDSIRYN<br>ASNDWFEFELDYDKFTDKARGTKTHWTLCSYGTRIRTFRNPLKLNQWDNEEVVLTEEFKKVFNNANIDIYGNLK<br>NSICSLNDKTTLESLMQLMKLMVQMRNSITGTETDYLLSPVTDANGNFYDSRNNIPTLPIDADANGAYNIARKG<br>LWIIQKIQQSQPGEKLNLAISNREWLQFAQQRPYLNE |
| 137 | MKTFNDLTGLYSLSKTLRFELKPVGKTKDNIETKGIIAQDEKRAEEYKKVKDIIDRYHKKFIEMCLANLKLKTISDGN<br>NDSLKEYVTLASKANKDEKEDNDFKDVKTALRKQIVDAFKKGGSYSDLFKKELIQVHLPDFVTDEQEKQMVENF<br>GKFTTYFTGFNENRQNMYSDEEKSTSIAYRLIHENLPMFIDNIKSFAKIAEHEDIDFLPDIENGFKEELKRLKAQSIS<br>EVFDLANFTNTLTQSQIDSYNAIIGARHDENGDKVQGINQYVNLYNQKNKDARLPLLKPLYKMILSDRGALSWL<br>PEEFATDEEMLAAINETHGNLKNVMTDVRKLLQNIDSYDTEHIYIANDKGLTDISQQIFGQYDVYTSAIKAELRDS<br>ITPSAKERKDPELLEKRINDIFKASKSFSIEYLNSHVDSDKTIQSYVKELGAYDRNGEQRINLFSQIELAYVDAHDVLL<br>GKHTNLNQSEDSIKKIKALLDAYKALLHFIKPLLGNGDEADKDNEFDAKLRAIWKDELDIVTPLYDKVRNRLTRKPY<br>STEKIKLNFDNAQLLNGWDMNKEPDCTSVLLRKDGQYYLAIMDKKSNHAFDIDELPCNGECYDKMDYKLLPGA<br>NKMLPKVFFSKSRIKEFAPSKEICDAYQKGTHKKGANFSIKDCRRLIDFFKDSIAKHEDWSKFPFTFSDTSTYEDIS<br>GFYREVEQQGYMLGYRKVSVSFINQLVDEGKLYLFQIWNKDFSEYSMGTPNMHTLYWKMLFDERNLANVVYK<br>LNGQAEVFYRKKSLDLNKTTIHRANQPIANKNMQNEKRESTFCYDIVKNRRYTVDKFQFHVPITINFKATGSDNI<br>NASVLDVIRNNGIEHIIGIDRGERHLLYLSLIDMKGNIVKQMTLNDIINEYKGNTYTTNYKELLQAREGDRKEARQ<br>NWQKIENIKELKEGYLSQVVHVITKMMVEYKAIVVLEDLNGGFMRGRQKIERQVYEKFEKMLIDKLNYYVDKQ<br>RDANENGGLLHAYQLASKFDTFKKLGKQSGCLFYIPAWNTSKIDPVTGFVNMLDTRYENADKARNFFSKFKSIN<br>YNADKNWFEFVIDDYSKFTDKAKDTRTDWVLCTYGTRIKTFRNPEKLNQWDNKEIVLTDEFKKVFMEAGIDING<br>NLKEAICTLTEKKHLESLMQLMKLLVQMRNSETNSEVDYLLSPVADTEGHFYDSRNCGDNLPKDADANGAYNI<br>ARKGLWAVMKIKASKPQENLKLGISNKEWLQFAQEKPYLND |
| 138 | MKNILEQFVGLYPLSKTLRFELKPLGKTLEHIEKKGLIAQDEQRAEEYKLVKDIIDRYHKAFIHMCLKHFKLKMYSE<br>QGYDSLEEYRKLASISKRNEKEEQQFDKVKENLRKQIVDAFKNGGSYDDLFKKELIQKHLPRFIEGEGEEEKRIVD<br>NFNKFTTYFTGFHENRKNMYSDEKESTAIAYRLIHENLPLFLDNMKSFAKIAESEVAARFTEIETAYRTYLNVEHIS<br>ELFTLDYFSTVLTQEQIEVYNNVIGGRVDDDNVKIQGLNEYVNLYNQQQKDRSKRLPLLKSLYKMILSDRIAISWL<br>PEEFKSDEEMIEAINNMHDDLKDILAGDNEDSLKSLLQHIGQYLSKIYIANNPGLTDISQQMFGCYDVFTNGIK<br>QELRNSITPTKKEKADNEIYEERINKMFKSEKSFSIAYLNSLPHPKTDAPQKNVEDYFALLGTCNQNDEQQINLFA<br>QIEMARLVASDILAGRHVNLNQSENDIKLIKDLLDAYKALQHFVKPLLGSGDEAEKDNEFDARLRAAWNALDIV<br>TPLYNKVRNWLTRKPYSTEKIKLNFENAQLLGGWDQNKEPDCTSVLLRKDGMYYLAIMDKKANHAFDCDCLPS<br>DGACFEKIDYKLLPGANKMLPKVFFSKSRIKEFSPSESIIAAYKAGTHKKGPNFSLSDCHRLIDFFKASIDKHEDWS<br>KFRFRFSDTKTYEDISGFYREVEQQGYMLGFRKVSETFVNKLVDEGKLYLFHIWNKDFSKHSKGTPNLHTIYWK<br>MLFDEKNLTDVVYKLNGQAEVFYRKKSLDLNKTTTHKAHAPITNKNTQNAKKGSVFDYDIIKNRRYTVDKFQFH<br>VPITLNFKATGRNYINEHTQEAIRNNGIEHIIGIDRGERHLLYLSLIDLKGNIVKQMTLNDIVNEYNGRTYATNYKD<br>LLATREGERTDARRNWQKIENIKEIKEGYLSQVVHILSKMMVDYKAIVVLEDLNTGFMRSRQKIERQVYEKFEK<br>MLIDKLNCYVDKQKDADETGGALHPLQLTNKFESFRKLGKQSGWLFYIPAWNTSKIDPVTGFVNMLDTRYENA<br>DKARCFFSKFDSIRYNADKDWFEFAMDYSKFTDKAKDTHTWWTLCSYGTRIKTFRNPAKNNLWDNEEVVLTD<br>EFKKVFAAAGIDVHENLKEAICALTDKKYLEPLMRLMTLLVQMRNSATNSETDYLLSPVADESGMFYDSREGKE<br>TLPKDADANGAYNIARKGLWTIRRIQATNSEEKVNLVLSNREWLQFAQQKPYLND |
| 139 | LTRKPYKTEKIKLNFENSQLLGGWDVNKEPDCTSVLLRKDGMYYLGIMDKKANKSFYCDCLPSEGSSYEKVDYKL<br>LPGANKMLPKVFFSKSRKSEFAPSEVITKAYENGTHKKGANFSLSDCHRLIDFFKASINKHEDWSRFGFIFSETNT<br>YEDMVGFYREVEQQGYMLGFRNVSEEYIDRLVDDGKLYLFQIWNKDFSEHSKGTPNLHTIYWKMLFDERNLEN<br>IVYKLNGQAELFYRKKSLDLCKTTVHKAHQSVANKNPQNDKRESIFEYDIIKNRRYTLPDKFQFHVPITINFKATGD<br>DRLNSATLEAIRDGGIEHIIGIDRGERHLLYLSLIDLKGNIVKQFTLNEIASEYNGAPCPPTNYKDLLVAREGDRNEA<br>RRNWQKIENIKEIKEGYLSQVVHIIAKMMVEYKAIVVLEDLNMGFMRGRQKIERQVYEKFEKMLIDKLNCYVDK<br>QKEATDIGGVLHPLQLTSRFESFRKLGKQSGWLFYIPAWNTSKIDPVTGFVNMLDTRYENVDKTRCFFSKFDVIR<br>YNGDKDLFEFTFDYDKFTDKAKGTRTKWTLCTYGSRIKTFRNPKKNNQWDNEEIVLTDEFKKAFADAGIDIEGN<br>LKDAICSLTEKKHLEPLMNLMKLLLQMRNSKTGTEIDYLLSPVADADGNFYDSRNEISTLPKDADANGAYNIARK<br>GLWAIRKIQSAPSGEKPNLAISNKEWLQFAQQKPYLDD |
| 140 | MNTFNQFTNLYNVQKTLCFELQPVGKTRENIEEDGLLKQDEERAENYKKVKGFIDEYHKQYIKDRLWNYELPLK<br>GEGKRNSLEEYQQFYELSKRDANQEATFTEIKDNLRAIIAKRLTEKGSAYERIFKKELIREDLIEFLDKEEDKELVRQF<br>SDFTTYFTGFHENRANMYKDEEQSTSIAYRLIHQNLPKFMDNIKAFSAIAQTPVAEHFKELYARWESYLNVSSID<br>EMFRLDYFSHTLTQPHIEVYNSIIGKRILEDGTEIKGINEYVNLYNQQQKDKKLPLFVPLYKQILSDRERLSWLSEEF<br>DSDAKMLKAINECYDHLHDLLMGKENESLCELLKHLTDFNLSQINITNDLSLTDISQSMFGRYDVFTTGLKNTLKI<br>STPQKRDEKEEAYEDRITKLFKACKSFSIAELNGLQLPVAEDGGHKRVEDYFISLGAVGKEKNLFEQIEEAYTEALPI |

TABLE S9A-continued

Enzyme Sequences Group 9 (SEQ ID Nos: 131-170)

| SEQ ID NO | Sequence |
|---|---|
| | LQLKETDDTLSQNKAAVAKIKDLLDAFKNLQHFVKPLLGSGEENEKDEVFYGAFQTLWDELDAVTPLYNKVRN WLTRKPYSTEKIKLNFDNAQLLDGWDENKETANASIILCKDRKPYSTEKIKLNFDNRKLLGMPMPSDGECYDKVVYK FFKDITTMVPKCTTQKKDVVAHFAHSNEDYILFDKKTFNAPVTITKEIYELNNILYNGVKKFQIEYLRSTGDKSGYE HAVFTWKTFCLQFLKAYKSTSIYNLKLVEQHIDSYYDLSSFYSAVNLLLYNLSYRKVSMSYVHSLVEEGKLFLFRIW NKDFSEYSKGTPNLHTLYWKMLFDERNLADVVFKLNGQAEVFYRKASIKQENRIIHPAHQAINNKNPLNRTPTS TFDYDIIKNKRYTVDKFLFHVPITINFKAKGLTNINPLVLDVIRKGGFSHIIGIDRGERHLLYLSLIDLKGNIVKQMTL NEIINVYREQTYVTNYHNLLAQREGDRTKARRSWDTIENIKELKEGYLSQVHVISKMVVEYHAIVVLEDLNMGF MQSRQKIERQVYEKFEKMLIDKLNCYIYKQVDPTSEGGVLHALQLTNKFESFRKLGKQSGCLFYIPAWNTSKIDP LTGFVNFINPKYESIQAARDLIGKFEDIRYNPEKNYFEFHIKDYAAFNPKAKSSRQEWVICTKGTRIRTFRNPDKN NEWDSEEIVLTEKFKELFDSYGIDYRCNLLASILIQTKKDFFHNEDVKKPSLLSLLKLTLQLRNSHINSEVDYILSPVA DAKGSFYDSRTCGSSLPNNADANGAFNIARKGLMLVERIRSIKDDEKPALTITNEEWLHYAQAQ |
| 141 | MKSLTNLYPVSKTLRFELQPIGKTKENIEKHGILSRDEQRAEDYITVKKYIDEYHKQLIKDRLWNFKLPMKSDSKLN SLQEYQELYELSKRDACQEDRFTELKDNLRAIIAKQLTGGTAYGRIFKKELIREDLIDFLTQEEEKETVRQFADFTTY FTGFHENRKNMYSAEEKSTAIAYRLIHQNLPKFMDNMKAFAKIAKSPVAEKFANIYKEWEDSLNVSCLEEIFQLD YFSETLTQPHIEVYNYIIGKKTKEDGNDVKGINEYVNEYNMRHKDNPLPLLVPLYKQILSDREKLSWIAEEEFDSDE KMLSAINESYNSLHDVLMGEENESLRSVLLHIKDYNLERVNINSESLTDISQHIFGRYDVFTNGIKAKLRGKNPKK RNESDESFEDRITKIFKTQKSYSIAYLNNLPQPTMEDGRVRTIEDYFISLGAINIEAKQKINLFAQIENAYHDAFTILK RTDTDDTLSQDKKAVEKIKVLLDAFKDLQHFIKPLLGSGEENEKDELFYGIFQLIWDELEAITPLYNKVRNWLTRK PYSTEKIKLNFDNAQLLDGWDENKETANASIILCKDGLYYLGILNKDYRKLLGMPMPSEGDCYDKVVYKFLKDITT MVPKCTTQKKEVVAHFGQSVEDYVLFDPKTFNAPVTVTKEIFDLNNVLYNGVKKFQIEYLRSTDDSLGYEHAVST WKSFCMQFLKAYKSTSIYNLASVEQKMNSYSDLSSFYKAVNLLLYNLSYRKVSVDYIHSLTEEGKLYLFRIWNKDF SEFSKGAPNLFTLYWKMIFDERNLDNVVYKLNGQAEVFFRKSSIKPENRVIHPAHRPIDNKNEQNKKRTSTFKYD IIKDYRYTVDKFQFHVPITIGFKSEGQTNINSRVQDIIRRGGFTHIIGIDRGERHLLYLSLIDLRGNIVMQKTLNVISR EVRGVTYSTNYRDMLEKREGDNKEARRSWGVIESIKELKEGYLSQAIREIANMMVEYNAIVVLEDLNQGFMRG RQKIERQVYEKFEKMLIDKLNCYVDKQIAPSSIGGALHPLQLTNKFESFRKLGKQSGCLFYIPAWNTSKIDPVTGF VNLFDTRYDTREKARMFFSKFKRIKFNTEKDWFEFAFNYNDFTSKAEGTRTEWTLCTYGERIRQFRNPEKNHN WDDETIVLTDEFKRLFCEYGIDIHGNLKESIVAQSDAKFFRGLLGLMKLLLQMRNSIANSEEDYLLSPVMDEKGCF FDSRDNDGTLPENADANGAYNIARKGLWIIRKIRETAENEKPSLKITNKQWLLFAQSKPYLND |
| 142 | MNTSNLSRFTNLYSISKTLRFELQPLGKTKDYIEKNGILMRDEKRAEDYKTVKGIIDEYHKKYIKSRLWDFKLPLASE GKRDSLEEYKALYEVSKRSEADEAAFKEVKDNLRSIIAKRLTSGKAYETIFKKELIREDLINSLEDEVEREIVSQFADF TTYFGGFHENRKNMYDAGEKSTAIAYRLIHQNLPKFMDNMKAFAKIAETSIAEHFADIYEGSKEMLNVGSIEEEIF RLDYFSEILTQPHIEVYNSIIGKRVLEDGTEIKGINEYVNLYNQQQKDKRLPLLVPLYKQILSDREKLSWLAEEEFDCD EKMLAAINETYAHLHDLLMGNENESLRSLLLHLRDYDLEQINISNDLSLTDISQHLFGRYDVFTNGIKEELRVITPR KRKETDEQLEDRISKIFKTQKSFCIAPLNSLPQPAMEDGKARCIEDYFMALGAINNETTQKENLFAQIENAYENA KSVLQMKETGDMLSQNKPAVAKIKALLDALKDLQHFIKPLLGSGEENEKDELFYGSFQMMWDELDAVTSLYNK VRNWLTRKPYSTEKIKLNFDNAQLLDGWDENKETTNASILLYKDGNYYLGIIKKEDRKILGSPMPTDGECYDKVV YKFFKDITTMVPKCTTQKKDVIAHFMHSDDDYILYDKKTFDAPVTITKEIYNLNNVLYNGVKKFQIEYLRSTGDKR GYEHAVFIWKSFCMHFLKAYKSTSIYNLVLVEQINSYYDLSSFYKAVNLLLYNLSYRKVSVYIHSLVDEGKLYLF RIWNKDFSEYSKGTPNLHTLYWKMLFDERNLADVVYKLNGQAEVFYRKSSIQPEHRIVHPAGKPIANKNEHSKE PTSTFKYDIVKDRRYTVDKFQFHVPITINFKAAGQENINPVVLDAIRRGGFTHIIGIDRGERHLLYLSLIDLQGNIVE QMTLNEIINEYKGLKHKTNYHDLLAKREGERTEARRSWDTIENIKEMKEGYLSQVVHIISKMMVEYNAIVVLEDL NTGFMRSRQKIERQVYEKFEKMLIDKLNCYIDKQVGASDIAGLLHPLQLACEAKKWKRSHQCGCLFYIPAWNTS KIDPVTGFVNLFDTRYENAAKAKAFFGKFGSIRYNAEKDWFEFAFDYNDFTTKAEGTRTEWTLCTYRERIRTFRN PQKNHQWDDEEIVLTDAFKQLFDKYDIDMKGNLKEAICAQNDVQFFKDMMELMKLLLQMRNSITNSETDYLL SPVADEKGQFFDSRRGITTLPDNADANGAYNIARKGLWVIRKIQETAENEKPSLAITNKEWLQFAQTKPYLNE |
| 143 | MKQFTNLYPVSKTLRFELQPIGKTKENIEKNGILTRDEKRAKDYQVVKGFIDEYHKQYIKDRLWNFKLPLASEGNL DSLEEYQMLYEMPRRDDTHEEDFSEVKDNLRAIITKRLTENGSAYDRIFKKELIREDLIEFLNNEEDKALVRQFADF TTYFSGFHENRRNMYSAEEKSTAIAYRLIHQNLPKFMDNMKAFAKIAETSVAEHFSNIYEGWEEYLNVGSIEEIFR LDYFSETLTQPHIEVYNYIIGKKVLEDGTEIKGINEYVNLYNQQQKDKSRLPVLYKQILSDREKLSWLAEEEFDS DEKMLGAINESYTHLHELLMGEENESLRSLLLHLKEYDLSQINITNDLSLTNISQHLFGRYDVYSNAIKEQLKIIIPRK KKETDEEFEDRISKIFKTQKSFSISFLNNLPHPETENGKPRSVEEYFISIGTINTKTTQKENLFAQIENAYENVRVILQ MKDTGNALSQNKPAVTKIKALLDAFKDLQHFIKPLLGSGEELEKDELFYGSFQMIWDELNTVTPLYNKVRNWLT RKPYSTEKIKLNFDNSQLLGGWDVNKEPDCTGILLRKDSFYYLGIMDKKANRVFETDITPSEGDCYEKMVYKQLG QISQQLPRIAFSKTWQQKLSIPEDVIKIKKNESFKKNSGDLQKLSYYKSFISQHDEWNSYFDINFTDRNDYKNLPD FYSEVDSQFYSLSFSRVPSSYINQLVDEGKLYLFRIWNKDFSEYSKGTPNLHTLYWKMLFDERNLSNVVYKLNGQ AEVFYRKASIQPENRIIHKANLSIVNKNELNKKRTSTFEYDIIKDRRYTVDKFQFHVPITINFKGTGQLNINPIVQETI RQGGFTHIIGIDRGERHLLYLSLIDLNGNIVKQMTLNDIFNEYKGQTYKTNYHDLLVKREGDRTDARRSWDTIETI KELKEGYLSQVVHVISKMMVEYKAIVVLEDLNTGFMRGRQKIERQVYEKFEKMLIEKLNCYIDKQADATEVTGLL HPLQLTCEAKKWKRSHQCGCLFYIPAWNTSKIDPVTGFVNLLDTRYDTREKARLFFSKFQRISFNTEKGWFEFTF DYNDFTTKAEGTRTQWTLCTHGERIRTFRNPQKNNQWDNERIVLTDEFKKLFDQKEIDISGNMKEAICNQKDA QFYRDLLGLMKLLLQMRNSIANSEEDYLLSPIADKNGHFFDSRERISSLPVDADANGAYNIARKGLWIVRKIRNTS EGEKLSLAITNKEWLLFAQSKPYLND |
| 144 | MKKLTNLYPVSKTLRFELQAIGKTKENIEKNGILQRDEKRAEDYKIVKSLIDEYHKQFIKDRLWNFKLPHNEGHLD SLEEYQALYEISKRNDTQEAEFTEIKDNLRSIISKRLTECGSAYERIFKKELIREDLIDFLESNEDKDIVRQFADFTTYFS GFHENRRNMYVAEEKSTAIAYRLIHQNLPKFMDNMKAFAKIAETSVAEHFTDIYEGWKEFLNVGSLEEIFRLDYF SETLTQPHIEVYNYIIGKKILEDGAEIKGINEYVNLYNQQQKDKSRLPFLVPLYKQILSDRDKLSWLADEFDSDEK MLAAINESYNHLHDLLMGLENESLRSLLLNIKDFNLSQINISNDLSLTDISQHLFGRYDVFTSGIKDELRIITPRKKE SDEEFEDRISKIFKTQKSFSVDFLDKLPQPVMEDEKPRTIEDYFMTLGAVNTEATQKENFFAQIENAYEDARTILQI KDTGDTLSQNKSAVAKIKALLDALKDLQHFIKPLLGSGEENEKDELFYGSFQMMWDELDTVTSLYNKVRNWLT RKPFSTEKIKLNFDNSQLLGGWDVNKEPDCKGILLRKDDFYYLGIMDKKSNRIFEADVTPTDGECYDKIDYKLLPG |

TABLE S9A-continued

Enzyme Sequences Group 9 (SEQ ID Nos: 131-170)

| SEQ ID NO | Sequence |
|---|---|
| | ANKMLPKVFFSKSRIDEFAPSEAIVSSYKRGTHKKGAVFNLADCHRLIDFFKQSINKHEDWSKFGFHFSDTKSYED<br>ISGFYREVEQQGYMLSSHPVSSSYIDTLVSEGKLYLFRIWNKDFSESSKGTPNLHTLYWKMLFDERNLVDVVYKL<br>NGQAEVFYRKASIKPENCIIHKANQPIANKNELNTKRASTFKYDIIKDKRYTVDKFQFHVPITINFKAAGQNNINPI<br>VQEAIKQDEFSHIIGIDRGERHLLYLSLIDLKGNIVKQMTLNEIINEYKGQTYKTNYHDLLAKREGDRTEARRSWET<br>IETIKELKEGYLSQVVHIISKMMVEYNAIVVLEDLNTGFMRGRQKIERQVYEKFEKMLIDKLNCYIDKQLSPTDEG<br>GLLHPLQLTCDAQKWKRSHQCGCLFYIPAWNTSKIDPVTGFVNLLDTHYDTREKARVFFSKFQRISYNAPKGWF<br>EPAFDYNDFTTKAKGTRTQWTLCTQGERIRTFRNPQKNHQWDDERIMLTDAYKQLFDKYDIDINGNIKEAISSQ<br>TDAQFFKDLMGLMKLLLQMRNSITNSEEDYLLSPVANGTGHFFDSREGISSLPKDADANGAYNIARKGLWVVQ<br>KIQETPEGEKPSLTITNKEWLQFAQTKPYLND |
| 145 | MKEKEQYSDFSRLYPVSKTLRFELKPIGRTMKNIEKNGILERDNQRANDYKIVKEFIDEYHKQHIKDRLWDFKLPL<br>KSDGRLDSLKEYQELYELSKRDANQESAFTEIKDNLRSIIARRLTHDSPAYKRIDKKELIREDLLEFLENEEDKEIVRQ<br>FADFTTYFTGFHQNRQNMYTAEEKSTAIAYRLIHQNLPKFMDNMKAFAKIAETSVAEHFADIYEGWKEYLNVG<br>SIEKIFQLDYFSETMTQPHIEVYNYIIGKKILEDGTEIKGINEYVNLYNQQQKDKSQRLPFLVPLYKQILSDREKLSW<br>MAEEFDSDEKMLAAINESYVHLHDLLMGTENESLRSLLSHMKGDTFNLEQINIINNDLSLTDISQHLFGRYDVFTNGI<br>KDELRAITPRKKKESDEDFEDRISKIPFKTQKSFSISLLNKLPQPVMEDGKPRTVEEYFMSLGAVNTETTQKENLFA<br>QIENAYENARSILQMKDTGDALSQNKQAVAKIKALLDAFKDLQHFIKPLLGSGEENEKDELFYGVFQLIWDELDT<br>MTPLYNKVRNWLTRKPYSTEKIKLNFDNAQLLGGWDVNKEPDCTGVLLQKDGFYYLGIMNKKANRIFESKVTP<br>SNEDCYEKIDYKLLPGANKMLPKVFFSKSRIDEFAPSEAIVDSYRRGTHKKGPDFNLSDCHRLIDFFKDSIAKHED<br>WSKFVFHFSETSTYEDISGFYREVEQQGYMLASHPVSVSYVEQMVDEGKLYLFRIWNKDFSEHSKGTPNLHTLY<br>WKMLFDERNLADVVYKLNGQAEVFYRRASIKPKNRIIHQANSPIANKNELNEKRTSTFKYDIIKDRRYTVDKFQF<br>HVPITIGFKAIGQNNINPIVQDTIRQGGFTHIIGIDRGERHLLYLSLIDLKGNIIKQMTLNDIVNEYNGVLYKTNYRD<br>LLKKREGERTDARRSWETIETIKELKEGYLSQVVHIISKMMVEYNAIIVLEDLNTGFMRGRQKIERQVYEKEKML<br>IDKLNCYIDKQTNPEDVGGLLHPLQLTCDAQKWKRSHQCGCLFYIPAWNTSKIDPVTGFVNLFDTRYETREKAR<br>LFFSKFQRIDFNTESDWFEFSFDYNDFTTKAEGTRTKWTLCTYGERIRTFRNPEKNHQWDDERIVLTDEFTQLFE<br>RYNIDIQGNLKEAISAQSDAQFYRELLGLMKLLLQMRNSITNSEEDYLLSPVADESSHFFDSRENVEILPNNADAN<br>GAYNIARKGLWVIRRIQETAENEKISLAISNKEWLQFAQTQPYLND |
| 146 | LQLTDTEDKLSQNKPAVGKIKALLDAFKDLQHFIKPLLGSGEENEKDELFYGAFQLIWDELDTVTPLYNKVRNWL<br>TRKPYSTEKIKLNFDNAQLLGGWDVNKEPDCTGVLLRKDGFYYLGIMNKKSNRIFDADVTPADGICYEKIDYKLL<br>PGANKMLPKVFFSKSRIDEFAPSEAILSSYKRGTHKKGADFSLSDCHRLIDFFKASINKHEDWSKFGFQFSDTKTY<br>EDISGFYREVEQQGYMLSHQVSEAYINQMVEEGKLFLFRIWNKDFSEYSKGTPNMHTLYWRMLFDERNLAD<br>VVYKLNGQAEVFYRKASIKAENQIMHPAHHPIENKNTLNEKRSSTFDYDLVKDRRYTVDKFQFHVPITINFKAIG<br>QTNVNPIVHETIRRGGFTHVIGIDRGERHLLYLSLIDLKGHIVKQMTLNEIINEYNGLAHKTNYDLLVKREGERTT<br>ARRSWDTIENIKELKEGYLSQVIHIISKMMVEYNAIVVLEDLNMGFMRGRQKIERQVYEKFEKMLIDKLNCYIDK<br>QADSQSEGGLLHPIQLANKFESFRKLGKQSGCLFYIPAWNTSKIDPVTGFVNLFDTRYETREKAKLFFSHFQRICF<br>NAEKDWFEFSFDYNDFTTKAEGTRTQWTLCSYGTRIRNFRNPLQNHQWDDEEIVLTEAFKALFDKYDIDIHANL<br>KEAINAQTDAQFFKDLMGLMKLLLQMRNSKTNSEVDYLLSPVADEHGRFFDSRAGAGSLPDNADANGAYNIA<br>RKGLWVIRKIQETPEGEKLSLAITNKEWLEFAQTKPYLND |
| 147 | LGLFLRLRPKLFVILCKSNSNVMRNLTNLYPVSKTLRFELQPIGKTKENIEKNGILQRDEKRAEDYQKVKNLIDEYH<br>KQFIKDRLWTFELPLEILEEYKELYETPKRDEAAFTEVKDNLRALIASQLKAKGSIYDRIFKKELIREDLIEFLDNEEDK<br>EIVRQFADFTTYFSGFHKNRENMYSAEEKSTAIAYRLIHQNLPKFMDNMKAFALIAKSPVAEHFPDLYSAWEECL<br>NVASIEEMFRLDYFSQTLTQTGIEVYNYIIGKKILEDGTEIKGINEYVNLYNQQQHQKDKKERLPLLVPLYKQILSDREK<br>LSWLAEEEFDSDEKMLNAINELYAHLHDLLMGEENESLHSILLQLKEYDLSQINIANDLSLTAISQQMFGRYDVFT<br>NGMKDILRTITPHKKKETEEDFEERISKILKIQKSISIAELNKLPQPISEDGGKPKLVEDYFMSLGAVDDGVTQKAN<br>LFAQIENAHTDALSVLQLTGTGDTLSQNKTAVAKIKTLLDAFKDLQHFIKPLLGSGEENEKDELFYGSFQLFWDEL<br>DAVTPLYNKVRNWLTRKPYSTEKIKLNFDNAQLLGGWDVNKEPDCTPGILLRKDGLYYLGIMNKKSNRIFDASVT<br>PSDGDCYEKIDYKLLPGANKMLPKVFFSKSRIDEFAPSDAIINSYKRETHKKGANFSLRDCHRLIDFFKQSISKHED<br>WSKFGFHFSDTSSYEDISGFYREVEQQGYMLSSHPVSSAYIHQMVDEGKLFLFRIWNKDFSEYSKGTPNLHTLY<br>WKMLFDERNLADVVYKLNGQAEVFYRKASIKPENRIIHPANQDIKNKNALNEKATSRFEYDIVKDRRYTVDKFQ<br>FHVPLTINFKATGQANVNPVVQEAIRKGEFTHIIGIDRGERHLLYLSLIDLKGRIVKQMTLNEIVNEYNGHSHTTD<br>YHGLLADREGQRTTARRSWDTIENIKELKEGYLSQVIHVITKMMVEYKAIVVLEDLNMGFMRGRQKIERQVYEK<br>FEKMLIEKLNCYIDKQADPTDVGGLLHALQLTNKFESFKKLGKQSGCLFYIPAWNTSKIDPVTGFVNLFDTRYETR<br>EKSRLFFSRFDRIAYNQDKDWFEFSFDYDNFTTRAEGCRTHWTLCTQGSTRIRNFRNPQKNNQWDDEEVNLTAL<br>FKQLFDLYDIDIHGNLMEAIQRQTEAKFYQELMHLMKLTLQMRNSRINSEVDYLLSPVADEKGRFFDSRSGDCV<br>LPDNADANGAYNIARKGLMLIQTIRETPDGEKPSLTITNREWLRFAQEKPYLVD |
| 148 | MKQFTNLYPVSKTLRFELQPIGSTKENIEKNGILSRDEQRAEDYKKVKNLIDKYHKQFIKDRLWNFQLPLENKGNL<br>DSLEEYRILYETPKRDEAVFTEVKDNLRALIVNQLKAKGSAYERIFKKELIREDLIEFLDMEEDKKTVRQFADFTTYF<br>TGFNENRANMYSAEEKSTAIAYRLIHQNLPKFMDNMKAFAQIVQSPVAEHFTDLYSYWEEYLNVASIEEMFQL<br>DFFSQTLTQTGIEVYNYIIGKKILEDGTEIKGINEYVNYYNQHQKDKKQRLPLLVPLYKQILSDRERLSWLAEEFDS<br>DEKMLKAINELYVHLHDLLMGKENESLRSLLLLKEYDLSQINIANNFSLTAICHQMFGRYDVFINGMKDILRAIT<br>PHKKKETEEEFEERISKILKTQKSISIAELNKLPQPVCEDCCKPKLVEDYFMSLGAVDDGVTQKLNLFAQIENAHTD<br>ALSVLQLTGTGDTLSQNKPAVAKIKNLLDTFKNLQHFIQPLLGSGEENEKDELFYGSFQLFWDELDAVTPLYNKV<br>RNWLTRKPYSTEKIKLNFDNAQLLGGWDVNKESDCTGVLLRKGAYYYLGIMNKKANRIFDACITPSNGDCYEKI<br>DYKLLPGANKMLPKVFFSKSHIDEYAPSDVIIENYKKGTHKKGADFSLQDCHRLIDFFKQSISHKEDWSKFGFQFS<br>PTCSYEDISGFYREVEQQGYMLSTHPVSSAYIDEMVAEGKLFLFRIWNKDFSEYSKGTPNLHTLYWKMLFDKRN<br>LADVVYKLNGQAEVFYRKASIKPDNRIIHPANQDIKNKNALNENKTSRFEYDIIKDHRYTVDKFQFHVPITINFKAI<br>GQANINPIVNDAIRKGVFTHIIGIDRGERHLLYLSLIDLKGRIIKQMTLNEIVNEYNGHSHATNYRDLLANREGERT<br>TARRSWDTIENIKELKEGYLSQVIHVITKMMVEYKAIVVLEDLNTGFMRGRQKIERQVYEKFERMLIEKLNCYIDK<br>QTTPTAEGGLLHALQLTNKFESFKKLGKQSGCLFYIPAWNTSKIDPTTGFVNLFDTRYETREKSRLFFSRFDRIAYN<br>RDKDWFEFSFDYNNFTTKAEECRTRWTLCTQGSTRIINFRTPQKNNQWEDEEVNLTVLFKQLFDRYDINIHGNL |

TABLE S9A-continued

Enzyme Sequences Group 9 (SEQ ID Nos: 131-170)

| SEQ ID NO | Sequence |
|---|---|
|  | METIQQQTEAKFYQELMHLLKLTLQMRNSRTNSEVDYLLSPVADEHGHFFDSREDIETLPNNADANGAYNIAR<br>KGLWVIRKIQETPEGERPSLAITNKEWLQFAQTKPYLND |
| 149 | MTQKFDDFIHLYSLSKTLRFEARPIGDTLRNFIKNGLLKRDEHRAESYVKVKKLIDEYHKAFIDRVLSNGGLNYEDK<br>GEYDSLTEYYVLYSTTRRDETTQKHFKATQQNLRDQIVKKLTDDDAYKHLFGKELIESYKDKEDKKKLHEADLVQF<br>INTANPKQRLNFSKKEAIDLVKEFCGFTSYFGDFHKNRKNMYSAEEKSTGIAYRLINENLPKFIDNMESFKKIAAIP<br>EMEDNLKEIHDNFAEHLNVENIQNMFQLNYYNQLLTQKQIDVYNAIIGGKTDEEHKEKIKGINEYVNLYNQAHK<br>DAKLPKLKTLFKQILSDRNAISWLPEEFDNDQEALNAILDCYARLSENVLGKENLKRLLCSLSEYDTKGIFLRNDLQ<br>LTSISKKMSGSWTDIPSAIKNDMKDGAPAKKRKESEEDYEKRIDNLFKKLDSFSIGYIDDCLNKFDNNNTFTIEGYF<br>KELGAKDTQSEDIFKQIANAYTDVKPLLNSPYPKSKNLSQDKENVKKIKRFLDALMSLVHFVKPLLGNGDESNKD<br>EKFYGELSLLWTELETIVPLYNMVRNYMTRKPYSNSKIKLNFENSQLLGGWDVNKEKERASILLRRNGLYYLAIM<br>DKDSSKLLGKSMPSDGECYEKMVYKQISFNSGFGGFIRKCFNSATELGWKCSPTCLNKDGKIIILDEEATDIRPELI<br>DNYKSFLDIYEKDGYKYKNFGFHFKKSSEYENINDFFKEVEQQGYKITFTNVSVAFIDKLVKEGKMYLFQIYSKDFS<br>EYSKGTPNMHTLYWKALFDDRNLKDVVYKLDGQAEMFFRKKSINCNHPTHPANQPIQNKNKDNKKKESVFKY<br>DLTKDRRYAVDKFMFHVPIKMNFKSTGTENINLPVREYLKTSNDTHIIGIDRGERHLLYLVVIDLHGNIVEQYSLN<br>DIVNEYNGNTYRTNYHDLLDAREEDRLKQRQSWQTIENIKELKEGYLSQVIHKITQLMIKYHAIIVLEDLNMGFM<br>RGRQKVEKQVYQKFEKMLIDKLNYLVDKKADIESTGGLLNAYQLTNKFPGFKNLGKQSGFLFYIPAWNTSKIDPV<br>TGFVNLLDIRNVDKAKAFFAKFDSIWYNKEKDWFEFALDYDKFGSKAEGTRTKWTLCTQGKRIKTFRNADENSN<br>WDYQIIDLTKDLKQLFAQYNIDINGNLKEAISNQTEKTFFVELLGLLKLTLQMRNSITGTETDYLVSPVADENGNF<br>YDSRTCGHSLPENADANGAFNIARKGLMIIEQIKASDNLSKLKFDISNKSWLNFAQQKPYKHE |
| 150 | MKRKFDDFIHLYSLSKTLRFEASPIGDTLRNFKKNGLLERDKHRAESYVKVKKLIDEYHKVFIDRVLNGSVLNYVNK<br>GKYDSLTEYYDLYSVPKKDETSQKHFKAIQQHLRQQIVKKFTDDKNYKRLFGKELLESYKDKEDKKKLNEADLVQF<br>INAANPEQLLSLSKKEAIDLVQEFSGFTTYFNEFHKNRKNMYSAEEKSTGIAYRLINENLPKFIDNMKSFKKIVDIPE<br>MKDNLKQIHEYFVDYLNVENIHEMFQLDYYNQLLTQKQIDVYNAIIGGKTDNEHKEKIKGINEYVNLYNQTHKD<br>AKLPKLKVLFKQILSDRNAISWLPEEFKDDQEVLNAIKDCYARLSKNVLGDNILKELLCSLAEYDTKGIFLRNDLQT<br>DISQKMFGNWSVIPSAIKKDVAPAKKRKELEEDYEKRIDNLFKKRESPSIDYIDSCLDKFDENNTHTIEGYFATLGA<br>VDTPTTQRENIFAQIANTYTDLEPLLKSPYSKNKNLSQDKDNVAKIKLFLDALMSLMHFVKPLLGKGDESNKDEK<br>FYGDFTLLWTELETVVPLYNMVRNYMTRKPYSKSKIKLNFDNSQLLGGWDANKESDYASILLRRDGKYYLAIMD<br>KDSKKLLGKSMPSDGECYEKMVYKLLPGANKMLPKVFFATSRIKDFKPSEQLLENYNKGTHKKGVNFSISDCHAL<br>IDYFKQSINKHEDWKNFNFNFSETSTYEDLSAFYREVEQQGYKITFTNVSVSFIDKLVEEGKMYLFQIYNKDFSEYS<br>KGTPNMHTLYWKALFDERNLKDVVYKLNGQAEMFFREKSIKVSTIHPANRPIQNKNKDNKKKESIFEYDLIKDR<br>RYTVDKFMFHVPITMNFKSADTENINLPVREYLQTSDDTHIIGIDRGERHLLYLVVIDLQGNIVEQYTLNDIVNEY<br>NGNTYRTNYHDLLNAREAERLKARQSWQTIENIKELKEGYLSQVIHKITQLMIKYHAIVVLEDLNKGFIRGRQKVE<br>KQVYQKFEKMLIDKLNYLVDKKADIETTGGLLNAYQLTSKFESFQKLGKQSGFLFYIPAWNTSKIDPVTGFVNRL<br>DTRYHNVDKSKAFFAKFDSIRYNKEKDWFEFALDYKNFGNKAEGTRTKWTLCTQGKRIKTFRNAEKNSNWDY<br>QIIDLTKELKQLFAHYDIDINGNLKKAISNQTEKTFFVELMQFLKLTLQMRNSITNTETDYLVSPVADENGNFYDS<br>RKCGSSLPENADANGAFNIARKGLMIIEQIKASDDLSKLKFDISNKSWLNFAQQKPYKHE |
| 151 | LVQFINTANLKQRLNLSKEEAKDLVQEFCGFTTYFGDFYQNRENMYSAEEKSTGIAYRLINENLPKFIDNMETFKK<br>IAAIPEMEDNLKEIHDNLSEHLNVENIQDMFQLNYYNQLLTQKQIDVYNAIIGGKTDDEHKEKIKGINEYVNLYN<br>QAHKDAKLPKLKTLFKQILSDRNAISWLPEEFDNDQETLNAIKDCYAHLSGNILKDENLKRLLCSLSEYDTKGIFLR<br>NDSQLTSISKKMSGSWTDIPSAIKNDMKDGVPAKKRKESEEDYEKRIDNLFKKQDSFSIDYMDACLNKFVENNP<br>YTIEGYFKELGAKDTQSEDIFKQIENAYTDVKPLLNSTYPKNKNLSQDKENVAKIKRFLDTLMSLVHFVKPLLGKG<br>DERNKDEKFYGELSLLWTELETIVPLYNMVRNYMTRKPYSNSKIKLNFDNSQLLGGWDANKESDYSSILLYRDGK<br>YYLAIFDKDSKKLLGKSMPSDGECYEKMVYKLLPGANKMLPKVFFAKSRIKDFKPSEQLLEKYNKGTHKKGKNFSI<br>SDCHALIDFFKQSINKHEDWKNFDFNFSETSTYEDLNSFYREVELQGYKITFTKVSASFIDKLVEEGKVYLFQIYNK<br>DFSEYSKGTPNMHTLYWKALFDDRNLKDVVYKLNGQAEMFFRKKSINCNHPTHPANQPIQNKNKDNKKKESV<br>FEYDLIKDHRYTVDKFMFHVPITMNFKSTNEKDINLHVREYLQTSNDTHIIGIDRGERHLLYLVVIDLHGNIVEQYT<br>LNDIVNEYNGNTYRTNYHDLLDAREEDRLKQRQSWQTIENIKELKEGYLSQVIHKITQLMIKYHAIIVLEDLNIGF<br>MRGRQKVEKQEYQKFEKMLIDKLNYLVDKKADIESTGGLLNAYQLTNKFASFKKLGKQSGFLFYIPAWNTSKIDP<br>VTGFVNLLDTRYQNVDKAKAFFAKFDSIRYNKDKDWFEFALDYNNFGSKAEGTRTKWTLCTQGKRIKTSFNKM<br>SSKWNNQEIDLTKDLKQLFVQYDIDINGNLKEAISKQTKYTFVELMGLLKLTLQMRNSITGTETDYLVSPVADE<br>NGNFYDSRTCGPSLPENADANGAFNIARKGLMIIEQIKASDDLSKLKFDISNKSWLNFAQKKPYKHE |
| 152 | MAKKFEDFTKLYPLSKTLCFEARPIGATKSNIIKNGLLDEDKHRAESYVKVKKLIDEYHKAFIDRVLADGCLCYKNE<br>GNEDSLEEYYEFYSLSSKDKSDDTRKHFATIQQNLRSKIAETLTKDKAYANLFGNKLIESHKDKEDKNNIIDSDLIQF<br>VSTATPDQLDSQSKDDATKLIKEFWGFTTYFTGFFENRKNMYTSEEKSTGIAYRLINENLPKFIDNMESFKKIMEK<br>PEMSANMEELRANLEEYLNVESISEMFELNYYNMLLTQKQIDVYNAVIGGKTDEEQDIKTKGINEYVNLYNQQH<br>KDAKLPKLKTLFKQILSDRNAISWLPEEFDKDQNVLNAIKDCYVRLTANVLGNNVLNSLLSTLSEYNTESIFIRNDI<br>QLTNISQKMAGSWNYIQDAIKQDNKVNAPARKRKESEEDYEERISKNFKKADSYSIKYIDDCLNRAYKNNTYTVE<br>GYFATLGATNTPSLQRENLFAQIANAYTNISSLLSSDYSAEKNLAQDKENVAKIKTLLDCIKSLQHFVKPLLGKGDE<br>SDKDERFYGELSMLWKELDTVTPLYNMVRNYMTRKPYSQKKIKLNFENPQLLGGWDANKEKDYASILLRRDGK<br>YYLGIMDKESKKLLGKPMPSDGDYYEKMVYKFFKDITTMIPKCSTQLKAVKEHFSKSNADFVLSGKNFNTPLIISK<br>EVFELNNVKYGQFKKFQKDYVATTNDIEGYAHAVKIWIKFCMDFLGTYDSTISYDLSSLASNEYTSLDTFYQDVN<br>RLLYAVSFIKVSVSHIDSLVEEGKMYLFQIYNKDFSEYSKGTPNMHTLYWKALFDERNLADVVYKLNGQAELFYR<br>EKSIDCTHPTHPANHPILNKNKDNEKKESIFEYDLIKDRRYTVDKFMFHVPITMNFKSTGADNINQLVREHLKDA<br>DAPHIIGIDRGERHLLYLVVIDMHGNIKEQFTLNDIVNEYNGNTYRTNYHDLLDAREDARLKARQSWQTIENIKE<br>LKEGYLSQVIHKITQLMVKYHAIVVLEDLSMGFMRGRQKVEKQYYQKFEKMLIDKLNYYVDKKANAEQAGGLL<br>NAYQLTSKFDSFQKLGKQSGFLLYIPAWNTSKIDPVTGFVNLLDTRYQNVEKAKAFFCKFEAIRYNSNKNWFEFT<br>IDYNNFGQKAEGTRTKWTLCTQGKRIRTFRNPEKNSEWDNQEIDLTSALKNLFAHYIDINGNIKEAISAQSDKT<br>FFTELLHLLKLTLQMRNSITGTETDYLISPVADDNGYFDSRTCNDTLPKNADANGAYNIARKGLMIEQIKKAKD<br>IANIKFDISNKSWLNFAQQKPYKDE |

TABLE S9A-continued

Enzyme Sequences Group 9 (SEQ ID Nos: 131-170)

| SEQ ID NO | Sequence |
|---|---|
| 153 | MIKEFEDFKRLYPIQKTLRFEAKPIGSTLEHLVKSGILDEDEHRAASYVRVKKLIDEYHKAFIDRVLNDGCLPFKNKG<br>EKNSIEEYYESYTSKDKEEDSKKRFKEIQQNLRSIIVNKLTKDKAYANLFGNYLIESHKDKEDKKTMIDSDLIQFIKD<br>ADSLELGSMSKDEAIELVKEFWSFTTYFVGFYDNRKNMYSAEEKSTAIAYRLINENLPKFIDNMEAFKKIISRPEIQ<br>ANTEQLYSDFAEYLNVESIQEMFQLDYYDILLTQKQIDVYNAIIGGKTDEKHDIKTKGINEYINLYNQQHKEDKLP<br>KLKVLFKQILSDRNAISWLPEEFNSDQEMLISIKDCYEKLCVNVLGDKVLKSLLSSLDDYELEGIFLQNDQQLTNIS<br>QKIFGSWSVIQEAIIRNIKNTAPARKHKETEEDYEKRIFSIFKQAGSFSIKYIDDCLYDLDKNNINTIENYFATLGAEN<br>TPEIQRENLFALIKNAYTDVAGLLCSEYPTEKNLSQDENHVAKIKALLDAIKSLQHFVKPLLGNGDEHDKDERFYG<br>ELVSLWTELDTVTPLYNMVRNRITQKPYSQKKIKLNFENPQLLGGWDANKEKDYSCIILRREGMYYLAIMDKDS<br>RKLLGKEMPSDGECYEKMVYKLLPGANKMLPKVFFAKSRIEEFMPSEQIIEKYNNGTHKKGKDFNITDCHNLIDY<br>FKQSINKHEDWSKFGFTFSETSTYEDLSGFYREVEQQGYKLSFTNVSASYINSLVDEGKMYLFQIYNKDFSEYSKG<br>TPNMHTLYWKALFDEQNLADVVYKLNGQAEIFYRKKSIDATHPTHPANRPVQNKNKDNKKKESLFEYDLIKDR<br>RYSVDKFMFHVPITMNFKSNGSENINQQVKEYLQLANDTHIIGIDRGERHLLYLVVIDMHGNIKEQFSLNEIVNT<br>YKGNIYHTNYHDLLEAREEERLKARQSWQTIENIKELKEGYLSQVVHKITQLMVKYHAIVVLEDLNMGFMRGRQ<br>KVEKQVYQKFEKMLIDKLNYLVNKQANITEAGGLLNAYQLTSKFDSFQKLGKQSGFLFYIPAWNTSKIDPVTGFV<br>NLLDTRYQNVEKAKAFFSKFDAIRFNQDKDWFEFNLDYNKFGEKAEGTRTRWTLCTQGKRIYTFRNEDKNSQW<br>DNIEIDLTSEMKSLLELYHIDIQGNLKEAINSQTDKSFFTKLIHLLKLTLQMRNSITRTETDYLISPVADEDGEFYDSR<br>SCGPELPKNADANGAYNIARKGLMLIRQIKEAKELDKIKFDISNKAWLNFAQQKPYKND |
| 154 | MAKIFEDFKRLYPLSKTLRFDAKPVGATLDNIVKSGLLEEDEHRAASYVRVKKLIDEYHKVFIDRVLDNGCLPLENK<br>GENNSLAEYYDSYVSKSQONEDAKKAFEENQQNLRSIIAKKLTGDKAYANLFGKNLIESYKDKKDKKKIIDSDLIQFI<br>NTADSTQLDSMTQVEAKELVKEFWGFVTYFYGFFDNRKNMYTAEKKSTGIAYRLINENLPKFIDNMEAFKKVIA<br>RPEIQANMEELYSDFSEYLNVESIQEMFQLDYYDMLLTQKQIDVYNAIIGGKTDDEHDVKIKGINEYINLYNQQH<br>KDTRLPKLKALFKQILSDRNAISWLPEEFNSDQEVLNAIKDCYERLSENVLGDKVLKSLLSSLLGSLADYSLEGIFIRNDLQ<br>LTDISQKMFGNWGVIQNAIMQNIKHVAPARKHKESEEEYEKRIAGIFKKADSFSISYLNDCLNEADPNNAYFVE<br>NYFATFGAVNTPTMQRENLFALVQNKYTEVAALLHSDYPTAKHLAQDKANVAKIKALLDAIKSLQHFVKPLLGK<br>GDESDKDERFYGELASLWAELETVTPLYNMIRNYMTRKPYSQKKIKLNFENPQLLDGWDANKEKDYATIILRRN<br>GLYYLAIMGKDSKNLLGKAMPSDGECYEKMVYKQFDISKQLPKCTTELKHVRKALVEDAKRSCLLSDFNNWNK<br>PLNVTRKLWELNNFVWDKKKEDWVLRKKDNETRPKKFHKKYLELTSDKKGYNQAKNDWIKFTKEFLSSYKKVE<br>AYDIHYKKRYNSVDELYKQLNGDLYAISFTYVSASFIEQLVSEGKMYLFQIYNKDFSEYSKGTPNMHTLYWKALFD<br>ERNLADVVYKLNGQAEMFYRKKSIENTHPTHPANHPILNKNKDNKKKESLFDYDLIKDRRYTVDKFMFHVPITM<br>NFKSSGSENINQDVKAYLRHADDMHIIGIDRGERHLLYLVVIDLQGNIKEQYSLNEIVNEYNGNTYHTNYHDLLD<br>VREEERLKARQSWQTIENIKELKEGYLSQVIHKITQLMVKYHAIVVLEDLNMGFMRGRQKVEKQVYQKFEKMLI<br>DKLNYLVDKKADASVSGGLLNAYQLTSKFDSFQKMGKQSGFLFYIPAWNTSKIDPVTGFVNLLDTRYQNVEKAK<br>VFFSKFDAIRYNKDKDWFEFNLDYDKFGKKAEGTRTKWALCTRGMRIDTFRNKEKNSQWDNQEIDLTAEMKS<br>LLEHYYIDIHGNLKDAISAQTDKAFFTGLLHILKLTLQMRNSITGTETDYLVSPVADENGIFYDSRSCGDELPENAD<br>ANGAYNIARKGLMMIEQIKDAKDLNNLKFDISNKAWLNFAQQKPYKNG |
| 155 | MEFNDFKRLYPLSKTLRFEAKPIGDTLKNIIKNGLLEEDEHRAQSYVKVKKLIDEYHKVFIDRVLNDGCLTIENKGK<br>KDSLEEYYESYMSKSNDENVSKTFKDIQENLRSVIANKLTKDKGYANLFGNKLIESYKDKDDTKKIIDSDLIQFINTA<br>EPSNLDSMSQDEAKELVKEFWGFTTYFEGFHKNRKNMYTSEEKSTGIAYRLVNENLPKFIDNMEAFKKAINKPEI<br>QANMEELYSNFAEYLNVESIQEMFQLDYYNMLLTQKQIDVYNAIIGGKTDEDHDVKIKGINEYINLYNQQHKDE<br>KLPKLKALFKQILSDRNAISWLPEEFNSDQEVLNAIKDCYERLSENVLGDKVLKSLLCSLSDYNLDGIFVRNDTQLT<br>DISQKMFGNWSVIQNAIMQNIKKKKLARKRKESEEDYEKRIPDIFKKADSFSIQYINDSLNKMDDNNLHAVDEYF<br>ATLGAVNTPTMQHENLFALIQNAYTDISDLLDTPYPENKNLAQDKTNVAKVKALLDAIKSLQHFVKPLLGKGDES<br>DKDERFYGELASLWTELDTVTLLFNMVHNYMTRKPYSQKKIKLNYKNTQLLAGWDANKEKEHAAIILRRNGMY<br>YIAIMDKDSKNLLDKAMPSDGECYEKMVYKQFDISKQLPKCTTELKRVRKALIEDAKRSCLLSDSKDWNKPLNVT<br>RKLWELNNYVWDKKKADWVLRKKENETRPKKFHKKYLELTSDKKGYNQAKNDWIKFTKEFLSSYKKVKDYDIH<br>YKKRYNSVDELYKQLNSDFYTISFTYVSVSFIDKLVNEGKMYLFQIYNKDFSNYSKGTPNMHTLYWKALFDERNL<br>ADVVYKLNGEAEMFYRKKSINNTHPTHPANHPIQNKNKDNKKKESVFEYDLVKDRYTEDKFLFHVPITMNFKS<br>VGSENINQQVKEYLQQADDTHIIGIDRGERHLLYLVVIDMEGNIKEQFSLNEIVNEYNGNTYRTNYHDLLDVCAD<br>KRLKASQSWQTIENIKELKEGYLSQAIHKITQLMVKYHAVVVLEDLNKGFMRGRQKVEKQVYQKFEKMLIDKLN<br>YLVDKKADAAQSGGLLNAYQLTSKFDSFQKLGKQSGFLFYIPAWNTSKIDPVTGFVNLFDTRYTNADKALKFFSK<br>FDAIRYNEEKDWFEFEFDYDEFTQKAHGTRTKWTLCTYGMRLCSFKNPAKQYNWDSEVVALTDEFKRILGEAGI<br>DIHENLKDAICNLEGKSQKYLEPLMQFMKLLLQLRNSRKNPEEDYILSPVADENGVFYDSRSCGDKLPENADAN<br>GAYNIARKGLMLIRQIKKAKELDKVKFDISNKAWLNFAQQKPYKNE |
| 156 | MEFNDFKRLYPLSKTLRFEAKPIGSTLNNIIKSGLLEEDEHRAQSYVKVKKLIDEYHKVFIDRVLDDGCLTIENKDKK<br>DSLEEYYESYMSKSNDENVSKTFKEIQENLRSVIAKKLTDDKAYANLFGKNLIESYKDKDDKNKIIDSDLIQFINTAE<br>PSQLDSMSQDEAKELVKEFWGFTTYFVGFFDNRKNMYTSEEKSTGIAYRLVNENLPKFIDNMEAFKKAIAKPEI<br>QANMGELYSNFAEYLNVESIQEMFQLDYYNMLLTQKQIDVYNAIIGGKTDEEHDVKIKGINEYINLYNQQHKDE<br>KLPKLKALFKQILSDRNAISWLPEEFNSDKEVLNAIKDCYERLSENVLGDKVLKSLLGSLGSLDTVNLNGIFVRNDLQT<br>DISQKMFGNWSVIQNAIMQNIKNVAPARKRKESEEDYEKRISDIFKKADSFSIQYINDCLNEMDDNNLHAVDGY<br>FATLGAVNTPTMQRENLFALIQNAYTDISNLLDTPYPENKNLAQDKTNVAKVKALLDAIKSLQHFVKPLLGMGD<br>ESDKDERFYGELASLWTELDTVTPLYNMIRNYMTRKPYSEKKIKLNFENPQLLGGWDANKEKDYATIILRRNGM<br>YYLAIMNKDSKKLLGKTMPSDGECYEKMVYKFFKDVTTMIPKCSTQLKDVQAYFKVNTDDFVLNSKAFNKPLTI<br>TKEVFDLNNVLYGKFKKFQKGYLSATGDTAGYTHAVNVWINFCMDFLNSYESTCMYDFTSLKSESYLSLDAFYQ<br>DANLLLYKLSFTNVSVSFIDKLVDEGKMYLFQIYNKDFSDYSKGTPNMHTLYWKALFDERNLVDVVYKLNGQAE<br>MFYRKKSIDYTHPTHPANHPIQNKNKDNKKKESVFEYDLVKDRRYTVDKFLFHVPITMNFKSVGSENINQQVRE<br>YLQQADDTHIIGIDRGERHLLYLVVIDMQGNIKEQFSLNEIVNEYNGNTYRTNYHDLLDTREEERLTARQSWQTI<br>ENIKELKEGYLSQVIHKITQLMVKYHAVVVLEDLNKGFMRGRQKVEKQVYQKFEKMLIDKLNYLVDKKADATQS<br>GGLLNAYQLSKFDSFQKLGKQSGFLFYIPAWNTSKIDPVTGFVNLLDTRYQNTEKAKAFFSKFDAIRYNADKD<br>WFEFNLDYDKFGTKAEGTRTTWTLCTQGNRICTFRNAEKNSQWDNQEIDLTREMKSLFEHYHINICGNLKEEIC<br>SQTDKAFFTGLLHILKLTLQMRNSITGTETDYLVSPVADENGVFYDSRSCGDMLPKNADANGAYNIARKGLMLI<br>GQIKETKDLANFKYDISNKAWLNFAQQKPYKNE |

TABLE S9A-continued

Enzyme Sequences Group 9 (SEQ ID Nos: 131-170)

| SEQ ID NO | Sequence |
|---|---|

157 MDKKFEDFKRLYPLSKTLRFEAKPIGSTLDNIIKSGLLDEDEHRAVSYVKVKKLIDEYHKSFIDRVLDEGCLPFENNG
EKDSLEEYYESYKLKSNDENANKTFKEIQQNLRSVIANKLTDDKAYANLFGNKLIESYKDKEDKKKTIDSDLIQFINT
AEPSQLDSMSQDEAKELVKEFWGFTTYFVGFFDNRKNMYTSEEKSTGIAYRLVNENLPKFIDNMEAFKKVIAKS
EIQANIEELYSNFAEYLNVESIQEMFQLDYYNMLLTQKQIDVYNAIIGGKTDEKHDVKIKGINEYINLYNQQHKDE
KLPKLKALFKQILSDRNAISWLPEEFNDDQEVLNAIKDCYERLSENVLGMNKVLKSLLCSLADYNLDDIFIRNDLQLT
DISQKMFGNWSVIQDAIIQNIKNVAPARKRKESEEDYEKRISGIFKKADSFSILYINSCLNEMDDNSLHAVDGYFA
TLGAVNTPTMQRENLFALIQNAYTDISDLLNTKYPANKNLAQDKTNVAKVKALLDAIKSLQHFVKPLLGKGDES
DKDERFYGELASLWTELDTVTPLYNMIRNYMTRKPYSEKKIKLNFENPQLLGGWDANKEKDYSTIILRRNGMYY
LAIMNKDSRRLLGKAMPSDGECYEKMVYKLLPGANKMLPKVFFAKSRIDDFKPNIQIVENYNNGTHKKRKNFNI
QDCHDLIDFFKQSIKKHEDWSKFSFNFSDTSTYEDLSGFYREVEQQGYKLSFMNVSVSFIDKLVDEGKMYLFQIY
NKDFSEYSKGTPNMHTLYWKALFDERNLADVVYKLNGQAEMFYRKKSIDYTHPTHPANHPILNKNKDNKKKES
LFEYDLIKDRRYTVDKFLFHVPITMNFKSVGSENINQQVREYLQQADDTHIIGIDRGERHLLYLVVIDMQGNIKEQ
FTLNEIVNEYNGNTYRTNYHDLLDIREEEERLAARQSWQTIENIKELKEGYLSQVIHKITQLMVKYHAIVVLEDLNM
GFMRGRQKVEKQVYQKFEKMLIDKLNYLVDKKADATQPGGILNKLYKDSFQKLGKQSGFLFYIPAWNTS
KIDSVTGFVNLLDTRYQNTEKAKVFFSKFDAIRYNEEKDWFEFYLDYDKFGSKAEGTRTKWTLCTQGKRIRTFRN
PDKNSQWDNQEVDLTREMKSLFEHYHINICGNLKEEICSQTDKAFFTGLLHVLKLTLQMRNSITGTETEDYLVSPV
ADEEGNFYDSRYCNITLPKNADANGAYNIARKGLMLVKQIKAATDLANFKYDISNKAWLNFAQQKPYKNE

158 MKKSSLQDFTNQYSLSKTLRFELIPQGETLEHIEKNGLLSQDEHRAESYIIVKKIIDEYHKAFITKALDGVKLNSLEDY
FLYYQLPKRDEEQKKKFEEIQTKLRKQIADRFAKQESFKNLFAKELIKDDLINFVKSNDDKLLVAEFQNFTTYFTGF
HENRKNMYSAEDKSTAIAFRLIHQNLPKFIDNMRAFDKIKISKVKDSFKTILADDELGAIIQVIAVEDVFTLNYFND
TLTQLGIDKYNQLIGGFTSEDGKIKIKGLNEYINLYNQTAKKEERLPKLKPLYKQILSDRSTASFIPEAFSNDNEVLES
IEKLYQEINDLVLNKRVKGEHSLKELLQSLNEYDVSKVYLRNDLSLTDISQKMFGDWGVFQKGMQTWYAVNYK
GKNKAGTEKYEDEQKKYFSNQDSYSIGFINECLLLLDTVYQKRIEDYFKLLGERNTEEEKSENLFVLIEKNYNGIKDL
LNNPYPHDKNLAQDQANVDKIKNFLDVVKTLQWFIKPLLGKGNEAEKDERFYGEFTSLWTTLDQVTPLYNKVR
NYMTQKPYSTEKIKLNFENSTLLDGWDVNKEVDNTAMIFRKNGLYTLQIMNKKHNKIFKTDIANTGECYEKM
EYKLLPGANKMLPKVFFSNSRIDEFKPGTELLENYKNETHKKGDNFNLNDCHHLIDFFKTSINKHEDWKHFGFQF
SDTKTYNDLSGFYREVEQQGYKITYKAISENYIAQMIAEGKLYLFQIYNKDFSPYSKGMPNMHTLYWKMLFDAV
NLKNVVYKLNGQAEVFYRKLSIKAENIITHKANVPIHNKNEEENEKKQQSRFDYDIIKDKRYTMDKFQFHVPITMN
FKAKGLNNINIEVNQYLKKESDIHIIGIDRGERHLLYLTLIDGKGNIKQQFSLNEIINEYQGKTYKTNYHDLLDKKEG
DRDDARRNWKTIETIKELKEGYLSQVIHKISELMVEHNAIVVLEDLNMGFMRGRQKVEKQVYQKFEKMLIDKLN
YLVDKKKNPTDLGGTLNAYQLTNKFESFQKMGKQSGFLFYVPAWNTSKMDPVTGFVNLLDTRYENIEKAKTFF
SKFDSIHYNPLKKYVEFECDYNRFTTKAEGTQTKWTLCTYKERIETFRDPTQNSQWKSREIVLTDEFISLFEQYGIA
YKNKEELKDAIARQTEKVFFERLLHLLKLTLQMRNSITGTETDYLISPVANAKGEFYDSRTASETLPKNADANGAY
NIARKGLWVVEQIKQADDLKKLKLAISNKEWLGFVQNYGK

159 MGWRNGFQKILILINNKKMGNTNLFKGFTNFYPVSKTLRFELKPIGKTLEHIEKNGLLLQDEHRAESYVTVKKIID
EYHKAFIAKALDGLVLNVLEDYHLYYQLPKRDEAQNKKFEELQTEMRKQIADRFTKQDGFKNLFAKELIKEDLKA
FVQTLEDRQLVEEFGNFTTYFTGFHENRKNMYSAEDKSTAIAYRLIHQNLPKFYDNMKAFDKIRNSAVKEKFALII
SDDELGPIIQVKDIEEVFCLDYFNETLTQKGIDKYNQLIGGYMPEDGKEKKKGLNEYINLFNQTAKKEERIPKLKPL
YKQILSDRSTASFIPEEFECDNEVLESIEKLYQEINKHALPQLKGLMNNLHDFDLHKIYLRNDLSLTDISQKMLGD
WGAFQKAMNKWFDLNYKGKAKPGTEKYEEEQKKYFRNHESYSIGFINDCLAKSDIAEHHKKIEDYFKRAGEQIN
ETENLFTLVEKGYSTVNDLLNNPYPKEKNLSQDQQNVDKIKAFLDGIKALQWFIKPLLGKGNEAEKDERFYGEFA
MLWTTLDQITPLYNKVRNYMTQKPYSTEKIKLNFENSYFLNGWAQDYESKAGLIFIKDGNYYLGINNKKLTIEEKE
LLKGTDAKRIILDFQKPDNKNIPRLFIRSKGDNFAPAVEKYNLPIVDSGKFKTDYRKTNEEDYTKSLHKLIDY
FKEGFSKHESYKHYPFSWKSTTEYKDIAEFYNDVEVSCYQVFEEGVNWGKIMDFVDQGKLYLFQIYNKDFSPYSK
GTPNMHTLYWKMLFDAENLKDVVYKLNGQAEVFFRKSSIKAENKVVHKAEGSIPNKNELNAKKQSTFDYDIIKD
RRYTTDKFQFHVPITMNFKARGLNNINTEVNQLIKKENEIHIIGIDRGERHLLYLTLIDSKGSIKQQFSLNEIINQYN
GQNYKTNYHNLLDKKEGGRDEARRNWKTIETIKELKEGYLSQVIHKIAELMVEYNAIVVLEDLNMGFMRGRQK
VEKQVYQKFEKMLIDKLNLVDKKKKAGEFGGTLKAYQLTNKFESFQKMGKQSGLLYYVPAWNTSKMDPVTG
FVNLLDTRYENMEKAKQFFGKFEAISYKQTKGYFEFEFDYMKYTNKAEGTKTRWTLCTNNERIETYRNPEKNSQ
WDSREVGLTKEFVSLFEQFGINFKDNAGLKEAICRQTEKAFYERLLHLLKLTLQMRNSITGTEIDYLISPVANDKGE
FYDSRTAAEILPQNADANGAYNIARKGLWVIDQIKQADDLKKLKLAISNKEWLGFVQKDV

160 MKNLTEFTGLYPVSKTLRFELKPQGRTLEYIEKNGLLEQDEHRASSYILVKKIIDDYHKAFIANALRDFKLYSLEDYYL
YYNIQKRDDEQKKKFEDIQSKLRKQIADRFTKEESFKNLFAKELIKENLIEFVQTVEDRELIKEFESFTTYFTGFHENR
KNMYSAEEKSTAIAYRLIHQNLPKFIDNMRVFEKIANSPVKDKFQTILSDNQLGPVIQVMAVEDMFRLDYFNETL
TQIGIDKYNSLCGGFSPNEGKEKIQGLNEYINLYNQTAKKEERIPKLKPLFKQILSDRSTASFIPDEFENDSEVLESIE
LFYQEVNEQVINKNVEGEHSLKELLKSLPEYELTKIYLRNDLSITDISQKIFGDWGVFQKAMNTWFELNYNGKAK
FGTEKYEEEQRKYFANLDSFSIGFINECLLQLDTPYHKNIADYFALRGKTDTETQDLFAVLEDKYNAVTDLLNNPY
PQDQDLAQDQKQVDKLKELLDAVKAIQWFIKPLLGKGNEADKDERFYGEFTSLWITLDQITPLYNKVRNYMTR
KPYSTDKIKLNFENSYFLNGWAQDYESKAGLIFTKDGNYYLGINDKKLSNEDKTLLKSNSELNLAKRIVLDFQKPD
NKNIPRLFIRSKGNNFAPAVEKYNLPIHEVIEIYDNGKFKTEYRKINETDYLKSLHLLIDYFKIGFSKHESYKHYPFSW
KNTTEYKDIAEFYHDVEVSCYQVFEENVNWDTLMNFVDEGKLYLFQLYNKDFSPNSKGTPNLHTLYWKMLFDA
DNLKDVVYKLNGQAEVFFRKSSIKENIVLKANEAVNNKNEQNTKKSQRFEYDIIKDKRYTVDKFQFHVPITM
NFKARGLNNINTEVNQWLQKSDNVHIIGIDRGERHLLYLTLIDSKGNIKQQFSLNEIVNEYEGKTYKTDYHKLLDN
REGNRDEARKNWKTIETIKELKEGYLSQVIHKISELMVEYNAIVVLEDLNMGFMRGRQKVEKQVYQKFEKMLID
KLNYLVDKKQNPAEMGGTLHAYQFTNKFESFQKMGKQSGMLFYVPAWNTSKMDPVTGFVNLFDTRYENME
KARSFIGKFDTIRYNPKKEYFEFDFDYNKFTAKAEGTRTRWTLCTNDTRIETFRNPAKNSQWDNREIILSDEFINLF
KLYNIDYQNSDLKVQICKQTEKAFFERLLHLLKLTLQMRNSMTGTEVDYLISPVTNSRGEFYDSRTASDILPKNAD
ANGAYNIARKGMWVIEQIRKATDFRKLKLAISNKEWLSFVQH

TABLE S9A-continued

Enzyme Sequences Group 9 (SEQ ID Nos: 131-170)

| SEQ ID NO | Sequence |
|---|---|
| 161 | MKRFTNLYQLSKTLRFELKPIGKTLENIEKHGLLEQDTHRAESYVKVKDIIDEYHKAFIEEYLNTFADSSETYAEQNK<br>NFVKLLQELYTNYMCKTKDETQQKLLTESQAKLRKIIAKSFNNDKYKRLFGKELIKEELIDFLKDDVEDITLVQEFKD<br>FTTYFTGFHENRKNMYSDEDKSTAIAYRLIHENLPRFIDNILVFEKIAQSDVAQKFTELYKNFQSYLNVKEISEMFK<br>LGYYNMVLTQTQIDVYNAIIGGKTIEDNDIKIKGLNEYINLYNQQQEDKHNRLPKLKPLYKQILSDRNAISWLPEQ<br>FDANEKGGKVLEAIQKAYNELEQQILNNSNEAEHSLPELLKLLSNYDLNKIYIPNDAQLTDISQKVYGHWNIISKA<br>LIEDLKLTTPRKSRKETDEKYEERLNKILKSQSSFSIRKITDSVHNTYPEIKSSIITYFENIGNIDNEEENIISKITNSYNIA<br>KDLLNTPYLGNNLSQDTVNVEKIKNLLDAIKDLQHFIKPLLGKGDESEKDEKFYGEFTLLWDELNNITPLYNMVR<br>NYMTRKPYSTEKIKLNFENSTLLDGWDLNKETDNTSVILRKDGMYYLAIMNKKHNRVFNIDSIPTEGDCFEKME<br>YKLLPGANKMLPKVFFSKSRIDEFAPSKQLIEKYQSGTHKKGDNFSLIDCHNLINFFKDSINKHEDWKKFNFNFSD<br>TNTYEDLSNFYREVEKQGYKISFRNVSSEYINSLVEDGKIYLFQIYNKDFSSYSKGTPNMHTLYWKMLFDETNMS<br>DVCYKLNGQAEIFFRKSSIKAEHPTHPANQPIENKNTLSNKKQSVFTYDLIKDKRYTIDKFHFHVPITMNFKGIGIN<br>NINNIVNQFIQEQEDLHIGIDRGERHLLYLTVIDLQGNIKEQYSLNEIINNYNGNTYKTNYHDLLEKREKERMDAR<br>QSWKSIESIKELKEGYLSQVIHKITKLMIKYNAIVVLEDLNIGFMRGRQKVEASVYQKFEKMLIDKLNYLVDKKKQ<br>PEELGGTLNALQLTNKFESFQKLGKQSGFLFYTQAWNTSKIDPVTGFVNLFDTRYETREKAKEFFKKFDSICYNSE<br>KDWFEFSFDYNNFTTKAEGTRTNWTLCTYGKRIETFRDEKQNSQWASNEINLTDKFKEFFAKYNIDINANLKESI<br>TAQESADFFKGILALLKLTLQMRNSMTGTDVDYLQSPVADNNGVFFNSQECDNSLPQNADANGAYNIARKGL<br>WIVNKIKISNDLSNLNFAISNKEWLQFAQEKPYLLND |
| 162 | MASLKKFTRLYPLSKTLRFELIPLGLTADHIGKSGILSQDEHRAESYKKVKKIIDEYHKAFIEKVLNNIHLQYDNIEQN<br>NSLEEYFLYYMIKNDEKKEKIFEEIQKKLRKQIADRFIDDPSFKNIDKKELIRSDLKDFVCSQEDLQLVDEFKDFTTY<br>FTGFHENRKNMYSSEAQSTAIAFRLIHENLPKFIDNIQVFNKVAASSVSEFFTELYANFEECLTVTEIAEMFKLEYF<br>NSVLTQKQIDVYNFILGGKSIEGGSKIKGLNEYINLYNQQQKDKSKRLPKFKPLFKEILSDRNSISWLPEKFKSDEEV<br>LETIEKAYQELNEHVLNRNVGGEHSLKELLVRLEDFNLDKIYVRNDQQLTDISQKIFGHWGTISKALLEELKNEVP<br>KKSNKETDEAYEERLNKILKSQGSVSIALINNSIQKLNIEEKKTVNSYFSLNSNICPKDNLYTRIENAYLEVKDLLNTP<br>YTGKNLAQDKLNVEKIKNLLDAIKSLQHFVKPLLGDGKEPEKDEKFYGEFLSLWEELDKITPLYNMVRNYMTQKP<br>YSTEKIKINFENSTLMDGWDVNKERDNTSVILRKDGLYYLAIMDKKHKKVFDAHNTPSNGICYEKMEYKLLPGA<br>NKMLPKVFFSKSRIHEFAPSKKLIENYKNETHKKGTTFNLDDCHKLIDFFKTSIKKHEDWNRFEFKFSDTTTYEDLS<br>GFYKEVEQQGYKISFRNVSADYIDNLVKEGKIYLFQIYNKDFSPYSKGTPNLHTLYWKMIFDERNLANVVYKLNG<br>QAEVFFRKSSISYDKPTHPANQEIDNKNILNKKKQSIFSYDLIKDKRYTVDKFQFHVPITMNFKSTGQDNINLSVN<br>EYIRQSDDLHIIGIDRGERHLLYLTVIDLEGRIKEQYSLNEIVNIYNGNEYHTNYHDLLSKREDEREKARQSWQTIE<br>NIKDLKEGYLSQVIHKISELMIKYNAIVVLEDLNIGFMRGRQKVEASVYQKFEKMLIDKLNYLANKKIDPEEEGGIL<br>NAYQLTNKFTSFQKIGKQSGFLFYTQAWNTSKIDPSTGFVNLFDTRYETREKSKMFFSKFDSIKYNKDKDWFEFIF<br>DYTNFTTKAEGTRTQWTICSYGKRIETLRDENKNSNWVSTEIDLTQSFKNFFTKYGIDINDNLKEFIVQQDTSEFF<br>KGILYLFKLTLQMRNSAIGKDIDYIISPIADEKGIFYNSNECDSSLPKNADANGAYNIARKGLYIVRKIKHSDELKNL<br>NLAITNKEWLQFAQSKPYINK |
| 163 | MKKLNAFSRIYPLSKTLRFELRPIGKTLEHIEKSGILSQDQHRAESYVEVKKIIDEYHKAFIENVLKDFRFSENRGEKN<br>SLEEFLVYYMCKSKDETQKRQFADIQDKLRKQIAKRFSDDDRFKRIDKKELIKEDLLSFVEDVEKRQLIEEFKDFTTY<br>FTGFHENRKNMYTDEAQSTAIAYRLIHENLPKFIDNIMVFDKVAASPIAKYFAELYSDFEEYLNVSELGEMFRLDY<br>YNIVLTQTQIDVYNAVVGGRTLDDGTKIQGLNEYINLYNQQQKDKSARLPKLKPLYKQILSDRNAISWLPEQFQS<br>DEKVLEAILKAYQELDEQVLNRKKEGEHSLKELLLSLSNYDLTKIYIRNDTQMTDISQKAFGHWDVIPKALLEQLKK<br>EVQKKSKESEEAYEERLNKIIKSQGSIPIALINQGVQKQNSEEQNTLQTYFASLGAVETESVKKENLFTQIENAYAE<br>VKDLLNTPYSGKNLAQDNVAVEKIKTLLDAIKALQHFVKPLLGDGTESEKDEKFYGEFSMLWEELDKITPLYNMV<br>RNYMTRKPYSTEKIKLNFENSTLMNGWDLNKEQDNTTVILRKDGIYYLAIMDKKHKKVFDKNILGSGECFEKM<br>EYKFFKDLTTMVPKCTTQLKVVKEHFLTHSEPYTISKDVFYSKFEITKEEYELNNVLYNGKKKFQKDYLRQTGDEK<br>GYKDALTKWIRFCLRFLAQYKSTMIYDISSFQVDCKINSYTSIDEFYSEINLYLYNITFRNVSVDYINSLVEEGKIYLF<br>QIYNKDFSPYSKGTPNLHTLYWKMLFDEKNLADVVYKLNGQAEVFYRKSSIICERPTHPANQAINNKNVLNKKK<br>HSTFVYDLVKDKRYTVDKFQFHVPITMNFKSTGGDNINLLVNEYIQQSDDLHIIGIDRGERHLLYLTVIDLQGRIKE<br>QYSLNEIVNTYNGNEYRTNYHDLLSKREDERMKARQSWQTIENIKELKEGYLSQVIHKISELIVKYNAIVVLEDLN<br>MGFMRGRQKVESSVYQKFEKMLIDKLNYLVDKKKNPEEDGGVLNAYQLTNKFESFQKVGKQSGFLFYTQAWN<br>TSKIDPVTGFVNLFDTRYETREKAKDFFGKFDAIRYNTAKDWFEFAFDYSNFTSKAEGSRTNWTLCTYGERIEKFR<br>DEKQNSWASRGINLTDKFKELFAEYKIDIQTDLKEVISRQDSADFFKRLLYLLKLTLQMRNSETGTEVDYMQSP<br>VADANGNFYNSETCDDSLPKNADANGAYNIARKGLWIVQQIKATDDLKNVKLSISNKEWLKFAQEKPYLNE |
| 164 | MKKLNAFSRIYPLSKTLRFELRPIGKTLEHIEKSGILSQDQHRAESYVEVKKIIDEYHKAFIENVLKDFRFSENRGEKN<br>SLEEFLVYYMCKSKDEMQKRQFADIQDKLRKQITQRFSDDDRFKRIDKKELIKEDLLSFVEDVEKRQLIEEFKDFTT<br>YFTGFHENRKNMYTDEAQSTAIAYRLIHENLPKFIDNIMVFDKVAASPIAEHFAKLYSDFEEYLNVSELGEMFRLD<br>YYNIVLTQTQIDVYNAIVGGKTLEDGKKIQGLNEYINLYNQQQKDKSARLPKLKPLYKQILSDRNAISWLPEQFQS<br>DEKVLEAIQKAYQDLEEQVFNRKKEGEHSLKDLLLSLSDYDLSKIYIRNDTQMTDISQKAFGHWDVIHKALLEQLK<br>EDVQKKPKKESDEAYEERLNKIIKSQGSIPIALINQGVQKQNSEEQNTLQTYFASLGAVETESVKKENLFTQIENAY<br>AEVKDLLNTPYSGKNLAQDNVAIEKIKTLLDTIKALQHFVKPLLGDGTESEKDEKFYGEFSMLWEELDKITPLYNM<br>VRNYMTRKPYSTEKIKLNFENSTLMNGWDLNKEQDNTTVILRKDGMYYLAIMNKKHNRVFDVKNISKNGECFE<br>KMEYKLLPGANKMLPKVFFSKSRIDEFAPSEQLLENYNKGTHKKGNLFNLSDCHALIDFFKASINKHKDWSKFGF<br>KFSDTNTYEDLSGFYREVEQQGYNISFRNVSVDYINSLVEEGKIYLFQIYNKDFSPYSKGTPNLHTLYWKMLFDEK<br>NLADVVYKLNGQAEVFFRKSSIICDKPTHPANQPIDNKNALNNKQQSVFEYDLVKDKRYTVDKFQFHVPITMNF<br>KSTGGDNINLLVNEYIRQSDDLHIIGIDRGERHLLYLTVIDLGRIKDKEQYSLNKIVNTYNGDEYPTNYHDLLSKR<br>EDERMKARQSWQTIENIKELKEGYLSQVIHKISELIVKNAIVVLEDLNMGFMRGRQKVESSVYQKFEKMLIDKL<br>NYLVDKKKNPEEDGGVLNAYQLTNKFDSFQKLGKQSGFLFYTQAWNTSKIDPVTGFVNLFDTRYETREKAKDFF<br>GKFDAIRYNTAKDWFEFAFDYSNFTSKAEGSRTNWTLCTYGERIEKFRDEKQNSWASQGINLTDKFKELFAKY<br>KIDIQADLKEAISQQDSADFFKGLLYLLKLTLQMRNSEIGTEIDYMQSPVADANGNFYNSDTCDDSLPKNADAN<br>GAYNIARKGLWIVQQIKAADDLKNVKLSISNKEWLKFAQEKPYLNE |

TABLE S9A-continued

Enzyme Sequences Group 9 (SEQ ID Nos: 131-170)

| SEQ ID NO | Sequence |
|---|---|
| 165 | MFIMTSLKRFTRVYPLSKTLRFELKPVGKTLDHIVSSGLLEQDQHRAGSYVEVKKIIDEYHKAFIESSLDDFELQYYN EGKNNSLEEFYSYYMCRSKDETQKKLFEENQDKLRKQIADRLSKDERFKRIDKKELIEKDLIDFVKKPEERQLLEEF KGFTTYFTGFHENRKNMYSAEAQSTAIAYRLIHENLPKFIDNIMVFDKVAASPVADSFAELYANFEEYLNVTEIAE MFNLAYYNVVLTQSQIDVYNAIIGGKTFENGVKIKGLNEYINLYSQQQKDKSARLPKLKPLYKQILSDRNAISWLP EYFSEDEKLLEAIQKSYQELDEQVFNRKREGEHSLKELLLGLEGFDLSKIYIRNDLQLTDISQKVYGSWSVIQKALLE ELKGEVQKKSKKETDEAYEDRLNKILKSQGSISIALINDCVHKLNSEEQNTIQGYFATLGAVDNQILQKENLFVQIE NAYTEIKDLLNTPYQGRNLAQDKVNVEKIKNLLDSIKSLQHFVKPLLGDGSEAEKDEKFYGEFVALWDELDKITPL YNMVRNYMTRKPYSTEKIKLNFENSTLMDGWDLNKEQANTTVILRKDGLYYLAIMNKKNNKVFDVKNISSKGE CYEKMEYKLLPGANKMLPKVFFSKSRIHEFAPSEQLLENYNNETHKKGATFNLSDCHALIDFFKASINKHEDWSK FGFNFSDTSSYEDLSGFYREVEQQGYKISFRNVSVDYVDSLVEEGKIYLFQIYNKDFSLYSKGTPNLHTLYWKMLF DEKNLADVVYKLNGQAEVFFRKSSINYERPTHPANQPIDNKNPQNEKKQSVFNYDLIKDKRYTVDKFQFHVPIT MNFKSTGSENINQSVNEHIQKSDDLHIIGIDRGERHLLYITVIDLKGRIKEQFSLNEIVNHYNGKNHCTDYHALLSK REEEERMKARQSWQTIESIKELKEGYLSQVVHKISELMVKYNAIVVLEDLNMGFMRGRQKVEASVYQKFEKMLI DKLNYLADKKGKPEEEGGILNAYQLTNKFVSFQKMGKQSGFLFYVPAWNTSKIDPVTGFVNLFDTRYETREKAK AFFAKFESIRYNEDKDWFEFAFDYSKFTSKADGSCTKWTVCTYGKRIETFRDEKQNSNWVSKEVCLTEKFKDFFA KYGIELRSNLKEYIISQDSADFFKGLLSLLKLTLQMRNSETGTDVDYLQSPVADANGEFYNSENCDESLPENADAN GAYNIARKGLWVVKQIKGADDLKNLKLAISNKEWLQFVQAKPYLND |
| 166 | MKTFQQFSRVYPLSKTLRFELKPIGSTLEHINKNGLLDQDQHRAKSYIQMKNIIDEYHKEFIEDVLDDLELQYDNE GRNNSISEFYTCYMIKSKDDNQRKLYEKIQEELRKQIANAFNKSDIYKRIFSEKLIKEDLKNFITNQKDNDKREQDI QIIEEFKNFTTYFTGFHENRKNMYTSEAQSTAIAYRLIHENLPKFIDNIMVFDKVAASPIADSFSELYTNFEECLNV MSIEEMFKLNYFNVVLTQKQIDVYNAIIGGKTIDNTNIKIKGLNEYINLYNQQQKDKSARLPKLKPLYKQILSDRN AISWLPEQFESDDKLLEAIQKAYQELDEQVLNRKIEGEHSLRELLVGLADYDLSKIYIRNDLQLTDISQKVFGHWG VISKALLEELKNEVPKKSKKESDEAYEDRLNKVIKSQGSISISIAFINDCINKQLPEKQKTIQGYFAELGAVNNETIQKE NLFAQIENAYTEVKDLLNTPYTGKNLAQDKVNVEKIKNLLDAIKALQHFIKPLLGDGTEPEKDEKFYGEFAALWEE LDKITPLYNMVRNYMTRKPYSTEKIKLNFENSTLMDGWDLNKEQANTTVILRKDGLYYLAIMNKKHHNRVFDVK AMPDDGDCYEKMEYKLLPGANKMLPKVFFSKSRIQEFAPSSQLLENYHNDTHKKGVTFNIKDCHALIDFFKASI NKHEDWCKFGFRFSPTETYEDLSGFYREVEQQGYKISFRNVSVDYIHSLVEEGKIFLFQIYNKDFSPYSKGTPNLH TLYWKMLFDEKNLADVVYKLNGQAEVFFRKSSINYEQPTHPANKAIDNKNELNKKKQSLFTYDLIKDKRYTIDKF QFHVPITMNFKSTGNDNINQSVNEYIQQSDDLHIIGIDRGERHLLYLTVINLKGEIKEQYSLNEIVNTYKGNEYRT DYHDLLSKREDERMKARQSWQTIENIKELKEGYLSQVVHKIALNEDLNAGFMRGRQKVESSVYQ KFEKMLIDKLNYLADKKKQPEEPGGILNAYQLTNKFVSFQKMGKQCGFLFYTQAWNTSKIDPVTGFVNLFDTRY ETREKAKTFFGKFDSIRYNDEKDWFEFAFDYTNFTSKADGSRTNWKLCTYGKRIETFRDEKQNSNWTSKEVVLT DKFKEFFKESNIDIHSNLKEAIMQQDSADFFKKLLYLLKLTLQMRNSETGTNVDYMQSPVADEEGNFYNSDTCD SSLPKNADANGAYNIARKGLWIVQQIKTSDDLRNLKLAITNKEWLQFAQRKPYLDE |
| 167 | MGTLKQFTRVYPLSKTLRFELKPIGRTLEFINSSGLLEQDQHRADSYIKVKGIIDEYHKAFIETVLNDFKLNYTDEGK KNSLEEFYTCYMCKAKDEAQKKLFEEIQGKLRKQIADCFSKDDKFKRIDKKELIKEDLVNFVTNQEDRLLIDEFRDF TTYFTGFHENRKNMYSAEAQSTAIAYRLIHENLPKFIDNMLVFDKVAASPVSEHFVGLYSNFEEYLNVMNIAEM FRLDYFNIVLTQKQIDIYNYIIGGRTLDDGTKIKGLNEYINLYNQQQKDKSVRLPKLKPLYKQILSDRNAISWLPEQF ESDEKALEAIQKAYQELDEQVFNRNKEGEHSLKELLQTLAEYDLDKIYIRNDLQMTDISQKVFGHWGIISKALLEQ LKKELPKKSKKETDEAYEERLNKVLKSQGSISIAQINNSVWVMGMEEQNSIQAYFARLGAVNTETVQQENIFSHI ENAYTEVKDLLNTPYPLNKNLAQDKVNVEKIKNLLDAIKSLQHVKPLLGDGTESEKDEKFYGEFVALWEDLDKIT PLYNMVRNYMTRKPYSTEKIKLNFENSTLMDGWDLNKEQANTTVILRKDGLYYLAIMNKKHHNRVFDVKNMPE SGDCYEKMEYKLLPGANKMLPKVFFSKSRINEFAPSEQLMANYRNETHKKGASFNIHDCHALIDFFKSSINKHED WSRFGFHFSDTNTYEDLSGFYREVEQQGYKISFRNVSVDYIHSLVEEGKIYLFQIYNKDFSPYSKGTPNLHTLYWN MMFDERNLADVVYKLNGQAEVFFRKSSITCERPTHPANQAIENKNALNEKKQSVFTYDLIKDRRYTVDKFQFHV PITMNFKSTGNDNINQSVNEYIQKCDDLHIIGIDRGERHLLYLTVIDMKGQIKEQYSLNEIVNTYKGNEYRTNYHE LLSKREDERMKARQSWQTIENIKELKEGYLSQVIHKISELMVKYNAIVVLEDLNMGFMRGRQKVEASVYQKFEK MLIDKLNYLADKKKNPEEEGGILNAYQLTNKFTSFQKMGKQSGFLFYTQAWNTSKIDPVTGFVNLFDTRYETRE KAKVFFCKFDSIRYNRDKDWFEFAFDYNKFTTKAEGTHTQWILCTYGKRMETFRDEKQNSQWTSQECGLTDKF KEFFAKYGIDIHTNLKEAIAQQDSADFFKGLLYLLKLTLQMRNSKTGTDIDYMQSPVADANGNFYNSELCDNSLP KNADANGAYNIARKGLWIVRQIKASDDLRNLKLTISNKEWLQFAQNKPYLND |
| 168 | MSTYSDFTGLYTLSKTLRFELKPIGKTKDNIERNGILDRDSQRAIGYKAIKKVIDEYHKAFIELMLDSFELKLKDEGR MDSLMEFYYLYHLPTIDSKRKDDLKKVQEALRKQISECFTKSEQYKRLFGKELIREDLADFIKTPKYEGVIRSQHDN EDLTEEEIRKIQEEVEKTIDQFYDFTTYFVGFYDNRKNMYVADDKATSIAHRMITKNLPKFIDNMDVFAKISSSEV ATHFETLYKEMEAYLNVNSIEEMFQLDYFSMVLTQKQIDVYNSIIGGMVLENGTKIQGLNEYVNLYNQQQKDK GNRLPKLKPLFKQILSERNAISWLPEEFESDNDMLDGIERCYQDLKKQVFNGENSMQVLLKSIGDYDLEHIYLPN DLQLTDIAQKYYGSWSVIKAMEEDVKANNPQKRNDTGEKYERITKLLKSKESISIEEINRLMKWLLGDDYKPM ENYFSMMGAEDDENGQKPDLFIRIENAYTEAKALLTSVYPEDRKLSQDKKNVERIKNLLDAIKDLQRFVKPLLGG GTESEKDPRFYGEFVPMWEALDQITPLYNMVRNRMTQKPYSEEKIKLNFDTPTLLKGWPDAQASSGAILKDNK GLYYLAILDSMHRTCLNELKSCPTEKSEMAIMKYLQGGDMEKNVQNLMRINGVTRKVNGRKEKEGAMVGQNI RLENAKNTYLPTEINDIRLKGSYLTSSQSFNKQDLALYIEYYMPLVREYYSDYQFSFRNPSEYKSFAEFTDHINQQA YQVQFGSISDKQLFQMVEEGKIYLFQIYNKDFSPYSKGTPNMHTLYWKMLFDERNLADVVYKLNGEAEVFFRK HSIEVGRPTHPANKPIENKNKLNEKKISVFAYDLLKDRRYTVDKFQFHVPITMNFKAAGLNNINPLVNAYLKESKA THIIGIDRGERHLLYLSLIDLQGNIVEQYSLNEIVNEYNGNTYRTNYHDLLDAKEKQRDEARKSWQTIENIKELKEG YMSHVIHKIAELMVKYNAVVVLEDLNMGFMRGRQKVEKQVYQKFEKMLIDKLNKKLEATEMGGVLNAY QLTNKFESFQKPGKQSGFLFYIPAWNTSKMDPTTGFVNLLDTRYENMAKAKAFFGKFKSIRYNATKDWFEFAF DYNNFHNRAEGTRTQWALCTYGTRIETKRDPKQNNSFVSEEFDLTSKFKKLLAHYAIDLNGNLLEQICSQNDTQ FYKDLLHLLHLTLQMRNSITGTDVDYLVSPVMNVYGEFYDSRTCGNNLPKNADANGAYNIARKGLWIIEQIKQT EDLSKLKLAISNKEWMRYAQGLR |

TABLE S9A-continued

Enzyme Sequences Group 9 (SEQ ID Nos: 131-170)

| SEQ ID NO | Sequence |
|---|---|
| 169 | MKTLKNLTGLYSLSKTLRFELKPIGKTKENIEKNGILERDNERAIAYKAVKKVIDEYHKAFIELMLDDFELNKDTLNE FYYLYHLPTSEAKRKTDLPKVQEVLRKQISERFTKSEQFKRLFGKELIREDLVEFVKTPQYENIIRKMPGNEQLTDKE VKQIQERVQKDIAQFDDFTTYFSGFYDNRKNMYVPEDIATSIAHRMIGENLPKFIDNMDVFARIAASDVATHFD ELNKAMELYLNVNEIPEMFQLDYFHMVLTQKQIDVYNAIIGGKVLDDGTKVQGLNEYVNLYNQQQKDKSKRLP KLKPLFKQILSERNAISWLPDEFDSDNEMLQSIGKCYHDLKEQVFGSLKTLLGSIKDYDLEHIYLPNDLQLTDIAQK HFGDWSVIKNAVIENLQSVNPKKKRENGENYDERILKLQKANDSYSIGFINALLRSKTDDFNPLENYFAGMGAE DNENGQKLNHFARIENAYTEVKTLLNADYPEGKSLSQDKANVEKIKNLLDSIKDLQHYVKPLLGSGMESDKDNR FYGEFTPLWEALDQITPLYNMVRNRMTQKPYSDEKIKLNFDNSTLLAGWDLNKEADNTCTLLRKDGNYYLAIIN KRSNKVLKPENLISDGDCYEKMEYKLLPGANKMLPKVFFSKSRIDEFKPSESVLKNYQKETHKKGDNFNLDDCHA LIDFFKESINKHEDWSKFGFHFSDTNSYEDLSGFYREVEQQGYKISFRNVSVNYINQLVDEGKIYLFQIYNKDFSPY SKGTPNMHTLYWRMLPFDERNLADVVYKLNGEAEVFFRKHSIRVDKPTHPANKPIANKNAQNEKKESIFTYDLV KDRRYTVDKFQFHVPITMNFKAAGLNNINPLVNAYLKESNSTHIIGIDRGERHLLYLSLIDMKGNIVEQYTLNEIV NEYKGNTYRTNYHDLLDAKEKQRDEARRSWQTIENIKELKEGYMSQVIHKIAELMVKHNAIVVLEDLNMGFMR GRQKVEKQVYQKFEKMLIDKLNYLVDKKLDAEEMGGVLNAYQLTNKFEGFQKLGKQSGFLFYIPAWNTSKMD PTTGFVNLFDTRYENMEKSKVFFGKFDSIRYNSAKGWFEFAFDYGNFTAKAEGTRTNWTLCTYGTRIETKRNPE KNNEFDSVEIDLTEQFKALFAKHQIDLSGNLKEQICNQSDASFHKELLHLLHLTLQMRNSVTNSEVDFLLSPVMN ASGEFYDSRTCGKNLPENADANGAYNIARKGLWIIEQIKNTNDNDLAKIKLAISNKEWLRYAQGLD |
| 170 | LKNKYYVCIFIKKTINSIINLKETNKMKKFSDFTNVYPVSKTLRFELKPIGKTQENLGKIIDEDNQRAKDYKVVKKVI DEYHKAVIEQLLNGFELDKDTLEKFKDLYHLSISEPKRKDLPKVQEVLREQISKRFIKSEQYKRLFGKELIQEDLPEFV YSSSKYGDVIRKQHEKEHLSDDDINRERKRICDEIAQFDDFTSYFGGFHENRKNMYVADDKATSIAHRLINENLPK FVDNMDVFAKIAASDVAQHFDKLYKEMEPYLNVGAISEMFEIGYFSTVLTQKQIDVYNAIIGGKVEEDGRKIQGL NEYINLYNQQQKDKANRLPKLKPLFKQILSDRNAISWLPEEFESDNDMLQRIEECYQNLKEQVFDSLKTLLANIKE YDIAHIYLPNDLQLTDISQKHFGSWSVIKNAVIEKVKAENPQKKKESGEKYEERIAKELKHYDSLTIGFLNDLLKNQ VGFTPIEMYFANMGAEDNENGQQVNHFVRIENAYTDICQLLSTEYKGDSLAQDKKNVEKIKNLLDAIKNLQHFV KPLLGKGNESEKDNRFYGEFTPLWEMLDQITPLYNMVRNRMTKKPYSEEKIKLNFENSQLLKGWDLNKEVANT CTMLRKDGNYYLVIMNKKHNTVLQPGKLVSDGDCYEKMEYKLLPGANKMLPKVFFSKSRIGEFNPSERIINNYN NNTHKKGDTFNLDDCHALIDFFKTSINKHEDWSKFDFKFSDTNTYSDLSGFYREVQQGYKIAFRNVSVQYIDQL VDEGKIYLFQIYNKDFSPYSKGTPNMHTLYWRALFDEKNLANVVYKLNGEAEVFFRKHSLPYKPTHPANKPIAN KNSQNKKKESTFAYDLIKDRRYTLDKFQLHVPITMNFKAAGINNINLMVKDYLKESDATHIIGIDRGERHLLYLSVI NMKGEIVEQYSLNEIVNEYNGNTYRTNYHDLLDAKEKQRDEARRSWQTIENIKELKEGYMSQVVHKIAQLMVK YKAIVVLENLNMGFMRGRQKVEKQVYQKFEKMLIDKLNYLVDKQCAIDEEGGILHAYQLTNKFESFQKIGTQSG FLFYIPAWNTSKMDPTTGFVNLFDTRYENMEKARLFFAKFDSIRYNTNQNYIEFAFDYDNFTSKAEGTKTKWTL CTYGTRIETKRNPDKNNEFDSIELNLTEQFKALFTTYHIDITGNLKEQICNQNDATFYKGLLHLLHLTLQMRNSVT GTATDYLLSPVMNNKGEFFDSRKCGKNLPENADANGAYNIARKGLWVIEQIKQAEDLSNIDLAIKNKEWMQFA QKNR |

TABLE S9B

Human Codon Optimized Nucleotide Sequences Group 9

| SEQ ID NO | Corresponding AA | Sequence |
|---|---|---|
| 171 | 131 | ATGGATATGAAGTCACTGAACAGCTTTCAGAACCAATATTCACTTTCAAAAACGCTGAGATTTC AGCTTATTCCTCAGGGGAAAACACTGGATAATATCAACGAGTCCCGAATCCTGGAGGAAGACC AACACCGCTCTGAGAGCTACAAACTCGTGAAGAAAATAATTGATGACTACCACAAGGCTTACAT TGAGCAAGCTCTGGGAAGCTTCGAGTTAAAGATTGCGTCTGATAGTAAGAATGATAGTCTCGA GGAGTTTTACTCTCAGTACATCGCGGAGAGAAAGGAAGATAAGGCAAAAAAGCTGTTTGAGA AAACTCAGGATAACCTACGGAAGCAGATTTCCAAGAAGCTCAAACAAGGAGAGGCATATAAGA GACTGTTCGGGAAAGAACTCATTCAGGAGGATCTCTTGGAGTTCGTCGCCACCGACCCCGAAG CAGACTCTAAGAAACGGCTCATTGAGGAGTTTAAAGACTTTACCACATACTTTATCGGCTTTCAC GAGAATAGGAAGAATATGTATGCCGAAGAGGCTCAGTCCACAGCCATCGCGTATCGAATCATC CACGAGAATCTGCCAAAGTTTATTGATAACATTCGCACCTTCGAGGAGCTGGCCAAGAGCTCTA TTGCTGACGTTTTACCCCAGGTGTATGAGGATTTTAAGGCATATCTCAAAGTGGAGTCAGTTAA GGAGCTGTTTTCTCTAGACTATTTCAATACCGTACTTACCCAGAAACAGCTTGATATATACAACG CAGTGATCGGTGGCAAATCATTGGACGAAAACTCACGCATTCAGGGACTGAATGAGTATATCA ACCTGTATAACCAGCAGCATAAGGATAAGAAATTGCCTTTTCTGAAGCCACTGTTTAAACAGAT TCTGTCCGACAGGAATAGCTTAAGCTGGCTGCCAGAAGCATTCGACAATGATAAGCAGGTCCTT CAGGCAGTGCATGATTGCTACACATCCCTGCTAGAAAGTGTTTTCCATAAAGACGGCCTGCAGC AGTTACTGCAGAGCCTGCCCACATATAATCTCAAAGGCATCTACTTACGGAACGATTTGAGCAT GACAAATGTCTCACAGAAGTTGCTTGGCGACTGGGGCGCTATAACTCGCGCCGTAAAAGAAAA GCTGCAAAAGGAAACCCCGCTAAAAAACGTGAATCAGATGAAGCGTATCAGGAACGGATCA ACAAGATTTTTAAACAGGCCGGAAGTTATAGCTTGGACTACATCAACCAGGCACTGGAAGCCA CAGATCAGACCAACATCAAGGTGGAAGACTACTTTATTAATATGGGCGTCGACAATGAACAGA AGGAGCCGTTGTTCCAACGGGTGGCCCAGGCCTATAATCAAGCTAGCGATCTCCTGGAAAAGG AATATCCTGCAAACAAAAACCTTATGCAAGATAAGGAGTCGATCGAACATATCAAGTTTCTCCT GGATAATCTCAAGGCCGTGCAGCATTTATCAAACCTTTGTTGGGTGATGGGAACGAAGCTGA CAAGGATAACCGGTTCTACGGAGAGCTAACGGCCCTGTGGAACGAGTTGGACCAGGTAACCA GACTCTATAACAAAGTGAGAAACTACATGACTAGAAACCCCTATAGCGTCGACAAGATCAAGA |

TABLE S9B-continued

Human Codon Optimized Nucleotide Sequences Group 9

| SEQ ID NO | Corresponding AA | Sequence |
|---|---|---|
| | | TCAATTTCAAGAACTCTACCCTTCTAAATGGTTGGGATAGGAATAAAGAACGAGACAACACTGC<br>CGTCATCCTGCGGAAAGATGGGAAATTTTACCTAGCAATCATGCATAAGGAGCACAATAAGGT<br>ATTCGAAAAATTCCCCGTCGGCACAAAGGACAGCGATTTCGAAAAGATGGAATACAAACTGCT<br>GCCTGGTGCCAACAAGATGCTGCCCAAGGTGTTTTTCTCTAAATCTCGCATCGACGAATTCAAG<br>CCTTCCGCCGAACTGCTGCAGAAATACCAGATGGGCACACACAAGAAGGGGGAATTATTTTCG<br>CTAAACGATTGCCATTCCCTGATCGACTTCTTCAAGGCTTCCATCGAGAAACACGATGATTGGA<br>AGCAGTTCAATTTTCACTTCAGTCCAACTTCCAGCTACGAAGACCTCAGCGGCTTCTATAGAGA<br>GGTGGAGCAACAGGGATACAAACTTACTTTTAAGAGCGTGGACGCGGACTACATTAATAAGAT<br>GGTTGACGAGGGAAAGATATTCCTTTTCCAGATCTACAACAAAGATTTCAGCGAACACTCCAAA<br>GGGACTCCCAATCTGCACACCCTTTATTGGAAGATGCTGTTTGACGAAAGGAATTTGCAGAACG<br>TGGTCTATAAGCTTAATGGCGAAGCTGAGGTCTTTTTCCGGAAAAAAAGTTTAACCTACACCCG<br>GCCCACCCATCCTAAGAAGGAGCCAATTAAGAACAAGAATGTGCAGAATGCCAAAAAGGAGA<br>GCATCTTCGACTACGATCTGATCAAGAACAAAAGGTTTACGGTTGACAGTTTTCAGTTTCACGT<br>ACCAATTACAATGAACTTCAAGAGTGAGGGACGTTCTAACCTCAACGAGAGGGTGAACGAGTT<br>CCTGCGACAAAATAACGATGCCCACATAATTGGGATTGATAGAGGGGAGCGCCACTTGCTGTA<br>CCTTGTCGTTATCGACAGGCATGGTAATATCGTGGAGCAGTTCTCCCTCAACTCCATAATTAACG<br>AGTACCAAGGGAATACCTATGCCACTAATTATCACGATTTACTGGACAAGCGTGAAAAGGAAA<br>GGGAGGAGGCCAGGGAGTCCTGGCAGAGTATTGAGAACATCAAAGAGCTGAAAGAGGGATA<br>CCTCTCTCAAGTGGTTCATAAAATCGCTGACTTAATGGTGAAATACCATGCTATTGTCGTGCTGG<br>AAGATCTGAACATGGGCTTCATGCGGGGCGCCAGAAAGTTGAAAAACAAGTGTACCAGAAA<br>TTCGAGAAAATGCTGATTGACAAGCTAAACTATTTGGTAGACAAAAAGCAGGATGCTGAGACG<br>GACGGCGGACTGCTAAAAGCATATCAGCTGACAAACCAGTTTGAATCATTTCAGAAGCTCGGT<br>AAGCAGTCGGGCTTCCTGTTCTACGTGCCAGCCTGGAACACGTCTAAAATCGATCCGTGTACCG<br>GATTCACGAACCTCCTGGACACTCGATACGAGTCAATCGAAAAGGCGAAAAAGTTTTTTCAGAC<br>CTTCAATGCCATTAGATATAATGCAGCCCAAGGGTACTTCGAGTTTGAACTCGACTACAATAAG<br>TTCAATAAGAGGGCTGACGGGACACAGACCCTCTGGACTCTGTGTACCTATGGGCCACGCATA<br>GAGACACTCAGGTCCACCGAGGACAATAACAAATGGACTTCTAAAGAGGTGGACCTCCACCGAC<br>GAGCTGAAGAAGCATTTTTACCACTATGGCATTAAGCTGGATGCAGACCTCAAAGAAGCTATA<br>GGTCAGCAGACTGACAAGCCTTTTTTCACTAACTTACTCCACCTTTTGAAGCTGACACTCCAGAT<br>GCGCAATTCCAAAATAGGCACCGAAGTCGACTACCTTATATCACCGATCCGAAACGAGGATGG<br>TACTTTCTATGACAGTAGACAAGGAAATAAGTCGCTGCCTGCCAATGCCGATGCGAATGGAGC<br>CTACAACATAGCTCGTAAGGGCTTGTGGGTTATCAATCAAATAAAACAGACACCCCAAGATCAA<br>AAACCGAAGTTGGCCATTACCAATAAGGAGTGGCTTCAGTTCGCACAAGAAAAACCATACCTTA<br>AGGACTGA |
| 172 | 132 | ATGGATCACTTCACCAATCTGTACCCTGTGTCGAAGACCCTGAGATTCGAGCTGATTCCAGACA<br>AGCGCACCAAGGCAATCCTGGAGCGCACCGACCTGATCGCCCAGGATGAGCATCGAGCTGAGT<br>CTTATAAACTCGTGAAGAAGATCATCGATCGGTATCATAAAAAGTTCATCGACAGTGTGCTGGG<br>AACTCTGAAACTGCCTCTGGACGAACTGGACTCACTGCACGAGCTGTACAGCAAATCTCAGAA<br>GTCAGACGCCGACAAAAAGGCCCTCGAGAAGATCCAGGACAAGCTGCGGAAACTGATCGCAG<br>ACGCCCTGACTAAGGATTCTAGGTACAAGAGGATCGACAAGAAAGAGCTCATCAGAGAGGAC<br>ATCCTGTCTGTGATCGAGCCCGAGGAGCAAGCCCTGATCGACGAGTTCCGGGACTTCACCACAT<br>ACTTTACAGGCTTTCACGAGAACAGGAGGAACATGTACTCCGCTGAGGCCCAGAGCACCGCTA<br>TCGCCTATAGACTGATCCACGAGAACCTGCCTAAGTTTATCGACAACATGGCCACTTTTGAGAA<br>GATCGCAGCCTCTCCCGTGGCCGAGCACTTCCCACAGCTGTACCAGGAGATGGCAGAATATCT<br>GAACGTGCGGGAGATCGGTGACCTCTTCAAGCTGGATTACTACACAGAGCTGCTGACGCAGAG<br>TCAGATCGAGGCTTATAACGCAGTCATCGGCGGAAGGACTGTGGAGGAGTCTGGAAAGAAGA<br>TCCAGGGGATCAACGAGTACGTGAACCTGTACAATCAGCAGCAGCCCTCTAGAGACACTCGGC<br>TGCCCAAGCTGAAGCCCCTGTTTAAGCAGATTCTGTCTGATAGGGAGGCTGTGTCTTGGCTGCC<br>TGAGGAGTTTGAGAGCGATAAAGACATGCTGACCGCCGTGAAGGAGTGCTACCACAGCCTGA<br>ACGATCACGTGTTTGATCCTCTGCGCGAGCTGCTGACAAACCTGTCTAGTTACAATCTGGACGG<br>CATCTACATCCCCAACGATCTGAGCCTGACAGACATTAGTCAGGCCATGTTCAAGGATTGGTCT<br>GTGATCAAAAAGGCCATCGCCGAAGACGTGAAAAGGAACTGCCCACTGAAAAGGAACGAAAA<br>GGCCGACAATTATGAGGAGAGGATTAGTAAGCTGATCAAGAGAGAAAACAGCTTCTCCATTGG<br>GTACATGAATCACTGCATCCAGGAGAAGGATATCTGCGATCATTTCGCTACCCTGGGCGCTAGC<br>GACAACGGGGAGGAGCAAACCGTGAACCTGTTTCTGCAGATCCAGATGCCTACACCGACGCT<br>CAGAGCCTGATCGAAAATGACTATCCCGAGGATCGGAACCTGGCCCAGGACAAAGAGAACGT<br>CGCCAGACTGAAGGCCCTGCTGGATGCTGTGAAGGCCCTGCAGCGGTTTGTGAAACCTCTGAG<br>GGGCAACGGAGACGAGCCTGACAAGGACGAGCGATTCTATGGCGAGCTGGCCGTGCTGTGGG<br>AGGAGCTCGACCACATCACACCTCTGTACAACAAGGTGCGGAACCGCATGACAAGAAAGCCCT<br>ACAGCATCGAAAAGTTTAAACTGAACTTCCAGAATTCCACACTGCTGGACGGCTGGGATCTGAA<br>TAAAGAGCGCGATAACACCGGAGTGATTATGAGAAAGGACGGCAAGTACTTCCTGGCCATCAT<br>GAACAAACAGTTCAATAGAATTTTCGTTGACGCCCCCCAGGCCGGACACGACGAGGATACCTTC<br>GAGAAGATGGAGTATAAGCTGCTGCCCGGAGCTAACAAAATGCTGCCCAAAGTGTTCTTCAGC<br>AAGTCCCGGATCGAAGAATTCAAGCCTAGCCCAGAGCTGCTGGAGCACTATGAGAAGGGCACC<br>CACAAAAAAGGAGATAACTTTAGTCTGAAAGACTGTCATGAGCTGATTGATTTCTTTAAGGCCA<br>GCATCGCCAAGCATGAGGACTGGTCTAAGTTCGACTTCCATTTTTCCCCAACTGATACATATGA<br>GGATCTGTCCGGCTTCTACAGGGAGGTGGAACAGATGGGCTATAAGATCAGCTACAAGCAGAT<br>TCCCGTGTCATACATCGACAAGATGGTGGAGGAAGGAAAGCTGTTTCTGTTCCAGATTTACAAC<br>AAGGATTTCAGCCCATATAGCAAGGGAACCCCCAATCTGCACACGCTCTACTGGAAGATGGTG<br>TTTGACGAACGGAACCTGGCCAATGTGGTCTACAAACTGAACGGCCAGGCCGAGGTGTTCTAT<br>AGGAAGAAATCTCTGGACTATGACAGACCTACCCATCCCGCTAACCAGGCAATTAAGAACAAG<br>AACCCCGAGACAACAAAGAAAGAGTCCACCTTTGATTACGACATCATCAAAGACAAGAGATTC<br>ACCATGGATAAATTCCAGTTCCACGTCCCCATTACCATCAACTTCAAGGCCACCGGGTCTGGCTC |

TABLE S9B-continued

Human Codon Optimized Nucleotide Sequences Group 9

| SEQ ID NO | Corresponding AA | Sequence |
|---|---|---|
| | | TATCAATCCTCTGGTTAATCAGTACATCCACGACCACGACGACCTGCATTTCATCGGCATCGATC
GGGGCGAGAGACACCTGCTCTACGTGACCGTGATTGACAGCAAGGGATGCATCAAGGAGCAG
TTCAGCCTGAACGAGATCGTGAACGAGTACCAGGGCAACACCTATAAGACCAACTACCGCAGC
CTGCTGGATAAACGGGACGACGAGCGCCAGCGGGAGCGGCAGAGCTGGAATACCATCGAGG
GTATTAAGGAACTGAAGCAGGGATACCTGTCTCAGGTGATTCACAAGATCGTGAGCCTGATGG
TGAAATACCACGCTGTGGTCGTGCTGGAAGACCTGAACATGGGCTTCAAACGCGGCCGCCAGA
AAGTCGAGTCCTCCGTGTACCAGCAGTTTGAGAAGGCCCTGATTGATAAGCTCAACCTGCTGAT
CGACAAGAAAATCGACGCCGATCAGCCCGGTGGCCTGCTGCACGCCTACCAGCTGACCAACAA
GTTCACCTCCTTTAGAGACATGGGCAGACAGAACGGCTTCCTGTTCTATATTCCCGCATGGAAC
ACCAGCAAAATCGATCCAGTGACCGGCTTCGTGGACCTGCTGCATCCTAGATACGAGAGCGTG
GACAAATCCCGCTCCTTCTTCTGCAAGTTTAAGAGCATCAGGTACAACCAGGACAAGGGATGGT
ATGAGTTCACCATGGACTATAATGACTTCACAACTAAGGCTGAAGGAACAAGGACAGAGTGGA
CTCTCTGCACACACGGCACCCGGGTGGAGACATTCAGGAACGCCGAGAAAAATTCCTCCTGGG
ATTCCAGAGAGGTTAATCTCACTGACGAGTTCAATGCCCTGTTTGCGACCTACGGCGTCGAGCC
CCAGGGCAATCTGAAGCAGGCTATCGCCGAGAGATCCCAGAAGGAATTCTTCGATAAACTGAC
CCACCTGCTGGCCCTGACACTGCAGATGCGGAATAACATCACCGGCACCGAAGTGGACTACAT
GATCTCCCCTGTGGCTGACGAGAATGGGAAATTCTTCGATAGTCGGACCTGCGGGAAGGAACT
GCCAGAAAACGCTGACGCCAACGGGGCCTATAACATCGCCCGAAAAGGACTGTGGGTCGCCC
GGCAGATTCAGGCCGCCCACGTGGATGAGAAGGTGAACATGGCCATCTCCAACAAGGAATGG
CTGTCCTTCGCTCAGTCCAAGCCCTATCTGAATGACTGA |
| 173 | 133 | ATGAAACAGTTAAATGATCTTACTGGTCTGTACTCACTCAGTAAGACCCTTCGGTTCGAACTGA
AACCTATTGGAAAGACCCTCGAGCATATTGAATCGAAAGGATTCATTACACAGGACGAGAAGA
GGGCCGAAGAATACAAGAGAGTAAAAGATATCATCGATCGGTACCACAAAAGCTTCATTACAA
TGTGTCTCTGTGGTTTTAAATTCAATCAGGAAGACCTCGACACATACGCCGCTCTGGCGGAAGA
CTTCAATAGAGATGAAAAAGCCTTTGAGGAGTCTAAAAAGACTTTACGGAAGCAGATCGTGGG
AGCCTTTAAGAAAGGCGGCGGCTATAGCGACCTTTTCAAGAAAGAACTGATCCAGAAGCACCT
GCCAGAGATCGTGACAGATGACGAGGAAAAGAAAATGGTCGAAAACTTCTCCAAGTTCACAAC
ATATTTCACCGGTTTCAACGAGAATAGAAAGAATATGTACTCCGACGAGGAAAAGAGCACCGC
GATTGCTTACAGGCTGATACATGACAACCTGCCTATGTTTCTTGACAATACGCGTAGTTTCTCCC
GGATCGCTGATAGCGACGTTAGGCAGTCTTTCTGCAAAATAGAGTCATCTTTTAGCGAATACCT
GAATGTGGAGCATCTCGCAGAGATGTTTCAGCTGGATTACTTCAGTGAGACATTGACGCAGGA
ACAGATCGCAGTGTATAACCACGTGGTTGGTGGCCGCACATTGGAGGACGGAACCAAAATTCA
GGGAATTAACGAGTATGTCAACCTATATAACCAGCAGCATAAGGATAATCGATTACCACTCCTC
AAACCGTTGTATAAAATGATTCTCTCAGATCGAGTGGCACTGTCTTGGCTGCCCGACGAATTTG
CAAATGACAAGGAGATGATCGACGCCATCAAAGAGACATACGATTCACTGAAGGAAAATCTCA
CTGGTGACGGCGATGGTAGTCTTAGAAATCTGCTGCTCAACATCAACAATTACGATATCGAGCA
CATCTATATTGCGAACGACCTTGGACTAACCGACATCAGTCAGCAGATGTTTGGCAATATGAC
GTGTACACATCCGCTATCAAACAGGAACTTAGAAATTCCGTCACTCCTACGGCTAAGGAAAGAC
GCGAACCAGAACTCTATGCTGAGAGAATTAACAAGCTCTTTAAGTCCACTAAATCATTCTCTGTA
GCTTACCTGAACTCTTTGGTGGATGCCGAGCACACCATCCAGAACTACTATCAACAGCTTGGAG
CCTATGATCGCGACGGCGAACAGCGCATCAATCTCTTTACTCAACTGGAAATGGCTTACGTTGC
AGCTAAAGATATTCTGTCCGGGAAGCATGGTAACATCTCTCAAACCGATGCCGAGATTGCCATT
ATTAAGAACTTGCTGGATGCCTACAAGTCCCTGCAGCATTTTATAAAACCCCTGCTGGGGAATG
GGGATGAGGCGGACAAAGACAACGAGTTCGACGCAAAACTGAGAGAGGTGTGGGACGCTTT
GGACATAGTCACCCCCCTATATAATAAGGTTCGAAATTGGCTTACTCGGAAGCCATATTCCACG
GAGAAAATTAAGCTCAATTTTGAGAATGCCCAGCTGCTGAATGGGTGGGACAAGAACAAAGA
GACGGACTGCACAAGCGTGCTGCTCAGGAAGGACGGGAAATACTTCTTAGCAATCATGGATAA
GAAGGCTAACCGTGCATTCGATGTCGAAGACCTTCCCTGCGATGGCATTTGCTTCGAGAAAATG
AACTACAAACAAATCGCGCTCCCCATGGGCTTAGGGGCGTTTGTCAGGAAGTGCACCGGCTCG
GCAAAAAAACTGGGTTGGACCTGTCCCTCCAGTCTGCTGAACAAGGACATGAAGATCATCATC
AAAGATGATGAGGCTACTAATGTCCTCCCTTCTTTAATTGAGTGCTACAAGGACTTCTTAAATAT
CTATGAGAAGGACGGCTTCAAGTATAAGGACTTCAACTTTAAGTTCAAGCCAACCCACGAGTAT
AAGAAGCTGTCACACTTTTTTGCAGAGGTTCCTACTCAGGGCTATAAAATTACTTTTCGGAAAGT
AAGCGAGTCATTCATCAACCAACTGGTTGATGAAGGGAAGCTGTATCTGTTCCAGATATGGAA
CAAAGACTTCTCGGAATTCAGTAAAGGGTCACCTAATATGCACACACTCTACTGGAAAATGCTA
TTTGACGAGCGCAATCTGGCTGACGTGGTATATAAGCTGAACGGCCAGGCCGAAGTCTTTTACC
GGAAGTCAAGTTTAGACGTGGCTAACACCACCATTCACAAGGCCCATCAGCCCATCCTTAACAA
AAACCAGGAAAACAAAAAGCAACAGTCCACTTTCGACTACGACATAATTAAGAATCGGCGTTA
CACCGTGGATAAATTTCAGTTCCATGTGCCAATATCCATCAACTTCAAAGCAACTGGCAGGGAT
AATGTTAACTCTCAGGTCCTGGATATCATCCGGAATGGCGGAATTAAGCACATTATTGGTATTG
ATCGAGGGGAGCGGCACCTATTATACCTAAGTTTGATAGACTTGAAGGGGAACATCGTGAAGC
AGATGACACTGAATGATATAGTGAATGAGTACAACGGAAACACCTACGCAACAAATTACAGAG
ACTTGCTGGCAGAGCGCGAGGGCAATAGAACTGAGGCCCGCAAGAACTGGAAGAAAATCGAA
AACATCAAGGACATCAAACAAGGCTATCTTTCTCAAGTTGTGCACATAATTAGCAAGATGATGG
TCGAATACGACGCCATCGTGGTCCTGGAAGATCTCAACATGGGCTTCATGCGGGAAGGCAAA
AGATTGAAAGATCCGTCTATGAGCAATTCGAGAAGATGCTGATTGACAAGCTCAATTATTACGT
AGATAAGCAAAAGGACGTTAACGAAGCCGGCGGCTTGCTCCATGCCCTTCAGCTAACCTCCCG
CTTCGAGAGCTTTAAAAAACTCGGAAAGCAGATGGGTGTTTGTTTTACATCCCAGCCTGGAAT
ACCAGCAAGATAGACCCCGTAACCGGATTTGTGAACCTGTTTGATACGAGGTACACCAATGCC
GATCAGGCCAGAAAGTTCTTTAGCCTGTTTTGATAGCATAAGGTATAACGCCGAGAAAACTGG
TTTGAGTTCGCCTTTGACTACGATAAATTCACAACAAAGGCCAAAGGGACTCGCACACGGTGG
ACTCTGTGCACATATGGAACTCGTATAAGGACGTTCAGGAACCCAGCCAAGCTTAATCAGTGG
GACAATAAAGAAGTGGTGTTAACCGATGAGTTTAAGAAGGCGTTTGCCGATGCCGGTATTGAT |

TABLE S9B-continued

Human Codon Optimized Nucleotide Sequences Group 9

| SEQ ID NO | Corresponding AA | Sequence |
|---|---|---|
| | | ATCCACGGGAACTTGAAGGAAGCTATATGTTCACTGGAGGATAAAAAATACCTTGAACCGTTG<br>ATGCATCTGATGAAACTGCTCCTGCAGATGCGCAACTCTATCACCAACACCGAGGTGGACTATC<br>TCCTGAGCCCTGTCGCTGATAAAAACGGCAGCTTCTATGATTCTAGGGTGTGTAGCTATGCCTT<br>GCCTAAGGATGCAGACGCAAACGGGGCTTACAATATCGCTCGTAAGGGACTATGGGCTATTCG<br>CCAAATCCAGGAAACCCCTGTGGGAGAGCGACCGAATCTGGCAATCAAGAATAATGAGTGGTT<br>GAAATTTGCCCAACAGAAGCCCTACCGAGACGAATGA |
| 174 | 134 | CTGCTGAACTACAAATACTACATCGTGATGAAGCATACGATGAGCTGACGGGCCTGTATTCCC<br>TGAGCAAAACGCTGAGATTTGAGCTGAAGCCTGTGGGTAAGACCCTGGAGTACATCGAGAACA<br>AGGGCATCATCGCTCAGGACGAGAAGCGCGCCGAGGAATACAAGCTGGTGAAAGGCATTATC<br>GACAGATACCACAAATCCTTCATCAGACTGTGTCTGTACAACTTTAAGCTGAAGCTGGAATCTG<br>ACAACGGACTGGATAGCCTGGAAGAGTACGTGGAATACGCCTCAATCCAACGGAGGACCGAC<br>ACCCAGGACGCTGAGTTCAAGAAGGTGAAAGAGAACCTGAGGAAGCAGATCGTGAGCGCATT<br>TAAAAACGGGGCCACCTATGGCGATCTGTTTAAGAAGGAGCTGATCCAGCAGATCCTGCCTGA<br>TTTCGCCGACAATGATGAGGAGAGACAGCTGGTGGACAACTTTAGCAAGTTCACAACCTACTTC<br>ACCGGGTTTCATGAGAACAGGAAAAATATGTACTCCGAGGACGATAAAGCTACCGCCATCGCA<br>TTCCGGCTGATCCACGAGAATCTGCCCCTGTTCATTGACAACATGAAGAGTTTTGCCAAGATCG<br>CCGAGACCGTGGTGGCCGAGCACTTCGCCGATATCGAGACGGCTTTTGAGGATTGTCTGAACG<br>CCCTGATCCCCGATATGTTCGCTCTGCCATACTTCACCAAAACACTGACCCAGGAGCAGATTGA<br>AGTGTACAATAATATCATCGGAGGCAGGGTGCTGGAGGACGGCACCAAAATCCAGGGCATCA<br>ATGAGTACGTTAACCTCTACAACCAGCAACAGAAGGACAAGTCTGCGCGCCTGCCCCTGCTGA<br>AACCACTGTATAAGATGATCCTGAGCGATCACGTGGCCATTTCCTGGCTGCCCGAGGAGTTCGC<br>CAGCGATGAGGAGATGCTGTCTGCCATCAACGGGGCCTACGACATGCTGAAGGACGTGCTGTC<br>TGAAAAGAACGAGGACTCTCTGTTCAACCTGCTGAAGAACATCAACGAGTACGACACCGAGCA<br>CATCTTTATCGCTAACGACCTGGGCCTGACCGACATTTCCCAGCAGATCTTCGGCCAGTACGAC<br>GTGTATAGCAGTGTGATTAAAGCTGAGCTGAGGAATCAGGCCAGTATGACCGCCAAGGAGAA<br>GAAGAATCCCGAGCTCTATGAGGACAGAATCGCCAAACTGTACAAATCAGCCAAATCATTTAGC<br>ATCGATTACCTGAATAGTTTTGTAGACAGCGAAAAGTCAATTCAGAATTATTATGCCCAGCTGG<br>GGCATACGACCGGGATGGCGAGCAGAGGATCAACCTGTTTGCCCAGATCGAAATGAAGCAC<br>ATCGCCGTGGCCGACATCCTGGCCGGAAAGGTGGCCAATCTGAACCAGAGCGAACAGGGCAT<br>CAAACTGATTAAGGACTTCCTGGACGCATTTAAAGCCCTGCAGCATTTCATCAAGCCTCTGCTGG<br>GAAACGGCGACGAAACTGATAAGGACAACGCCTTCGACGCCAGACTGAGGGTGGCATGGGAC<br>ACTCTGGACATCATTACTCCCCTGTACAACAAGGTGCGCAACTGGCTGACAAGAAAGCCCTACT<br>CCGAGGAGAAGATCAAGCTGAACTTCGAAAACGCCCAGCTGATGAATGGCTGGGACCTGAAC<br>AAGGAGCCCGATTGCACCTCTATCATACTGAGAAAGGACGACAAGTTTTACCTGGCAATTATGG<br>ACAAAAAGGCCAACCATTCCTTCGATACCGACGAGCTGCCCAACGAGGGAGATTGTTATGAGA<br>AGGTGGACTACAAGCTGCTGCCTGGCGCCAATAAGATGTTGCCCAAGGTGTTTTTTAGCAAGA<br>GCCGCATCGACGAATTTGCCCCAAGCCAGTCCCTGCTGGATGCTTATGAGAAGGGCAGCCACA<br>AGAAGGGCACCAATTTCTCCCTGAACGACTGCCATAATCTGATCGACTTCTTCAAACAGTCAATC<br>GCCAAACATGAGGACTGGAAGAAGTTCCCCTTTGATTTTAGTGACACAAGCAGCTACGAAGAC<br>ATTAGCGGCTTCTATCGCGAGGTGGAACAGCAGGGGTACATGCTGTCTTACAGAAATGTGTCT<br>GCCGCCTACATTGATAAGCTGGTCGACGAGGGCAAGTTGTTCCTGTTCCAGATCTGGAACAAA<br>GATTTTTCCGAATATTCCAAAGGCACTCCTAACATGCACACCCTGTACTGGAAGATGCTGTTCGA<br>TGAGAAGAATCTGGCCAACGTGGTGTACAAACTGAACGGACAGGCAGAGGTGTTCTACCGCA<br>AGAAGTCCCTGGACATTGCAAATACCACAGTGCATACCGCTAACCGGCCTATTGCCAACAAGAA<br>CAAGGATAACAAGAAAAAGAGAGCACATTCGAGTACGACATCATTAAAAACCGGCGGTACAC<br>CGTGGACAAGTTCCAGTTCCACGTGCCCATAACCATGAACTTCAAGAGCATTGGGAACGACAAT<br>ATCAATGAGAGCGTGCTGAATGTGATTCGGAATAACGGGATTAAGCACATCATCGGATCGAC<br>AGAGGCGAGAGGCATCTGCTGTACCTGTCATTGATCGATCTGAAAGGCAATATCGTGAAGCAG<br>ATGACCCTGAACGACATCGTGAACGAATATAATGGCAACACCTACAGCACCAACTATAAGGAC<br>CTGCTGGCCACCAGGGAGGGAGATAGGACCGACGCCAGACGCAACTGGCAGAAAATTGAGAA<br>CATCAAGGACCTGAAGGAGGGATACCTGTCTCAGGTGGTGCACGTGATAGCAAAGATGATGG<br>TGGAGTACAAAGCCATCGTGGTGCTGGAAGATCTGAACATGGGCTTTATGCAGGGCAGGCAG<br>AAAATCGAGAGAAACGTGTACGAGCAGTTTGAGCGGAAACTGATCGAGAAGCTTAACTTTTAC<br>GTGGACAAACAGAAGAAGGCCGACGAGGTGGGCGGACTGCTGAATGCTTACCAGCTGACCTC<br>TAAGTTCGATAGTTTCAAAAAACTCGGCAAGCAGTCTGGCTGCCTGTTCTACATCCCAGCTTGG<br>AACACCAGCAAGATCGACCCTGTGACCGGCTTCGTGAACATCTGGGACACAAGATACGAGAAT<br>ACCGAAAAAGCCAGGTGTTTTTTCTCTAAGTTTGACAGCATCAGGTACAACACCCAGAAGGACT<br>GGTTCGAGTTCGCCTTTGACTATGGGAACTTCACCACCAAAGCCGATGGCACCCAGACCAAATG<br>GACCCTGTGCTCCTTCGGCACTAGGGTGAAGACCTTCAGAAACCCCGAGAAGGTGAATCAGTG<br>GGACAATGTGGAGGTGGTCCTGACTGAGGAGTTTAAGAGCCTCTTCGCTGACGCCGGCATCAA<br>CATCAACGGCAATCTGAAGGAGCAGATATGCAATCTGTCCGACAAGAAGTATCTCGAGCCACT<br>GATGGGCCTGATGAAGCTGCTGCTGCAGCTGAGGAATAGTATCACCAATAGCGAGGTGGACTA<br>CCTGCTGAGCCCAGTATGCGACAATAAAGGGAACTTCTACGACTCAAGAACCTGCAGTAATAA<br>GCTGCCTAAGGACGCCGATGCAAACGGGCCTACAACATTGCAAGAAAAGGCCTGTGGGCCCT<br>GGCTCGCATCGTGGATAGCGCTGAAGGGGAGCGGCCTAACCTGGCCATCTCCAATAAGGACTG<br>GCTGTGTTTCGCACAGCAGAAACCTTATCTGAACGATTGA |
| 175 | 135 | ATGGAGAGATTTGACGAACTGACCGGCCTGTACAGCCTGTCCAAAACCCTCCAGTTCGAGCTG<br>AAGCCTATCGGGAAGACTCTGGAGCAGATCGAGAGAAAGGGCATCATCGCCCAGGATGAGAA<br>AAGGGCTGAAGAGTACGAGATCGCCAAGTGTATTATTGACGAGTACCACAAGGCCTTTATCAG<br>CATGTGTCTGAAGGGACTGAGGCTGAATCTGTCCAGCACAGGCTCTCTGGACAGCCTGGAGGA<br>GTACGTGGAGCAAGCCAGCAAGCTGAGAAGAAGTGAATCCGAGGAGAAAAATTTCGACACCA<br>TCAAGCAGAACCTGAGACGGCAGATCGTGAACTCCTTTAAGAGCCGCGGCGGCTCTTTCACTG |

TABLE S9B-continued

Human Codon Optimized Nucleotide Sequences Group 9

| SEQ ID NO | Corresponding AA | Sequence |
|---|---|---|
| | | ACCTGTTCAAGAAGGAGCTGATTACCCAGCACCTGCCCGAGTTTGTGAGTGAGAAGAACAAAA AGCAGATTGTGGAGAACTTTTCCAAGTTCACTACTTACTTCACTGGCTTCCACGAGAACCGGAA GAATCTGTACTCCGAGGAAGAGAAATCCACAGCCATCGCTTACCGACTGATTCACGAAAATCTG CCCATGTTTATCGACAACATCAAGACCTTCGCCAAAATCGCCGACTCCGATGTGGCCAATTACTT TGTGGAGATCGAGACCACCTTTTCCGAGTACCTGGACGGCTCCCATATCACTGATATGTTTAAA CTGGAGTACTTTACCGAAACCCTGACCCAGGAGCAGATCAGTCTGTACAACAACGTGATCGGG GGCGTGAGCAATGAGGATGGAACCAAGAAGAAGGGGCTGAACGAGTACGTCAATCTGTACAA TCAGCAGAATAAGACCCGGCTGCCTCTCCTGAAGCCACTCTACAAGATGCTGCTGTCCGACAAG GTGTCCCTGAGCTGGCTGCCTGATGACTTCGTGTCTGACGAAGAGATGATTTATGCTATTAACG AAATGCAGCTCAGCCTGAAGGACCTGCTGTACTCTGACGGTGAAAACAGCCTGAAGTATCTGC TGACTCACATCGGCGATTACGACACCGAGCATATTTACATCTCCAACGACCTGGGCCTGACCGA CATCAGCCAGCAGATCTTCGGCCAGTATGATGTGTATACCAGCGGCATCAAAACCGAGCTCTGC AATCAAATCAAGCAGAGCGCCAAGGAAAAGCGCGAGCCCGAACTGTACAAAGAAAGGATCAA CAAGCTGTTCAAAAGCGCCAAATCCTTTAGCATAAACTACCTCAATTCCTTCGCCGAGGGCGAT AAGACCATTCAGGCCTACTATGCCAGACTGGGAGCACATGATCTGGAGGGAGAGCAGAGTAC CAACCTGTTCACCCAGATTGAAATGGCCAGCATCGCCGCCTCTGACATCCTGGCCGGGAAGCAC ACCAATATTAACCAAAGCGAGGAGGATACCAAGCTGATCAAGGACCTGCTGGATACCTACAAA GCTCTGCAGCACTTCATCAAGCCCCTGCTGGGAAACGGCGACGAGGCCGACAAAGATAACGAA TTCGACGCCCGCCTGAGAAACGCCTGGGACGCACTGAGCGTGGTGACCACCTGTACAATAAG GTTAGAAACTGGCTGACTAGAAAGCCCTACAGCACCGAGAAGATCAAACTGAATTTCGACAAT GCTCAGCTGCTGGGGGGGTGGGACCTGAATAAGGAGCCCGATTGCÅCTTCÅGTGCTGCTGCG GAAGGATGACATGTTCTACCTGGCCATCATGGACAAGAAGTACAACCACGCCTTCGATATCGAT GAGCTGCCATGCGAGGGCGAGTGCTACGAGAAGGTGGATTATAAGCTCCTCCCCGGCGCCAAT AAGATGCTGCCCAAGGTGTTTTTCAGCAAGTCAAGAATTTCTGAATTTGCCCCATCTCTGGCCAT CCAGAAGAGCTACAACGAGGGCACCCACAAAAAGGGGTCCAACTTTTCTATCAGCGACTGTCA CCGCCTGATTGATTTTTTCAAGCAGAGCATTGCCAAGCACGAAGACTGGTCTAAATTCCCTTTCT CTTTCTCCGACACTAAGAGATATGAGGACATCTCAGGATTCTATAGAGAGGTGGAGCAGCAGG GGTACATGCTGAGCTATCGCAACGTGTCCGTGAGCTTTATCAATCAGCTGGTGGACGAGGGGA AGCTGTACCTGTTCCAGATCTGGAATAAGGACTTTAGCAAGTACTCTAAAGGGACCCCCAATAT GCACACACTGTACTGGAAAATGCTGTTCGATGAAGTGAACCTGGCTGACACCGTTTACAAGCTG AACGGTCAGGCTGAGGTGTTCTACAGGAAGTCTAGCCTGAAACTGGAAAACACAACCATCCAC AAGGCCAACCAGACCATTAAGAACAAAAATGTGCAGAATGAGAAGAAGCAAGCACTTTCGAC TACGACATCGTGAAGAATCGCAGATACACAGTGGATAAATTCCAGTTTCACGTGCCAATCACCC TGAACTTCAAGGCCACCGGCGGCGACAACATCAACGCAAACGTGCAGGACATAATCCGGAATA ATGGCATCGAGCATATCATCGGCATCGACAGAGGCGAGAGACACCTGCTGTACCTGAGCCTGA TTGATCTGAAGGGTAACATTGTGAAGCAGATGACCCTAACGACATCATTAACGAATATAAGG GCAATATCTATAAGACAAACTACAAGGATCTCCTGGTGACACGCGAGGGGGACCGCACAGAG GCTAGGAGGAATTGGCATAAGATCGAGAATATCAAGGACCTGAAGGAGGGCTACCTGAGTCA GGTGGTGCACATCATAGCCAGAATGATGGCCGAGTACAAAGCCATCGTGGTCCTGGAGGACCT GAATATGGGATTTATGCGGGGGCGCCAGAAGATCGAGCGGAACGTGTACGAACAGTTCGAAC GGATGCTGATCGATAAACTGAACTACTACGTGGATAAGCAGAAAAAGGCCACAGAGAATGGC GGACTGCTGCATGCCCTGCAGCTGGCCAACAAGTTCGAGAGCTTTAAGAAGCTGGGCAAACAG TCTGGCTGTCTGTTCTACATACCTGCTTGGAATACCTCCAAAATTGATCCCGTCACTGGGTTTGT GAATCTGTTTGAAATTCACTATGAGAATGTGGACAAGGCCAGGTGCTTTTTCTCAAAGTTCGAT ATCATCCAGTACAACGAGGAGCGCGACTGGTTCGAGTTTGCCTTCGATTACAATGACTTTGGGA CCAAAGCTGAGGGCACCAAGTCTAAATGGACCCTGTGCACATATGGCACCAGAATTAAAACCT TTCGAAACCCTAACAAACTGAACCAGTGGGACAATGAGGAGGTGGTGCTGACCGAAGAGTTTA AGAAGATCTTCAACGAGGCTGGGATCGACATCAACGGGAATATTAAGGACGCAATCTGCCAGC TGAAGGAGAAGAAACACCTTGAGAGCCTGATGCACCTGATGAAACTCCTGCTCCAGATGAGGA ACAGCGTGAGCAACAGCGAGATCGACTACCTGCTGAGCCCCGTGGCCGATGAGAATGGGGAG TTTTACGACAGCAGAACATGCGCCCCAACTCTGCCAAAGGATGCAGACGCCAACGGAGCGTAC AATATCGCTAGGAAGGGCCTGTGGGTGATCGAGCAGATCAAACAGACTGCCGACAAGCCCAG GCTGGCCATGACTAACAAGGAGTGGCTGAAGTTCGCCCAGGATAAGCCCTATCTGAACGAATA G |
| 176 | 136 | ATGAATACCTTTAACGAGCTGTCCGGCCTGTACAGCCTGCGGAAGACCCTGCAGTTCGAGCTGA AGCCCATCGGAAAGACCCTGGAAAACATCGAGAAAAAGGGCATCATCGAGCAGGACACACAG AGAGATGTGGAATATAAGAAGGTGAAGGGCATCATCGACAACTACCACAAGGCCTTTATCAAA ATGTGCCTGTGGAACCTGGAGCTGAAGCTGGAGAGCGATGGCCACTCCGACTCCCTGGAGGAC TACGTGAGACTGGCCAGTATCATCAGAAGAGGCGAGCTGGACGAGATCGAGTTTTCTAAAGTC ÅAGGACAACCTGCGGAAGCAGATCGTGTCGGCTTTTAAGAATGGGAACTCCTATGGCGATCTG TTTAAGGAGGAACTGATCCAGGAACACCTCCCCAACTTTGTGACTGATGAGGCTGAGAAGCAG ÅTGGTGGATAATTTCAGCAAGTTCACCACTTACTTCTCCGAGTTCCATAAGAACAGAAAAAATA TGTATAGCGACGAGAAGAAGTCAACCGCCATCGCATACAGACTGATCCACGAGAACCTGCCAA TCTTCATCGATAACATCAAGACCTTCAAAAAGATTGCCAACCTGAAATCGTGAACCACTTTGCC GACATCAAGCAGGCTTTTCAAGAATGTCTGAACGTTGAGAACATCGACGAAATGTTCCAGCTG AACTACTTCACCAAGCACACTGCCACAGGAGCATATCGAGACCTACAATAACATTATTGGGGGA AAACCAACGAGGACGGGAGCAAAATCCAGGGCCTGAATGAGTATATCAACCTGTATAACCAGC AGCAGAAGGATCACAGCAACAGGCTGCCCCTGTTCAAGCCCCTTTATAAGATGATCCTGAGCG ACAGAGAAGCCCTGAGCTGGCTGCCCGAAGAGTTTGCCAGCGACGAGGAGATGATTAATGCC ATCAACGAGGTGTATGATAGCCTTAAAAACGTGCTGGCCAACGACAATAACGGCCTGAAGCAC CTGTTGCTGÅACATCAACCAGTATGATACGGAGCAGATCTATATCGCTAACGACCTGGGACTGA CCGATATTTCCCAGCAGATGTTCGGCAAATATGACGTGTTCACCAGCGGCATCAAGAACGAGCT GAGAGGCCAGATTTCTCCCTCTGCCAAGGAGAAACGCGAGCCTGAGCTCTACGAGGAGAAGAT |

TABLE S9B-continued

Human Codon Optimized Nucleotide Sequences Group 9

| SEQ ID NO | Corresponding AA | Sequence |
|---|---|---|
| | | CAACAAGATCTTCAAATCCGCCAGATCTTTCACTATCAACTACCTGAACAGCTTTGTGCAGGACG<br>GAAAGACAATCCAGAGCTACTTCGCACAGCTCGGCGCCACCAACACAGATTCTGCCCAGTGCAT<br>TGACATCTTCACCAAGATTGAGATGGCCCACATCGCCGCCACCGATATCCTGGAGGGCAAGCA<br>CAACTCCATCGACCAGTCTGATAGCGATATTAAACTGATTAAGGACCTGCTGGATGCTTACAAG<br>GAGCTGCAGCACTTCATAAAGCCACTGCTGGGGTCCGGCGACGAGGCCATGAAGGACAATGA<br>GTTCGACGCTCAGCTGCACTATGCCTGGGACTCTCTGAATATTATTACCCCCCTGTACAATAAGG<br>TGAGGAATTGGCTGACAAGAAAACCTTATTCCACAGAGAAGATTAAACTGAATTTCGAGAATG<br>CACAGCTGCTGGGAGGCTGGGACATGAACAAAGAGACCGÅTTGTACCTCTGTGCTGCTCCGGÅ<br>AGGACAACATGTACTACCTTGCCATTATGGATAAGAAAGCAATCACGCATTTGATATTGATGT<br>GCTGCCAAATGAGGGCGACTGCTACGAGAAGGTGGACTACAAGCTGCTGCCCGACGCCTACAA<br>GATGCTGCCAAAAGTGTTCTTCTCCAAGAGTCGTATCAACGAGTTCGCACCCTCAÅAGGATATT<br>CAGAACGCCTACCAGAAGGGCACCCACAAAAAGGGCCCTAACTTCAGCATCTCTGACTGCCAC<br>CGGCTGATCGATTTTTTCAAACAGAGTATCGCCAAGCACGAGGATTGGCAGAAGTTCCCATTCT<br>CTTTCTCAGACACCGACTCATACGACGACATCTCTGGCTTTTATCGCGAAGTGAAACAGCAGGG<br>CTACATGCTGGGCTATAGGAAGGTGTCCGTGTCTTTCATTAACCAGCTGATCGACGACGGCAAG<br>CTCTATCTGTTTCAGATCTGGAACAAGGATTTTTCCGAGCATTCCAAAGGGATGCCAAATATCCA<br>CACCCTGTACTGGAAAATGCTGTTCGATGAGAGAAACCTGAGCAACATCATCTACCGGCTGAAC<br>GGCAAGGCCGAGGTGTTTTACAGACAGAACTCACTGAAGCTGGAGAATACCACTATTCACAAA<br>GCCAACCAGCCTATCAAGAACAAGAACATCCAGAATTCTAAGGAGTGCAGCACCTTTGACTAC<br>GATATCATTAAGAACCGACGGTACACTGCAGATAAATTCCAGTTCCACGTGCCCATCACACTGA<br>ACTTCAGGTCTACCGGCTCTGACAATATCAACAACAAAGTGAACGATGTGATCAGAAATAATGA<br>TATTGAACACATCATTGGCATCGACAGGGGAGAGAGGCACCTGCTGTATCTGAGCCTGATTGA<br>TCTGAAGGGCAACATCGTGAAGCAGATGACCCTGAATGATATTGTGAATGAGTACAACGGCAA<br>CACGTACAAGACCAATTATAAAGACCTGCTCGTGCAGCGCGAAGGCGACCGCACCGAGGCAA<br>GGAGAAATTGGCAGAAGATCGAGAACATCAAGGAGATCAAAGAAGGGTACCTGTCCCAGGTG<br>ATCCACATCATCACCAAGATGATGGTGGAATACAAAGCCATTGTGGTGCTGGAAGACCTGAAT<br>ATGGGCTTCATGAGAGGAAGGCAGAAGATTGAGCGCAACGTGTATGAGCAGTTCGAGAAGAA<br>GCTGATCGATAAGCTGAACTATTATGTGGACAAACAGAAAGACATCACCGATGCCGGCGGCCT<br>GATGCACGCCCTGCAGCTCGCTAACAAGTTCGAGAGCTTTAAGAAGCTGGGTAAGCAGAGTGG<br>CTGTCTGTTTTATATCCCTGCCTGGAATACCTCTAAGATCGATCCAGTGACAGGGTTTGTGAACC<br>TGCTGGACACTCACTACGAGAATATTGACAAGGCACGGTGCTTTTTTAGCAAGTTTGACAGCAT<br>CAGATACAACGCCAGCAACGACTGGTTCGAATTCGAGCTCGATACGATAAATTCACCGACAA<br>GGCACGCGGAACCAAGACCCACTGGACCCTGTGCAGCTATGGCACCCGCATTCGGACCTTTCG<br>CAACCCTCTGAAGCTGAACCAATGGGACAACGAAGAAGTGGTGCTGACAGAGGAGTTTAAAA<br>AGGTCTTCAACAACGCCAATATTGACATCTATGGAAACCTGAAGAACAGCATCTGCTCGCTGAA<br>TGACAAAACCACCCTGGAGTCTCTGATGCAGCTGATGAAGCTGATGGTGCAGATGCGGAATAG<br>CATTACAGGCACTGAGACCGATTATCTGCTGAGCCCTGTGACAGACGCCAACGGCAACTTCTAC<br>GATTCACGCAACAATATACCTACCCTTCCCATTGACGCCGACGCCAATGGCGCCTATAATATCGC<br>CCGCAAGGGCCTGTGGATCATCCAGAAGATTCAGCAGTCTCAGCCCGGGGAGAAACTGAACCT<br>AGCTATCTCAAACCGGGAGTGGCTGCAGTTCGCCCAGCAGAGACCCTACCTGAATGAGTGA |
| 177 | 137 | ATGAAGACATTCAATGATCTGACCGGCCTGTATAGCCTGAGCAAGACCCTGAGGTTCGAACTG<br>AAGCCGGTGGGCAAGACCAAGGATAATATCGAGACAAAGGGCATCATTGCTCAGGATGAGAA<br>ACGCGCCGAGGAATACAAGAAGGTGAAGGATATCATCGACCGCTATCATAAAAAATTCATCGA<br>GATGTGTCTGGCCAACCTGAAGCTGAAGACAATTTCCGACGGCAATAACGACTCTTTGAAAGA<br>GTATGTGACACTGGCCTCAAAGGCAAATAAGGACGAGAAGGAGGACAACGACTTCAAAGATG<br>TGAAAACAGCCCTGCGCAAGCAGATCGTGGACGCCTTCAAGAAGGGCGGCAGCTATAGTGAC<br>CTGTTCAAGAAAGAGCTGATTCAGGTGCACCTGCCCGATTTTGTGACAGACGAGCAGGAGAAG<br>CAGATGGTGGAGAACTTCGGCAAGTTCACTACCTACTTTACCGGGTTTAATGAGAATAGGCAG<br>AATATGTACAGTGACGAGGAAAGAGCACCTCCATCGCATACAGACTGATCCATGAGAATCTC<br>CCCATGTTCATTGATAACATCAAGTCCTTCGCCAAGATCGCCGAACACGAGGACATCGACTTCC<br>TGCCCGATATCGAGAACGGCTTCAAGGAGGAACTGAAGAGGCTGAAGGCCCAGAGCATCTCC<br>GAGGTGTTCGACCTGGCCAACTTTACCAACACTTTGACCCAATCCCAGATCGATAGCTATAACG<br>CCATTATCGGCGCACGCCACGACGAAAACGGGGATAAAGTGCAGGGCATCAACCAGTACGTG<br>AATCTCTACAACCAAAAGAACAAGGACGCCAGGCTGCCCCTGCTGAAACCCCTGTACAAGATG<br>ATCCTGTCAGATCGCGGAGCCCTGTCCTGGCTGCCTGAGGAGTTTGCCACCGACGAGGAAATG<br>CTGGCAGCTATCAACGAGACCCACGGAAACCTGAAGAACGTGATGACCGACGTGCGGAAGCT<br>GCTGCAGAACATCGATAGCTACGACACAGAGCACATTTATATCGCCAACGACAAGGGGCTGAC<br>TGACATCTCCCAGCAGATCTTCGGCCAGTACGACGTGTATACCTCTGCCATTAAGGCTGAGCTG<br>CGGGATAGCATCACCCCCAGCGCTAAGGAGCGCAAGGACCCAGAACTGCTGGAGAAGAGGAT<br>CAATGACATCTTCAAGGCCTCCAAGTCCTTCAGCATCGAATATCTGAATAGCCACGTGGACAGC<br>GACAAAACCATTCAATCCTACTACAAGGAGCTGGGCGCCTACGACAGGAATGGCGAGCAGCG<br>GATTAATCTGTTTTCCCAGATCGAGCTGGCCTACGTGGACGCCCACGATGTGCTGCTGGGAAAA<br>CATACCAATCTGAACCAGAGCGAGGATAGTATCAAGAAGATTAAAGCCCTGCTGGACGCCTAC<br>AAAGCACTGCTGCACTTCATCAAGCCCCTGCTGGGGAACCGGCGATGAGGCCGACAAGGACAAC<br>GAGTTTGATGCTAAGCTGCGCGCCATTTGGGACGAGCTGGACATCGTGACCCCTCTGTACGAT<br>AAAGTGAGGAACAGGCTGACAAGAAAGCCCTACAGTACGAGAAGATCAAACTCAACTTCGAT<br>AATGCCCAGCTGCTGAACGGGTGGGACATGAATAAAGAGCCAGACTGCACCTCCGTGCTGCTG<br>CGCAAGGACGGCCAGTACTATCTCGCAATCATGGACAAGAAGGACAACCACGCCTTCGATATC<br>GATGAGCTGCCTTGTAACGGAGAATGCTACGACAAGATGGACTACAAGCTGCTGCCTGGAGCA<br>AACAAAATGCTGCCCAAGGTGTTTTTTAGCAAGTCCAGGATCAAGGAGTTTGCTCCCTCCAAGG<br>AGATTTGCGACGCCTACCAGAAGGGAACTCATAAGAAAGGGGCCAATTTTAGCATCAAGGATT<br>GCAGAAGGCTGATTGACTTCTTCAAGGATAGCATTGCCAAGCACGAGGACTGGTCAAAGTTCC<br>CTTTTACCTTCTCCGACACCAGTACTTATGAGGACATCAGCGGCTTCTACAGGGAGGTGGAGCA |

TABLE S9B-continued

Human Codon Optimized Nucleotide Sequences Group 9

| SEQ ID NO | Corresponding AA | Sequence |
|---|---|---|
| | | GCAGGGCTACATGCTGGGGTATCGCAAGGTGTCAGTCAGCTTCATCAATCAGCTGGTGGATGA
GGGAAAGCTGTACCTGTTCCAGATTTGGAACAAGGACTTTAGCGAGTATTCAATGGGGACCCC
CAACATGCACACCCTGTACTGGAAGATGCTCTTCGATGAGCGGAATCTGGCCAACGTGGTGTA
CAAACTGAATGGCCAGGCCGAGGTGTTCTACCGGAAGAAAAGCCTAGACCTGAACAAGACTAC
CATCCATCGAGCCAACCAGCCAATCGCTAATAAAAACATGCAGAACGAGAAGAGAGAAAGTAC
CTTCTGCTACGATATCGTGAAAAACAGGAGATACACCGTGGACAAGTTCCAGTTCCACGTGCCG
ATCACAATTAACTTTAAAGCTACAGGGTCAGACAACATCAACGCCTCCGTCCTGGATGTGATCA
GAAACAACGGGATCGAGCATATCATCGGGATCGATCGGGGAGAGAGACACCTGCTGTACCTG
TCTCTGATCGACATGAAGGGCAATATTGTGAAGCAGATGACCCTGAATGACATTATTAACGAGT
ACAAGGGCAATACATATACCACCAACTACAAAGAACTGCTGCAGGCACGGGAGGGCGACAGA
AAAGAGGCACGGCAGAATTGGCAGAAAATCGAGAACATCAAGGAACTGAAGGAGGGCTATCT
GAGCCAGGTCGTGCACGTGATTACCAAGATGATGGTGGAGTACAAGGCCATCGTGGTCCTGGA
GGACCTGAATGGCGGCTTCATGAGGGGGCGCCAGAAGATCGAGAGACAGGTGTACGAGAAG
TTTGAGAAAATGCTGATCGACAAGCTGAACTACTACGTGGATAAGCAGAGAGACGCTAACGAA
AACGGGGGCCTGCTGCACGCCTACCAGCTGGCCAGCAAATTCGATACCTTCAAGAAACTCGGA
AAGCAGAGCGGTTGCCTGTTTTACATCCCAGCCTGGAACACCTCCAAGATCGACCCTGTGACCG
GATTTGTCAACATGCTGGATACCCGATATGAGAACGCCGACAAGGCCCGCAACTTCTTTTCCAA
GTTCAAGTCCATCAATTACAATGCTGACAAGAACTGGTTCGAGTTCGTGATAGACGACTACTCA
AAGTTTACGGACAAGGCCAAGGATACCAGAACCGATTGGGTGCTGTGCACATACGGCACCAG
GATCAAGACTTTCCGGAATCCTGAGAAGCTGAACCAGTGGGATAACAAGGAAATTGTGCTGAC
CGACGAATTCAAGAAAGTGTTTATGGAGGCCGGGATCGACATCAACGGCAACCTGAAAGAGG
CTATTTGCACTCTGACAGAGAAAAAGCATCTGGAGTCCCTGATGCAGCTGATGAAGCTGCTGGT
GCAGATGAGGAATTCTGAGACCAACTCTGAGGTGGACTACCTCCTGAGCCCCGTCGCCGACAC
CGAGGGACATTTTTATGACAGCAGAAACTGCGGGGACAATCTGCCCAAGGACGCCGACGCTAA
CGGCGCCTACAATATCGCAAGAAAGGGCCTGTGGGCCGTGATGAAGATTAAGGCCAGCAAGC
CCCAGGAGAATCTGAAGCTTGGAATCTCTAACAAGGAGTGGCTGCAGTTCGCTCAGGAAAAGC
CTTACCTGAACGACTAA |
| 178 | 138 | ATGAAGAACATCCTGGAGCAGTTTGTGGGCCTGTACCCCTGTCTAAGCACTCAGATTTGAAC
TGAAGCCCCTGGGCAAAACTCTGGAGCACATCGAAGAAAAGGCCTGATCGCCCAGGACGAG
CAGAGGGCCGAAGAGTACAAGCTGGTGAAGGACATCATTGACAGATACCATAAGGCCTTTATC
CACATGTGCCTGAAGCACTTCAAGCTGAAGATGTACAGCGAGCAGGGGTATGATTCCTGGAG
GAGTACAGAAAGCTGGCTAGCATCTCTAAGCGAAACGAGAAGGAAGAACAGCAGTTCGACAA
AGTGAAAGAGAACCTGAGAAAGCAGATCGTGGACGCCTTCAAAAACGGAGGAAGCTACGACG
ACCTGTTCAAGAAGGAGCTGATTCAGAAGCATCTGCCTAGATTCATCGAGGGCGAGGGCGAG
GAGGAGAAGCGGATCGTGGATAACTTCAACAAGTTCACCACCTACTTCACCGGCTTCCACGAG
AACAGGAAGAATATGTACTCCGACGAGAAGGAGAGCACCGCAATCGCCTACCGGCTGATTCAC
GAGAATCTGCCTCTGTTCCTGGACAACATGAAGAGCTTTGCCAAGATTGCCGAAAGCGAAGTG
GCTGCCCGGTTTACCGAGATAGAAACAGCCTACCGGACCTACCTGAATGTGGAGCACATCTCTG
AGCTCTTTACCCTCGATTACTTTTCAACCGTGTTGACACAGGAGCAGATTGAGGTGTACAACAA
TGTGATCGGCGGGCGGGTGGATGATGACAACGTGAAGATACAGGGCCTCAACGAGTACGTGA
ACCTGTACAACCAGCAGCAGAAGGACCGGAGCAAACGGCTGCCCCTGCTGAAGAGCCTCTATA
AGATGATCCTGAGCGATAGGATTGCTATTTCCTGGCTGCCAGAAGAATTCAAGAGTGATGAGG
AGATGATCGAAGCCATCAACAATATGCATGATGATCTGAAAGATATCTCTGGCCGGAGATAACG
AAGATTCACTGAAGTCTCTGCTGCAGCACATCGGACAGTATGACCTGTCTAAGATCTACATTGC
CAATAACCCAGGCCTGACCGATATCTCTCAGCAGATGTTCGGATGCTACGACGTGTTCACCAAC
GGAATCAAGCAGGAACTGAGAAACTCCATCACCCCAACCAAGAAGGAGAAGGCCGATAACGA
GATCTACGAGGAGAGGATCAATAAGATGTTCAAGAGCGAGAATCATTCAGCATCGCCTACTT
GAACTCCCTGCCTCACCCAAAGACTGATGCTCCCCAGAAGAACGTGGAGGACTATTTCGCTCTG
CTGGGGACCTGTAATCAGAACGACGAGCAGCAGATCAATCTCTTTGCTCAGATTGAGATGGCC
AGACTGGTGGCCTCCGACATTCTGGCCGGAAGGCATGTGAATCTGAATCAGAGCGAGAATGAT
ATTAAACTGATTAAGGATCTGCTGGACGCCTATAAAGCCCTGCAGCACTTCGTGAAACCACTGC
TGGGCAGCGGCGATGAGGCTGAGAAAGACAACGAGTTTGATGCTCGACTGAGGGCCGCGTGG
AACGCTCTGGATATTGTGACCCCTCTGTACAACAAGGTGCGAAACTGGCTGACCAGGAAGCCTT
ACAGCACCGAGAAAATCAAACTGAATTTCGAGAATGCCCAGCTGCTGGGCGGCTGGGATCAAA
ATAAGGAGCCAGACTGCACATCCGTGCTGCTGAGGAAGGACGGGATGTACTACCTTGCCATCA
TGGACAAGAAAGCCAACCACGCCTTCGACTGTGACTGTCTGCCCTCCGATGGGCCTGCTTCGA
GAAAATCGACTACAAGCTGCTGCCTGGCGCCAACAAAATGCTGCCAAAGGTGTTCTTCTCCAAG
TCTCGCATTAAGGAGTTCTCTCCCTCTGAGAGCATCATCGCCGCCTACAAGAAGGGAACCCATA
AGAAGGGCCCAAATTTCTCTCTGAGCGACTGCCACCGGCTGATCGACTTTTTCAAGGCATCAAT
CGATAAACACGAGGATTGGTCTAAATTCCGGTTTCGGTTCTCCGACACCAAAACTTACGAGGAC
ATCTCCGGATTTTACCGCGAGGTGGAGCAGCAGGGCTACATGCTGGGTTTCAGGAAAGTGAGC
GAGACTTTTGTGAATAAGCTGGTGACGAGGGCAAGCTGTATCTCTTTCACATCTGGAATAAA
GACTTCAGTAAGCACAGCAAGGGCACACCCAACCTGCATACCATCTACTGGAAGATGCTGTTCG
ACGAGAAGAACCTGACTGACGTGGTGTACAAGCTGAACGGCCAGGCCGAGGTCTTCTATAGAA
AGAAATCTCTGGACCTGAATAAAACTACCACTCACAAGGCCCACGCCCCTATCACAAACAAGAA
CACCCAGAACGCCAAGAAGGGGTCCGTGTTCGACTATGACATCATCAAGAATCGCCGGTATAC
AGTGGATAAGTTCCAGTTCCACGTGCCAATCACTCTGAATTTTAAGGCAACCGGCCGGAATTAC
ATCAATGAGCACACCCAGGAAGCCATCAGGAACGAGGATCGCCTCATCATCGGCATCGAC
AGAGGCGAGCGGCATCTGCTCTACCTGAGTCTGATCGATCTGAAGGGAAACATCGTGAAGCAA
ATGACTCTGAACGATATTGTGAACGAGTATAACGGGCGGACCTACGCCACCAATTACAAGGAT
CTGCTGGCCACCCGGGAGGGAGAGAACAGATGCACGCCGCAACTGGCAGAAAATCGAAA
TATTAAGGAGATTAAGGAAGGGTACCTCTCTCAGGTGGTGCATATCCTGTCTAAGATGATGGT
GGATTATAAGGCAATCGTGGTGCTGGAGGATCTGAACACCGGCTTCATGAGGAGCCGGCAGA |

TABLE S9B-continued

Human Codon Optimized Nucleotide Sequences Group 9

| SEQ ID NO | Corresponding AA | Sequence |
|---|---|---|
|  |  | AAATTGAGAGACAGGTGTATGAAAAGTTTGAGAAAATGCTGATCGACAAGCTCAATTGCTATG TGGATAAGCAGAAGGATGCCGACGAGACTGGGGGGCCCTGCACCCCCTGCAGCTGACCAAC AAGTTCGAGTCCTTCCGGAAACTGGGAAAACAGAGTGGCTGGCTGTTCTATATTCCAGCATGG AACACCAGTAAGATCGACCCCGTGACAGGATTCGTCAATATGCTGGACACCCGCTACGAAAAT GCCGACAAGGCAAGATGCTTCTTCTCCAAGTTCGATAGCATCAGGTACAACGCCGACAAGGAC TGGTTCGAATTCGCAATGGACTACAGCAAATTCACTGATAAGGCCAAGGACACTCATACATGG GGACTCTCTGTAGCTACGGCACAAGAATCAAGACCTTCAGAAACCCCGCCAAGAACAATCTGT GGGACAACGAGGAAGTGGTGCTGACAGATGAGTTCAAGAAGGTGTTCGCCGCCGCCGGCATC GACGTGCATGAGAATCTGAAGGAGGCAATTTGCGCCCTGACCGACAAAAAGTACCTGGAACCC CTGATGCGCCTGATGACACTGCTGGTCCAGATGAGGAATTCCGCCACCAACAGCGAAACCGAT TACCTGCTGAGTCCAGTGGCCGATGAGTCTGGCATGTTTTATGATTCCCGGGAGGGCAAGGAA ACTCTGCCAAAGGACGCCGACGCCAATGGGGCCTATAATATCGCCAGGAAAGGCTTGTGGACT ATCAGAAGGATCCAGGCCACCAATAGCGAGGAGAAAGTGAACCTCGTGCTGAGCAACAGAGA ATGGCTGCAGTTCGCCCAGCAGAAACCATACCTGAATGATTGA |
| 179 | 139 | CTGACCAGGAAGCCCTACAAGACCGAGAAAATCAAGCTGAACTTTGAGAATTCCCAGCTGCTG GGCGGCTGGGACGTGAACAAGGAGCCAGATTGCACCTCAGTGCTGCTGAGAAAAGATGGCAT GTACTACCTGGGCATCATGGATAAAAAGGCAAACAAGAGTTTCTACTGCGATTGCCTGCCATCA GAGGGCAGCTCTTACGAGAAGGTGGACTACAAACTGCTGCCAGGGGCCAACAAAATGCTGCC CAAGGTTTTCTTTTCCAAGAGCCGGAAGTCGGAGTTCGCCCCTAGCGAAGTGATCACAAAGGC CTACGAGAACGAACACACAAGAAGGGGGCTAACTTTAGCCTCTCAGATTGTCACAGGCTGAT CGACTTTTTCAAGGCCAGTATTAATAAGCATGAGGACTGGAGCAGGTTCGGCTTTATCTTCTCT GAAACAAATACTTACGAGGATATGGTGGGCTTTTACAGGGAGGTGGAGCAGCAGGGCTACAT GCTGGGCTTTAGGAACGTGTCCGAGGAGTACATTGATCGGCTGGTTGACGATGGGAAACTGTA CCTGTTTCAGATCTGGAACAAAGACTTTAGTGAGCACTCCAAGGGCACCCCCAACCTGCACACA ATCTACTGGAAGATGCTGTTCGACGAACGCAACCTGGAGAACATCGTGTATAAACTGAACGGA CAGGCTGAGCTGTTTTACAGGAAGAAGAGCCTGGATCTGTGCAAGACCACCGTGCACAAGGCC CACCAGTCTGTGGCCAATAAGAACCCTCAGAATGACAAGCGGGAGTCTATTTTTGAATACGACA TTATTAAGAACAGACGCTATACTGTGGACAAGTTCCAGTTTCACGTGCCCATTACTATTAACTTC AAGGCCACAGGGGATGACAGACTGAATAGCGCCACCCTGGAGGCCATTAGGGACGGAGGCAT CGAACACATCATCGGCATTGATAGAGGCGAACGCCACCTGCTGTACCTGAGCCTGATCGACCT GAAAGGCAATATCGTGAAGCAGTTCACCCTGAACGAGATCGCCAGCAGAATACAACGGCGCCC CTGTCCTCCAACCAACTATAAGGATCTGCTGGTGGCCCGGGAAGGGGACAGAAACGAGGCCC GGAGAAATTGGCAGAAGATCGAGAACATCAAAGAAATCAAGGAAGGGTACCTGTCACAGGTC GTGCATATTATCGCCAAAATGATGGTGGAGTACAAGGCCATCGTGGTGCTGGAGGACCTGAAC ATGGGCTTTATGAGAGGTAGACAGAAAGATCGAACGCCAGGTGTACGAAAAGTTCGAGAAGAT GCTGATCGATAAGCTGAATTGCTACGTGGATAAGCAGAAGGAGGCCACCGATATCGGCGGAG TGCTGCACCCACTGCAGCTGACAAGCAGATTCGAAAGTTTTTCGGAAGCTGGGAAAGCAGAGCG GATGGCTGTTTTACATTCCTGCCTGGAACACTAGCAAGATTGACCCTGTGACCGGCTTCGTGAA TATGCTGGACACACGGTACGAACGTGGACAAAACTAGATGCTTCTTCTCTAAGTTTGACGTG ATTCGCTATAACGGGGACAAGGACCTGTTCGAGTTCACATTTGACTACGATAAGTTTACAGACA AAGCCAAGGGAACCAGAACTAAGTGGACACTGTCACCTACGGCAGCAGAATTAAAACTTTCA GAAATCCAAAGAAGAACAATCAGTGGGACAACGAGGAAATCGTGCTCACAGACGAGTTCAAG AAGGCCTTCGCCGACGCCGGCATTGACATCGAGGGCAATCTGAAAGATGCCATCTGCAGCCTG ACGGAGAAGAAGCACCTGGAGCCTCTGATGAACCTCATGAAGCTCCTGCTGCAGATGCGGAAC AGTAAGACCGGCACCGAGATCGACTATCTGTTGAGCCCCGTGGCTGATGCAGACGGAAACTTC TACGACAGCCGCAACGAGATCTCCACCCTGCCCAAGGACGCTGACGCCAACGGCGCATACAAC ATCGCCCGGAAGGGCCTGTGGGCCATCCGGAAGATCCAGAGCGCACCATCCGGAGAGAAACC CAATCTGGCCATTAGCAACAAAGAGTGGCTGCAGTTTGCCCAGCAGAAGCCCTATCTGGATGA CTAA |
| 180 | 140 | ATGAACACATTTAACCAGTTCACCAACCTATATAATGTGCAGAAGACCCTTTGTTTTGAGCTCCA GCCCGTAGGAAAAACTAGGGAGAACATCGAGGAGGACGGATTACTCAAACAGGACGAAGAG AGAGCCGAGAACTACAAGAAGGTGAAAGGCTTCATAGATGAATACCATAAGCAGTACATTAAG GACCGCCTTTGGAATTATGAACTGCCTCTGAAAGGTGAGGGCAAACGCAACAGTCTGGAGGAG TACCAACAGTTTTACGAGCTGTCCAAGCGGGACGCAAATCAGGAGGCAACTTTCACAGAAATC AAGGATAACCTGCGCGCTATCATAGCTAAAAGACTTACCGAAAAGGGCTCGGCATACGAGCGG ATTTTCAAAAAGGAACTGATCCGGGAGGACCTCATTGAATTTCTCGATAAGGAAGAAGACAAG GAGCTGGTGAGACAGTTCTCCGATTTCACTACCTATTTCACCGGGTTTCATGAAAATCGCGCAA ACATGTATAAAGATGAGGAACAGATACGTCTATCGCTTACCGACTCATCCATCAGAATCTGCC GAAGTTCATGGATAATATTAAGGCATTTTCGGCAATAGCCCAGACACCAGTTGCGGAACACTTC AAGGAACTGTATGCTCGTTGGGAGAGTTATTTGAATGTTAGTTCCATCGACGAGATGTTCAGAC TGGATTACTTTTCTCATACCCTGACTCAGCCTCATATAGGGTACAATTCCATAATTGGCAAG AGAATCTTGGAGGATGGGACAGAGATCAAGGGGATTAACGAATATGTCAACCTCTACAACCAG CAACAAAAGGACAAAAAGCTCCCCTTGTTTGTGCCCCTGTACAAACAGATACTGTCAGACAGG GAACGACTGAGCTGGCTGAGTGAGGAGTTCGATAGCGATGCTAAAATGCTCAAAGCCATCAAT GAGTGCTATGATCACCTGCACGATCCTGATGGGCAAAGAGAACGAAAGCCTCTGCGAGCTT CTGAAGCATTTGACGGATTTCAACCTCTCACAGATTAATATCACCAACGACCTGTCTCTTACTGA TATTAGCCAAAGCATGTTTGGGCGTATGATGTTTTTACCACGGGGTTGAAAAATACCCTTAAG ATCTCCACACCACAAAAGCGCGATGAGAAGGAGGAAGCTTACGAGGACAGAATTACTAAGCTG TTTAAAGCGTGCAAGAGCTTTTCAATCGCAGAGCTCAATGGTTTGCAACTACCGGTCGCAGAGG ATGGAGGGCACAAAAGAGTAGAAGACTATTTCATAAGCCTGGGCGCTGTCGGAAAAGAAAAA AATCTGTTCGAACAGATCGAGGAGGCCTATACTGAGGCTCTCCCATTCTGCAGCTTAAAGAAA CAGACGATACACTCAGCCAGAACAAGGCTGCTGTGGCCAAAATTAAGGATCTCTTGGACGCCT |

TABLE S9B-continued

Human Codon Optimized Nucleotide Sequences Group 9

| SEQ ID NO | Corresponding AA | Sequence |
|---|---|---|
| | | TTAAAAATCTACAGCACTTTGTGAAGCCCTTGCTTGGTTCCGGCGAAGAAAACGAAAAAGACG<br>AAGTGTTTTATGGGGCCTTTCAGACATTATGGGATGAGTTGGATGCAGTCACCCCCCTCTATAA<br>TAAAGTAAGGAACTGGCTGACTAGGAAACCTTACAGCACGGAGAAAATTAAGCTGAATTTTGA<br>CAACGCGCAACTCCTAGATGGGTGGGACGAAAACAAAGAAACAGCCAATGCTTCAATTATCCT<br>TTGTAAGGACGGGTTTTATTACCTGGGTATCGTTAAAAAGGACAATCGGAAACTATTGGGCAT<br>GCCCATGCCTTCCGACGGCGAATGTTATGATAAGGTCGTCTACAAGTTTTTCAAAGACATCACC<br>ACAATGGTGCCTAAATGCACAACTCAAAAGAAGGATGTCGTCGCACATTTCGCACACTCCAACG<br>AGGATTACATTCTGTTCGACAAAAAGACCTTCAATGCACCAGTGACGATTACCAAGGAGATCTA<br>CGAGCTCAACAATATTCTGTATAACGGCGTTAAGAAGTTTCAGATTGAGTACCTTCGTTCTACTG<br>GGGATAAGTCTGGATACGAGCATGCTGTCTTCACTTGGAAGACCTTTTGTCTCCAATTCCTGAA<br>AGCCTATAAATCTACCAGCATCTATAACCTAAAGTTAGTGGAGCAACACATCGACTCCTACTAC<br>GATCTGTCTAGTTTCTATTCTGCCGTTAATCTGTTGTTGTACAACCTGAGTTATCGGAAGGTTTCT<br>ATGTCATACGTTCATTCATTGGTCGAGGAAGGAAAACTGTTTTTGTTCCGAATCTGGAACAAGG<br>ATTTTTCCGAGTACAGCAAGGGCACACCAAATCTTCACACCCTGTATTGGAAAATGTTGTTCGA<br>CGAAAGAAATCTTGCCGACGTGGTATTCAAACTGAATGGTCAGGCTGAAGTGTTCTACAGAAA<br>GGCCAGCATTAAGCAGGAGAATAGAATTATTCACCCGGCCCACCAGGCTATCAACAATAAGAA<br>CCCACTCAACAGAACCCCTACCAGCACATTCGACTACGATATCATCAAAAATAAGCGCTACACA<br>GTGGACAAGTTCTTATTCCACGTGCCGATTACCATTAATTTTAAGGCCAAGGGACTGACGAATA<br>TTAATCCACTTGTCCTTGACGTTATCCGGAAGGGTGGCTTCTCACATATTATTGGCATCGATCGG<br>GGGGAACGTCACCTCTTGTACCTGTCACTGATCGACTTAAAAGGCAACATCGTTAAGCAGATGA<br>CTTTGAACGAAATTATCAACGTGTACCGGGAGCAAACATATGTGACAAATTATCACAACCTACT<br>GGCCCAACGAGAGGGAGATCGCACCAAAGCACGAAGGAGCTGGGACACTATCGAAAACATTA<br>AAGAACTCAAAGAGGGATACCTGTCTCAGGTCGTGCATGTGATCAGCAAGATGGTGGTTGAGT<br>ACCACGCGATAGTCGTGCTGGAAGATCTTAATATGGGATTCATGCAAAGTAGGCAGAAGATCG<br>AGAGGCAGGTGTACGAAAAATTCGAGAAGATGCTGATCGATAAACTCAACTGCTACATATACA<br>AACAGGTCGATCCCACATCGGAGGGAGGTGTGTTACACGCTCTGCAGCTTACCAACAAGTTCG<br>AGAGCTTTCGGAAGCTGGGAAAGCAAAGTGGTTGCCTCTTCTATATCCCTGCCTGGAATACAAG<br>CAAAATAGACCCCCTAACTGGCTTTGTGAACTTCATAAACCCCAAGTATGAATCTATTCAGGCG<br>GCCAGGGATCTCATCGGCAAGTTTGAGGACATCCGATACAACCCAGAAAAGAACTATTTCGAG<br>TTCCACATCAAAGACTACGCTGCGTTCAACCCAAAGGCCAAATCTTCAAGACAGGAGTGGGTG<br>ATCTGTACTAAGGGGACTAGGATTAGGACGTTTAGGAACCCTGACAAAAACAACGAGTGGGAC<br>AGTGAGGAAATAGTACTGACCGAGAAGTTTAAGGAGCTGTTTGACTCCTACGGCATTGACTAC<br>AGGTGTAATCTGTTAGCGAGCATACTAATCCAGACAAAGAAAGACTTTTTCCATAATGAGGACG<br>TGAAGAAGCCTTCTCTGCTGTCACTCCTGAAATTAACCCTTCAGTTACGCAACTCCCACATAAAT<br>TCCGAGGTAGACTATATTCTCTCACCAGTAGCCGACGCCAAAGGATCCTTTTATGACTCCCGCAC<br>CTGCGGTTCTAGTCTGCCCAATAATGCCGACGCCAATGGGCCTTTAACATTGCACGTAAGGGC<br>CTGATGTTAGTGGAACGCATCCGGTCCATAAAAGATGATGAAAAACCTGCCTTAACTATCACCA<br>ATGAAGAATGGCTGCATTATGCCCAGGCTCAGTGA |
| 181 | 141 | ATGAAGTCTCTGACCAATCTGTACCCCGTGAGCAAGACTCTGAGGTTCGAGCTTCAGCCTATTG<br>GAAAGACTAAGGAGAACATCGAAAAGCACGGGATCCTGTCTCGGGACGAGCAGCGGGCTGAG<br>GATTATATTACCGTGAAGAAGTACATTGACGAGTACCACAAGCAGCTGATCAAGGATCGGCTC<br>TGGAACTTTAAGCTGCCCATGAAGAGCGACAGCAAGCTGAACTCCCTCCAGGAATACCAGGAA<br>CTGTACGAGCTGTCCAAGAGACGCCTGCCAGGAGGACAGATTTACCGAGCTGAAGGACAA<br>CCTGCGGGCCATCATCGCCAAGCAACTGACTGGGGGGACCGCTTATGGTCGGATTTTCAAGAA<br>GGAGCTGATTCGAGAGGACCTGATCGACTTCCTGACCCAGGAGGAGGAGAAGGAGACAGTGC<br>GCCAGTTCGCCGATTTCACAACTTACTTCACTGGCTTCCACGAGAACAGGAAGAACATGTACAG<br>TGCCGAGGAGAAGTCTACCGCTATCGCCTACCGGCTGATCCACCAGAACCTGCCTAAGTTTATG<br>GACAACATGAAGGCCTTCGCCAAAATCGCCAAGAGTCCTGTCGCCGAAAAGTTTGCCAACATTT<br>ACAAGGAGTGGGAAGATAGCCTCAACGTGTCCTGCCTTGAGGAAATCTTCCAGCTGGACTATTT<br>CTCCGAAACTCTGACCCAGCCCCATATCGAGGTGTACAATTACATCATTGGCAAGAAGACCAAG<br>GAAGACGGCAATGACGTGAAGGGCATCAATGAATATGTGAATGAGTACAACATGAGGCACAA<br>GGACAACCCTCTGCCTCTGCTTGTGCCCCTGTACAAACAGATCCTTAGCGATAGAGAAAAGCTG<br>TCCTGGATCGCCGAGGAGTTTGATTCCGACGAGAAGATGCTGTCCGCGATTAACGAGAGCTAC<br>AACTCCCTGCATGATGTGCTGATGGGCAAGAGAACGAGAGCCTGAGGTCTGTGCTGCTGCAC<br>ATTAAGGACTACAACCTGGAGAGGGTGAATATTAACTCAGAGTCCCTGACCGACATCAGCCAG<br>CACATCTTTGGCAGATACGACGTCTTCACCAATGGTATTAAAGCCAAGCTGCGCGGAAAGAACC<br>CCAAGAAAGGAATGAGTCTGACGAAAGCTTTGAAGACAGAATCACAAAAATCTTTAAGACCC<br>AAAAGAGCTACAGCATCGCCTACCTGAACAACCTGCCCCAGCCCACCATGGAGGATGGAAGGG<br>TGAGAACAATTGAGGATTATTTCATCAGCTTGGGCGCCATCAACATCGAGGCAAAGCAGAAGA<br>TCAATCTGTTCGCCCAGATTGAGAACGCATACCACGACGCCTTCACCATTCTGAAGAGGACCGA<br>CACCGACGACACTCTCTCCCAGGATAAGAAGGCAGTGGAGAAGATCAAAGTGCTGCTGGATGC<br>CTTCAAGGACCTGCAGCACTTTATCAAGCCCCTGCTGGGCTCTGGCAGGAAAATGAGAAGGA<br>TGAGCTGTTCTATGGCATCTTTCAGCTGATCTGGGACGAGCTGGAGGCTATCACCCCACTGTAT<br>AACAAGGTGAGGAACTGGCTGACCCGCAAGCCATACAGCACAGAGAAGATCAAGCTGAACTTC<br>GATAATGCCCAGCTGCTGGACGATGGGATGAAAACAAGGAAACAGCTAACGCCTCAATTATC<br>CTGTGCAAAGACGGCCTGTACTACCTGGGGATCCTGAACAAAGATTACCGGAAGCTGCTGGGG<br>ATGCCTATGCCAAGCGAGGGCGACTGCTACGATAAGGTGGTGTACAAGTTCCTGAAAGACATC<br>ACCACGATGGTGCCAAAATGTACTACTCAGAAGGAAGTGGTGGCCCACTTTGGCCAGAGT<br>GTGGAGGATTACGTCCTGTTCGATCCCAAGACCTTCAATGCCCCTGTGACCGTGACTAAGGAGA<br>TCTTTGACCTGAACAATGTGCTGTACAATGGGGTGAAGAAGTTCCAGATCGAGTATCTGCGCA<br>GCACTGACGACTCACTGGGCTACGAGCACGCCGTGTCCACCTGGAAGAGCTTCTGCATGCAGT<br>TTCTTAAAGCCTACAAGTCTACTAGTATCTATAACCTGGCCTCCGTGGAGCAGAAGATGAACTC<br>TTACTCTGACCTGTCCAGCTTCTACAAAGCCGTGAATCTGCTCCTGTATAACCTCAGCTATAGGA |

TABLE S9B-continued

Human Codon Optimized Nucleotide Sequences Group 9

| SEQ ID NO | Corresponding AA | Sequence |
|---|---|---|
| | | AGGTGAGCGTGGATTACATTCACAGCCTGACCGAGGAGGGCAAACTGTATCTGTTCAGAATCT<br>GGAATAAAGACTTCTCCGAGTTTAGCAAAGGAGCTCCCAACCTGTTTACCCTGTATTGGAAGAT<br>GATCTTCGACGAACGGAACCTGGACAACGTGGTGTACAAACTGAACGGCCAGGCCGAGGTGTT<br>TTTCCGCAAGAGCAGCATTAAGCCCGAGAACAGAGTGATCCACCCCGCCCACAGACCCATCGA<br>CAATAAGAACGAGCAGAACAAGAAACGGACCAGCACCTTCAAATACGACATCATTAAGGATTA<br>TAGATATACAGTGGACAAGTTCCAGTTCCACGTGCCAATCACTATTGGCTTTAAGAGCGAAGGA<br>CAGACAAATATCAATTCCCGGGTGCAGGATATTATCCGGAGAGGGGGGTTTACTCATATCATC<br>GGCATCGACAGGGGCGAGCGCCACTTACTTTACCTGTCCCTGATAGACCTCCGCGGCAACATCG<br>TGATGCAGAAGACTCTGAATGTGATCTCTCGGGAAGTGCGGGGCGTGACCTATAGCACAAACT<br>ACCGGGACATGCTGGAGAAGAGAGAAGGTGACAACAAAGAAGCCAGGCGGTCTTGGGGCGT<br>GATTGAGAGCATCAAGGAGCTGAAGGAGGGCTACCTGAGCCAGGCCATCAGGGAGATCGCCA<br>ACATGATGGTGGAGTATAATGCCATCGTGGTGCTGGAAGACCTGAACCAGGGCTTCATGCGCG<br>GCAGACAGAAAATCGAACGGCAGGTCTATGAGAAGTTCGAGAAGATGCTGATTGACAAGCTG<br>AACTGTTACGTGGACAAGCAGATCGCCCCTAGCAGCATCGGCGGCGCCCTGCATCCCCTGCAG<br>CTGACCAACAAGTTTGAGAGCTTCCGGAAGCTGGGAAAACAGAGTGGCTGCTTGTTTTATATTC<br>CGGCCTGGAACACCTCCAAGATCGACCCTGTGACCGGCTTCGTGAATCTCTTCGACACACGCTA<br>CGACACCAGGGAGAAAGCTCGCATGTTCTTCAGCAAATTCAAAAGAATTAAGTTCAACACAGA<br>GAAGGATTGGTTCGAGTTCGCCTTCAACTACAACGACTTCACCTCCAAGGCTGAGGGGACTAG<br>GACAGAATGGACCCTCTGCACCTACGGGGAGAGAATCAGGCAGTTCAGAAACCCCGAGAAGA<br>ACCACAACTGGGACGACGAGACCATCGTGCTGACAGACGAGTTCAAAAGACTGTTCTGTGAGT<br>ACGGCATTGATATTCATGGCAACCTGAAGGAGAGCATTGTGGCTCAGTCCGATGCCAAATTCTT<br>CCGCGGCCTGCTGGGTCTGATGAAGTTGCTGCTGCAGATGAGGAACTCCATCGCCAATTCCGA<br>GGAGGATTACCTGCTCTCTCCCGTGATGGATGAAAAGGGGTGTTTCTTTGACTCACGCGATAAT<br>GACGGAACCCTACCAGAGAACGCCGACGCCAATGGCGCCTACAACATCGCAAGAAAAGGCCT<br>GTGGATTATCCGGAAGATCCGGGAAACCGCCGAGAATGAGAAGCCCAGCCTGAAAATCACCA<br>ATAAGCAGTGGCTGCTGTTCGCCCAGAGCAAGCCTTACCTGAACGACTGA |
| 182 | 142 | ATGAACACCAGCAACCTGTCCAGATTCACCAATCTGTACAGCATTTCCAAGACCCTGAGGTTTG<br>AGCTTCAACCTCTGGGCAAGACCAAAGACTACATTGAGAAGAATGGGATCCTCATGCGCGACG<br>AGAAGAGGGCCGAGGACTACAAGACCGTGAAGGGCATCATCGACGAGTACCACAAGAAGTAT<br>ATCAAGTCCCGCCTGTGGGACTTTAAGCTGCCACTGGCAAGCGAGGGAAAGCGGGATAGCCTG<br>GAGGAGTACAAAGCCCTGTACGAGGTTAGCAAGAGATCCGAAGCCGACGAGGCCGCCTTCAA<br>AGAGGTGAAGGATAACCTGAGGAGTATCATTGCCAAGAGACTGACTAGCGGCAAGGCTTACG<br>AGACTATCTTCAAGAAGGAGCTGATCAGAGAGGACCTTATTAATTCTCTGGAGGATGAGGTGG<br>AGAGAGAAATTGTGTCCCAGTTCGCCGACTTTACCACCTACTTCGGCGGCTTCCATGAGAATAG<br>AAAGAACATGTACGATGCCGGAGAAAAATCTACCGCCATCGCCTACCGCCTGATCCATCAGAA<br>CCTCCCTAAGTTTATGGATAACATGAAGGCTTTCGCCAAAATTGCCGAGACATCCATCGCCGAA<br>CACTTCGCAGACATCTATGAGGGCAGCAAGGAGATGCTGAACGTCGGGAGCATCGAGGAAAT<br>CTTTAGACTGGATTACTTCTCAGAGATCCTGACTCAGCCTCACATCGAGGTGTACAATAGCATTA<br>TCGGAAAAAAGGGTGCTGGAGGATGGAACTGAGATTAAGGGAATTAACGAGTATGTGAACCTG<br>TACAACCAGCAGCAGAAGGATAAGAGACTGCCACTGCTCGTGCCCCTGTATAAGCAGATCCTG<br>AGCGACAGAGAGAAGCTGTCCTGGCTGGCCCGAAGAGTTTGACTGTGATGAAAAGATGCTGGC<br>AGCCATCAACGAAACCTACGCCCATCTGCACGACCTGCTGATGGGGAACGAGAATGAGAGCCT<br>GAGATCACTGCTGCTGCACCTCCGGGACTACGACCTGGAGCAGATCAACATATCAAACGACCT<br>GTCTCTGACAGACATATCTCAGCATCTGTTTGGCCGGTACGATGTGTTCACAAATGGCATCAAG<br>GAGGAGCTGAGAGTGATCACACCCAGAAAGAGGAAAGAGACTGACGAACAGCTGGAGGACA<br>GGATTAGCAAGATCTTCAAGACACAGAAAAGTTTCTGCATTGCCTTCCTCAACTCCCTGCCCCAG<br>CCAGCCATGGAAGATGGCAAGGCCCGCTGTATTGAGGACTATTTTATGGCCCTGGGCGCCGTG<br>AACAACGAAACCACTCAGAAAGAGAACCTGTTCGCCCAGATCGAAAACGCCTATGAGAACGCC<br>AAGTCCGTGCTGCAGATGAAGGAAACCGGCGACATGCTGAGCCAGAACAAACCCGCCGTGGC<br>CAAGATCAAGGCCCTGCTGGACGCTCTGAAGGACCTGCAGCACTTCATTAAACCCCTGCTGGGC<br>TCCGGAGAGGAGAACGAGAAGGATGAGCTGTTTTATGGCTCTTTTCAGATGATGTGGGATGAG<br>TTGGACGCCGTGACCTCACTGTACAACAAAGTGCGTAACTGGCTGACCAGAAAGCCATACAGC<br>ACAGAGAAGATCAAACTGAATTTCGATAACGCCCAGCTGCTGGACGGATGGGACGAGAATAA<br>GGAAACCACCAACGCCTCCATCCTGCTGTACAAGGACGGAAACTACTACCTGGGGATCATCAA<br>GAAGGAGGATAGAAAGATTCTGGGCAGCCCTATGCCTACAGACGGGGAGTGCTATGATAAGG<br>TGGTCTACAAGTTTTTTAAAGACATCACCACCATGGTCCCCAAGTGTACAACCCAGAAGAAGGA<br>CGTGATCGCTCACTTCATGCACTCTGATGATGATTACATTCTGTATGACAAGAAAACCTTCGATG<br>CCCCAGTGACCATCACCAAGGAGATCTATAACCTGAACAACGTGCTGTACAACGGGGTGAAAA<br>AGTTTCAGATTGAGTACCTGCGGTCCACTGGAGACAAGAGGGGCTACGAACACGCCGTGTTCA<br>TCTGGAAGTCTTTCTGCATGCACTTCCTGAAGGCCTACAAGACCAAGTATCTACAACCTGGT<br>GCTGGTGGAGCAGCAGATCAACTCCTATTACGATCTGTCTAGCTTTTATAATGCTGTGAATCTTC<br>TGCTGTACAACCTGTCCTACCGGAAAGTGAGCGTGAATTACATTCACAGCCTGGTGGACGAGG<br>GCAAGCTGTACCTGTTTAGGATCTGGAATAAAGACTTCAGCGAGTACAGCAAGGGGACCCCA<br>ACCTGCATACACTGTACTGGAAAATGCTGTTCGACGAGCGGAACCTGGCAGATGTTGTGTATA<br>AGCTCAACGGCCAGGCCGAGGTGTTCTATAGAAAGAGTTCTATCCAGCCTGAGCATCGGATCG<br>TGCATCCAGCCGGCAAACCCATCGCAAACAAGAACGAGCACAGCAAAGAGCCAACCAGCACTT<br>TCAAGTATGACATCGTGAAGGACCGCAGATACACCGTGGACAAATTCCAGTTTCATGTCCCTAT<br>CACCATCAACTTTAAGGCAGCCGGGCAGGAGAACATCAACCCCGTGGTGCTGGACGCTATTAG<br>GCGGGGAGGCTTCACCCACATTATTGGCATTGACCGGGGAGAGGCATCTGCTGTACCTGAG<br>TCTTATCGACCTGCAGGGAAACATCGTGGAGCAGATGACCCTCAACGAGATCATCAACGAATA<br>TAAAGGCCTGAAACACAAGACTAACTATCATGACCTGCTGGCCAAGGGGAGGGCGAGAGAA<br>CAGAGGCCCGAAGGTCATGGGACACCATCGAGAATATCAAAGAAATGAAAGAGGGCTACCTG<br>AGCCAGGTGGTGCATATCATCAGCAAGATGATGGTGGAGTACAACGCTATTGTGGTGCTCGAA |

TABLE S9B-continued

Human Codon Optimized Nucleotide Sequences Group 9

| SEQ ID NO | Corresponding AA | Sequence |
|---|---|---|
| | | GATCTGAACACTGGATTCATGAGAAGCAGACAGAAGATTGAGAGGCAGGTGTACGAGAAGTT CGAGAAGATGCTGATCGATAAGCTGAACTGTTACATCGACAAACAGGTGGGCGCTAGCGATAT CGCCGGCCTGCTGCACCCACTGCAGCTGGCTTGCGAAGCAAAAAAATGGAAGAGAAGCCACCA GTGCGGGTGCCTGTTCTACATCCCTGCCTGGAACACCTCCAAGATTGATCCCGTGACAGGCTTC GTGAACCTGTTTGACACTAGGTACGAGAACGCCGCCAAGGCCAAAGCCTTCTTCGGCAAATTC GGTTCCATCAGATACAATGCCGAGAAGGATTGGTTTGAGTTTGCCTTCGACTACAATGACTTCA CCACCAAGGCCGAGGGGACACGGACCGAGTGGACACTGTGCACTTACCGGGAGCGGATTAGA ACCTTCCGGAACCCCCAGAAAAATCATCAGTGGGACGATGAAGAGATCGTGCTGACCGACGCC TTCAAGCAGCTGTTCGATAAGTACGACATCGACATGAAGGGCAATCTGAAGGAGGCCATATGC GCCCAGAATGACGTGCAGTTCTTCAAGGACATGATGGAACTGATGAAGCTCCTGCTGCAGATG AGGAATAGCATAACTAACAGCGAGACCGATTACCTGCTGTCTCCAGTGGCCGACGAGAAGGGC CAGTTTTTTGACTCCCGCCGGGGCATAACCACACTGCCCGATAACGCCGACGCCAACGGGGCCT ATAATATTGCCCGGAAGGGCCTGTGGGTGATCAGGAAAATCCAGGAAACCGCTGAGAATGAG AAGCCCAGTCTGGCTATAACAAACAAGGAGTGGCTGCAGTTTGCCCAGACAAAGCCCTATCTG AATGAGTAG |
| 183 | 143 | ATGAAACAGTTTACAAATCTGTATCCAGTGAGTAAAACACTGCGGTTCGAGCTGCAGCCCATCG GTAAGACCAAGGAGAACATCGAGAAGAATGGCATACTGACCCGCGACGAAAAACGCGCCAAG GACTACCAGGTCGTGAAGGGATTCATCGACGAGTATCACAAACAGTATATCAAGGACCGGCTG TGGAATTTCAAGCTGCCTCTGGCTTCTGAGGGCAATCTGGACTCTCTTGAAGAGTACCAGATGC TCTACGAGATGCCACGCAGGGATGATACCCACGAGGAGGATTTCAGTGAGGTGAAGGATAAC CTGAGGGCCATCATCACCAAGCGACTGACCGAGAACGGTTCAGCATACGACAGAATCTTTAAG AAGGAGCTGATCCGCGAAGATTTGATCGAGTTCCTGAACAATGAGGAAGATAAGGCCCTGGTG AGACAGTTCGCCGACTTTACAACATATTTTAGCGGCTTTCACGAAAACAGGAGAAATATGTACT CTGCCGAGGAGAAGAGCACCGCCATCGCCTACAGACTGATCCACCAGAACTTGCCAAAGTTCA TGGACAACATGAAGGCCTTCGCCAAGATCGCCGAGACATCCGTGGCCGAACATTTCAGCAACA TTTATGAGGGCTGGGAGGAGTACCTGAACGTCGGCAGTATTGAAGAAATTTTCCGGCTGGACT ACTTCTCCGAGACTCTGACTCAGCCTCACATCGAGGTCTATAATTACATCATCGGCAAGAAAGT GCTCGAAGACGGAACCGAGATCAAGGGGATCAACGAGTACGTGAATCTGTACAACCAGCAGC AGAAGGATAAGAGCAAGAGACTGCCATTCCTGGTCCCTCTGTACAAGCAAATTTTGTCCGATAG AGAAGCTGTCCTGGCTGGCCGAGGAGTTCGACAGCGATGAGAAGATGCTGGGCGCCATCA ATGAGAGCTACACCCACCTGCACGAGCTGCTGATGGGCGAAGAGAACGAGTCCCTGCGCAGCC TGCTGCTGCACCTGAAGGAATACGACCTGTCCCAGATAAATATCACTAACGATCTGAGCCTGAC AAATATCTCCCAGCACCTGTTTGGACGATATGACGTGTACTCCAATGCCATTAAGGAACAGCTG AAGATCATCATCCCTAGGAAGAAAAAAGAGACCGACGAAGAGTTTGAGGATAGGATCAGCAA GATCTTCAAGCACAGAAGTCCTTCAGCATCAGCTTTCTGAATAATCTGCCCCACCCCGAGACA GAGAATGGAAAGCCTCGGAGCGTGGAGGAATATTTCATTAGCATTGGCACTATCAACACCAAA ACCACCCAGAAGGAGAATCTGTTCGCTCAGATCGAGAACGCCTACGAAAACGTGAGAGTGATC CTCCAGATGAAAGACACTGGCAATGCCCTGAGCCAGAATAAACCAGCCGTGACCAAGATCAAG GCCCTGCTCGACGCCTTCAAAGACCTGCAGCACTTCATCAAGCCTTTACTGGGCAGCGGCGAAG AGCTGGAGAAGGACGAGCTGTTTTATGGCAGCTTTCAGATGATCTGGGATGAGCTGAACACCG TCACCCCTCTGTACAACAAGGTGAGGAACTGGCTGACAAGGAAGCCCTACAGTACAGAAAAGA TCAAGCTGAACTTCGACAATTCCCAGCTGCTGGGCGGCTGGGACGTGAATAAGGAGCCTGATT GTACTGGCATCTTGCTGCGCAAGGACAGCTTCTATTACCTGGGAATCATGGATAAAAAAGCAA ATCGGGTGTTCGAAACCGACATCACCCCATCAGAGGGCGACTGCTATGAGAAAATGGTGTACA AACAGCTGGGCCAGATTTCTCAGCAGCTTCCTAGAATTGCCTTTTCCAAGACCTGGCAGCAGAA ACTGTCCATTCCTGAGGACGTGATCAAGATCAAGAAGAATGAATCCTTTAAGAAAAATAGCGG CGATCTCCAGAAGCTGATCAGCTACTACAAATCTTTTATCTCCCAGCACGACGAATGGAATAGC TATTTCGATATCAATTTCACCGATAGGAATGATTACAAGAACCTGCCTGACTTTTATAGCGAGGT GGATAGCCAGTTTTACTCCCTGAGCTTCTCAAGGGTGCCTAGCAGCTATATCAATCAGTTGGTC GACGAGGGAAAGCTGTACCTGTTTCGCATCTGGAATAAGGACTTCAGCGAGTACTCCAAGGGC ACCCCAAACCTGCATACCTTGTATTGGAAGATGCTGTTTGACGAGCGGAACCTGAGTAACGTG GTGTACAAGCTGAACGGACAGGCCGAAGTGTTCTATCGGAAGGCCAGCATTCAGCCCGAGAAT AGAATCATCCACAAGGCCAACCTGTCTATCGTGAATAAAAATGAGCTGAACAAGAAGAGGACC TCCACTTTCGAGTACGACATCATTAAGGATCGCCGCTACACCGTGGACAAGTTCCAGTTTCACG TGCCTATCACTATCAACTTCAAGGGCACAGGCCAGCTGAACATAAACCCTATTGTCCAGGAAAC CATCAGACAGGGAGGGTTCACCCACATCATCGGAATCGACAGAGGCGAAAGGCATCTCCTGTA CCTGTCCCTGATTGACCTGAATGGCAATATCGTGAAGCAGATGACGCTGAACGACATCTTCAAC GAGTATAAAGGCCAGACCTATAAAACAAACTATCACGATCTGCTGGTGAAACGGGAGGGCGAT CGCACCGATGCCCGCCGGTCTTGGGACACCATTGAGACCATTAAGGAGCTGAAAGAGGGCTAT CTGTCTCAGGTGGTGCACGTGATCTCAAAGATGATGGTGAATACAAGGCCATCGTGGTGCTC GAAGATCTGAATACCGGCTTTATGCGCGGCAGACAGAAAATTGAGCGGCAGGTCTACGAAAA ATTCGAGAAGATGCTGATCGAGAAGCTGAACTGTTACATCGACAAACAGGCCGACGCCACCGA GGTGACAGGCCTGCTGCACCCACTGCAGCTGACATGCGAAGCCAAAAAGTGGAAGCGCTCCCA CCAGTGCGGCTGCCTGTTCTACATTCCTGCCTGGAACACTTCTAAGATCGATCCCGTCACAGGG TTCGTGAACCTTCTGGACACCCGGTACGACACTAGAGAGAAGGCCAGGCTGTTCTTCTCCAAGT TCCAGAGGATTAGCTTCAATACAGAGAAGGGCTGGTTCGAGTTTACCTTTGACTACAATGATTT CACCACTAAGGCTGAGGGCACTAGAACCCAGTGGACCCTGTGCACCCACGGGGAGAGAATCA GAACATTCCGGAACCCCCAGAAGAATAATCAGTGGGATAATGAGGAAGATCGTGCTGACCGACA AGTTCAAGAAGCTGTTCGACCAGAAAGAAATCGATATTCTGGCAATATGAAGGAGGCCATTT GCAACCAGAAGGACGCCCAGTTCTATCGCGACCTGCTGGGCCTGATGAAGCTGCTGCTGCAGA TGCGGAATAGCATCGCCAATTCTGAGGAGGATTACCTGCTGTCCCCATCGCCGACAAAAATG GCATTTCTTCGACAGCCGCGAGCGGATCTCCAGCCTGCCCGTGGACGCCGACGCAAATGGTG CCTACAACATCGCCAGGAAGGGACTGTGGATTGTGCGGAAGATCAGAAACACCTCTGAGGGC |

TABLE S9B-continued

Human Codon Optimized Nucleotide Sequences Group 9

| SEQ ID NO | Corresponding AA | Sequence |
|---|---|---|
| | | GAGAAACTGTCCCTGGCAATCACTAACAAGGAGTGGCTGCTGTTCGCACAGTCCAAGCCCTATC TGAATGATTGA |
| 184 | 144 | ATGAAGAAACTGACAAACCTGTACCCCGTGAGCAAAACCCTGAGGTTCGAACTCCAGGCTATC GGCAAGACCAAGGAGAATATCGAAAAGAATGGAATTCTGCAGAGAGATGAGAAGCGCGCCGA GGACTACAAGATCGTGAAGTCCCTGATCGATGAATACCACAAACAGTTCATTAAGGATCGCTTG TGGAACTTTAAGCTGCCATTGCACAACGAGGGCCACCTGGACTCCCTGGAGGAGTATCAGGCA CTGTACGAGATTTCCAAGCGGAACGACACCCAGGAAGCCGAATTCACTGAGATCAAAGACAAC CTTAGGTCAATTATCAGCAAGCGACTGACCGAGTGTGGCTCTGCCTACGAGCGGATCTTCAAAA AGGAACTGATCAGGGAGGACCTGATCGATTTCCTGGAAAGCAACGAGGATAAGGACATCGTG AGACAATTTGCTGATTTCACCACCTATTTCAGCGGGTTTCACGAGAATAGGAGAAACATGTACG TGGCCGAGGAGAAGTCCACCGCCATCGCCTATAGGCTGATCCACCAGAACCTGCCCAAATTTAT GGACAACATGAAAGCCTTCGCCAAGATCGCCGAGACCTCCGTGGCCGAGCACTTCACCGACAT CTACGAGGGCTGGAAAGAATTCCTGAACGTGGGCAGCCTGGAGGAAATATTTAGGCTCGACTA TTTCTCCGAGACACTGACACAGCCCCATATCGAAGTGTACAATTACATTATCGGCAAGAAGATC CTGGAGGATGGCGCCGAAATTAAGGGCATCAATGAGTACGTGAATCTGTATAACCAGCAGCAG AAAGACAAGAGCAAAGACTGCCATTCCTGGTGCCCCTCTACAAGCAGATCCTGTCAGACCGC GACAAACTGTCCTGGCTGGCTGACGAATTCGACTCCGACGAGAAGATGCTGGCCGCAATCAAT GAGTCATACAATCACCTGCACGACCTGCTGATGGGCCTGGAGAATGAGTCTCTGAGGTCCCTG CTCCTGAACATCAAAGACTTTAATCTGTCCCAGATTAATATCTCCAACGACCTGAGCCTGACTGA TATCTCTCAGCACCTGTTCGGACGCTACGATGTGTTTACATCAGGCATTAAAGACGAGCTGCGG ATTATCACACCTCGCAAAAAGAAGGAGAGCGATGAGGAGTTCGAAGACCGCATCTCCAAAATC TTTAAAACTCAGAAGTCCTTTAGCGTGGACTTTCTGGACAAGCTGCCACAGCCTGTCATGGAAG ACGAAAAACCCAGAACCATCGAGGATTATTTTATGACCCTGGGCGCCGTGAATACTGAGGCCA CACAGAAGGAAAACTTTTTCGCCCAGATAGAGAACGCCTACGAGGATGCCCGCACCATCCTCC AAATTAAGGACACCGGAGACACCCTGAGCCAGAATAAAAGTGCCGTGGCCAAAATTAAAGCCC TGCTGGATGCACTGAAGGATCTCCAGCACTTCATTAAACCTCTGCTGGGGTCTGGCGAGGAAA ACGAGAAGGACGAGTTGTTTTACGGAAGCTTCCAGATGATGTGGGATGAGCTGGACACCGTCA CAAGCCTGTACAATAAGGTGAGGAACTGGCTGACACGGAAGCCTTTCTCCACTGAGAAGATCA AACTGAACTTCGACAACAGTCAACTGCTGGGCGGATGGGACGTGAATAAGGAGCCCGACTGTA AAGGTATCCTGCTGAGAAAGGACGACTTCTATTATCTGGGCATCATGGACAAGAAAAGCAATA GAATCTTTGAGGCCGATGTGACACCCACCGATGGCGAGTGCTACGACAAGATCGACTATAAGC TGCTGCCCGGCGCTAATAAAATGCTGCCAAAGGTGTTCTTCTCAAAGTCTAGGATCGACGAGTT CGCCCCATCCGAAGCTATCGTGAGCTCCTACAAGAGAGGCACCCACAAGAAAGGCGCCGTGTT CAACCTCGCAGATTGCCACCGGCTGATTGACTTCTTTAAGCAGAGCATCAATAAGCACGAGGAT TGGAGCAAGTTTGGATTCCATTTTTCTGATACCAAATCTTACGAGGACATCAGCGGCTTTTACAG AGAGGTGGAACAGCAGGGCTACATGCTGTCATCTCATCCCGTGTCCTCCTCCTACATTGACACA CTGGTGAGCGAGGGCAAGTTGTACCTGTTCAGGATCTGGAACAAGGACTTCTCTGAATCTAGT AAGGGCACTCCCAACCTGCACACACTGTACTGGAAGATGCTGTTCGATGAGAGAAATCTGGTG GACGTCGTGTACAAGCTGAACGGTCAGGCCGAAGTGTTTTATCGCAAAGCCAGCATAAAGCCT GAGAATTGCATCATTCACAAGGCCAACCAGCCTATCGCTAACAAGAACGAGCTGAACACCAAG CGGGCCTCCACCTTCAAGTACGACATCATTAAGGACAAAAGGTACACAGTGGATAAGTTCCAG TTTCATGTCCCCATCACCATTAACTTCAAGGCTGCCGGCCAGAACAACATCAACCCCATCGTGCA GGAGGCCATCAAGCAGGACGAGTTCTCCCACATTATTGGCATTGATAGAGGCGAAAGGCACCT GCTGTACCTGAGCCTGATCGATCTGAAAGGCAACATCGTGAAGCAGATGACCCTGAATGAGAT TATCAATGAGTACAAGGGCCAGACCTATAAAACAAACTATCACGACCTGCTGGCCAAAAGAGA GGGAGACAGAACCGAGGCCCGCAGGTCTTGGGAGACCATCGAAACAATTAAGGAGCTGAAGG AGGGCTACCTGAGCCAGGTGGTGCATATCATCTCTAAGATGATGGTGGAGTACAACGCAATCG TGGTGCTGGAAGACCTGAACACCGGGTTCATGCGGGAAGGCAGAAGATCGAGAGACAGGT GTACGAGAAGTTTGAGAAGATGCTGATCGATAAACTGAATTGCTACATCGACAAGCAGTTATCT CCAACAGATGAGGGCGGCCTGCTGCATCCACTGCAGCTGACCTGTGACGCTCAGAAGTGGAAG AGAAGCCACCAGTGCGGCTGTCTGTTCTACATCCCTGCCTGGAATACCTCTAAGATCGATCCCG TGACAGGCTTCGTGAACCTGCTGGATACCCACTACGACACCAGAGAAGGCTAGAGTGTTCT TCTCCAAATTCCAGAGGATCAGCTACAATGCTCCCAAGGGCTGGTTCGAGTTCGCTTTTGACTA CAACGATTTCACAACAAAGCCAAGGGGACCCGCACTCAGTGGACACTGTGCACCCAGGGCGA GCGCATTAGGACCTTCCGGAACCCCCAGAAGAATCATCAGTGGGACGACGAGGAGGATCATGCT GACCGATGCCTATAAACAGCTGTTTGACAAGTACGACATCGACATCAACGGTAACATCAAGGA AGCCATTAGCAGTCAGACAGACGCCCAGTTCTTCAAAGACCTGATGGGGCTGATGAAGCTGCT GCTGCAGATGCGCAATTCCATCACAAACAGCGAGGAGGACTATCTGCTGTCCCCTGTGGCCAAT GGAACAGGACATTTCTTTGATAGCAGGGAAGGCATTTCTTCTGCCTAAGGACGCCGACGCG AACGGCGCATATAACATCGCCCGCAAGGGGCGTGGGTGGTGCAGAAGATCCAGGAGACCCC TGAGGGCGAGAAGCCTAGCCTGACTATCACCAACAAAGAATGGCTGCAGTTTGCCCAGACAAA GCCTTACCTGAACGACTAA |
| 185 | 145 | ATGAAGGAGAAGGAGCAGTACTCCGATTTTAGCCGTCTCTATCCCGTGTCTAAGACCCTGAGAT TCGAGCTGAAACCCATCGGAAGAACCATGAAGAATATTGAAAAGAACGGTATACTGGAGCGG GACAATCAGAGGGCCAACGATTACAAAATCGTGAAGGAATTTATTGACGAGTACCACAAACAG CACATTAAGGACAGACTGTGGGATTTCAAACTCCCCCTGAAGAGCGATGGCAGGCTGGACAGC CTGAAGGAGTATCAGGAGCTGTATGAGCTGTCTAAGCGGGACGCCAATCAGGAGTCAGCCTTT ACCGAAATCAAGGATAACCTGAGAAGCATCATCGCCCGGAGACTGACCCACGATTCCCCTGCCT ACAAGAGAATTGATAAGAAGGAGCTGATCAGAGAGGACCTGCTGGAGTTCCTGGAGAACGAG GAAGATAAGGAGATCGTGAGACAGTTTGCCGATTTTACCACTTATTTCACCGGGTTCCACCAGA ACAGGCAGAATATGTATACAGCAGAGGAAAAGAGCACCGCCATCGCCTACCGCCTGATCCACC AGAACCTGCCAAAGTTCATGGACAACATGAAGGCTTTTGCCAAAATCGCCGAGACTAGCGTGG |

TABLE S9B-continued

Human Codon Optimized Nucleotide Sequences Group 9

| SEQ ID NO | Corresponding AA | Sequence |
|---|---|---|
| | | CTGAGCATTTCGCCGATATCTACGAAGGATGGAAGGAGTACCTGAACGTGGGCAGTATCGAAA<br>AGATCTTCCAGCTGGATTACTTCAGTGAGACAATGACTCAGCCACATATCGAAGTGTACAACTA<br>CATTATCGGCAAGAAGATCCTGGAGGACGGGACAGAAATTAAGGGGATCAATGAGTACGTGA<br>ATCTGTACAATCAACAGCAGAAGGATAAGTCACAGCGCCTCCCGTTCCTGGTGCCCCTGTACAA<br>GCAGATCCTGTCTGACCGCGAGAAGCTGTCCTGGATGGCCGAGGAGTTCGACAGCGATGAGA<br>AAATGTTGGCCGCCATCAACGAATCTTACGTGCATCTGCACGATCTGCTGATGGGCACCGAAA<br>CGAGAGCCTGAGAAGCCTCCTGTCCCACATGAAGGATTTCAATCTGGAGCAGATCAACATCAA<br>CAACGACCTGAGCCTGACCGACATCTCACAGCACCTGTTCGGCCGCTACGATGTCTTCACTAAC<br>GGGATTAAGGATGAGCTGCGGGCCATTACTCCACGGAAGAAGAAAGAGTCTGACGAGGACTT<br>TGAGGATAGAATCAGCAAGATCTTTAAAACGCAGAAATCCTTTTCAATCAGTCTGCTGAATAAG<br>CTGCCTCAGCCTGTGATGGAAGACGGCAAGCCCAGGACAGTGGAGGAGTATTTCATGAGCCTG<br>GGCGCCGTGAACACCGAGACAACCCAGAAGGAAAACCTGTTCGCCCAGATCGAGAACGCCTAC<br>GAGAACGCCCGGAGCATCCTGCAGATGAAGGACACCGGCGATGCCCTGAGCCAGAATAAACA<br>GGCCGTGGCCAAGATAAAGGCCCTGCTGGATGCCTTCAAAGACCTGCAGCACTTCATTAAACCT<br>CTGCTGGGCTCAGGGGAGGAGAACGAGAAGGATGAGCTGTTTTACGGCGTGTTCCAGCTGAT<br>TTGGGACGAACTGGATACAATGACACCCCTGTACAATAAAGTGAGGAATTGGCTCACCCGCAA<br>ACCTTACTCAACCGAGAAGATTAAACTTAATTTTGACAACGCACAGCTGCTGGGCGGGTGGGA<br>TGTGAACAAAGAGCCCGATTGCACTGGCGTGCTGCTGCAGAAAGACGGCTTCTATTACCTGGG<br>GATCATGAACAAGAAGGCCAACCGGATCTTTGAGTCTAAGGTGACCCCCAGCAATGAGGATTG<br>CTATGAGAAAATTGATTACAAGCTGCTTCCAGGTGCCAATAAGATGCTGCCCAAGGTTTTTTCT<br>CCAAGTCCAGGATTGACGAGTTTGCTCCTTCCGAGGCCATTGTGGATAGCTACAGACGCGGAA<br>CACACAAAAAGGGCCCCGACTTCAATCTTAGCGACTGTCACAGACTGATCGACTTCTTTAAGGA<br>TAGCATTGCCAAGCACGAGGATTGGTCCAAGTTCGTGTTTCATTTCTCCGAGACCAGCACTTAC<br>GAGGACATCTCCGGCTTTTATCGCGAAGTCGAGCAGCAGGGCTACATGCTGGCTAGTCACCCA<br>GTGTCAGTCAGTTATGTGGAACAGATGGTGGATGAGGGAAAGCTGTACCTCTTCAGAATCTGG<br>AACAAGGACTTCTCCGAGCATTCAAAGGGCACCCCCAACCTGCACACCCTGTACTGGAAGATGC<br>TGTTCGACGAGAGAAATCTGGCCGACGTGGTGTACAAGCTGAATGGGCAGGCTGAGGTGTTTT<br>ACAGAAGAGCTTCCATCAAGCCCAAGAACCGGATCATTCACCAGGCCAACAGCCCCATCGCCA<br>ACAAGAACGAACTGAACGAGAAGCGCACCTCCACCTTTAAGTATGATATTATTAAAGACAGAC<br>GGTACACCGTGGATAAGTTTCAGTTTCATGTGCCCATCACAATCGGATTTAAGGCCATCGGGCA<br>GAACAATATCAATCCCATCGTGCAGGACACCATACGGCAGGGCGGGTTCACTCATATCATCGG<br>AATCGACAGGGGCGAACGCCACCTGCTGTACCTGAGCCTGATCGACCTGAAGGGCAACATCAT<br>CAAGCAGATGACCCTGAATGATATTGTCAACGAGTATAATGGCGTGCTGTACAAGACCAACTA<br>CCGGGACCTGCTGAAGAAAGGGAGGGCGAACGGACAGATGCACGCAGAAGCTGGGAGACT<br>ATTGAAACCATCAAGGAGCTGAAGGAAGGCTACCTGTCCCAGGTGGTGCACATTATCTCCAAG<br>ATGATGGTCGAGTACAACGCCATTATTGTGCTGGAGGACCTGAACACCGGATTTATGAGGGGC<br>AGGCAGAAAATTGAGCGGCAGGTGTACGAAAAGTTTGAGAAGATGCTGATTGACAAGCTGAA<br>TTGTTACATCGACAAGCAGACAAACCCCGAAGACGTGGGCGGCCTGCTGCACCCACTGCAGCT<br>CACATGCGATGCACAGAAGTGGAAGAGGAGCCACCAGTGTGGCTGTCTGTTTTACATCCCCGC<br>CTGGAACACCTCCAAAATCGACCCCGTCACCGGCTTCGTGAATCTGTTCGACACTAGGTACGAG<br>ACACGAGAGAAGGCCCGGCTGTTTTTCTCCAAGTTCCAGCGCATCGACTTCAACACCGAGAGC<br>GACTGGTTCGAGTTTTCCTTTGACTACAATGACTTCACAACCAAAGCAGAAGGCACCCGGACTA<br>AGTGGACCCTTTGCACTTACGGAGAGCGGATCAGAACCTTCAGGAATCCTGAGAAGAATCATC<br>AGTGGGACGACGAAAGGATCGTGCTGACCGATGAGTTCACCCAGCTGTTCGAGCGCTATAACA<br>TCGATATCCAGGGCAACCTGAAAGAGGCTATTTCTGCCCAGTCTGACGCACAGTTTTACCGGGA<br>ACTCCTGGGGCTGATGAAGCTGCTGCTGCAGATGCGCAACTCAATCACCAATAGCGAGGAGGA<br>TTACCTGCTGTCCCCCGTGGCAGACGAATCTTCCCATTTTTTTGATTCCCGGGAACGTGGAG<br>ATCCTGCCCAACAATGCTGACGCTAACGCGCCTATAATATCGCCCGCAAGGGCCTGTGGGTG<br>ATCAGGCGGATTCAGGAAACGCTGAGAACGAGAAAATCAGCCTGGCCATCTCCAACAAGGA<br>GTGGCTGCAGTTCGCCCAGACTCAGCCCTACCTGAACGACTGA |
| 186 | 146 | CTCCAGCTGACCGATACAGAGGACAAACTCAGTCAGAATAAACCAGCTGTGGGCAAGATTAAG<br>GCCCTGCTGGACGCCTTCAAAGACCTGCAGCACTTCATCAAGCCTCTGCTGGGCTCCGGGGAA<br>GAAAATGAGAAGGATGAGCTGTTCTATGGCGCCTTCCAGCTGATCTGGGATGAACTGGACACC<br>GTGACCCCTCTGTACAATAAAGTGAGGAACTGGCTGACCAGGAAGCCGTATAGCACCGAGAAA<br>ATCAAACTGAACTTTGACAACGCCCAGCTGCTGGGGGGATGGGATGTGAACAAGGAACCGGA<br>CTGCACCGGCGTGCTGCTGAGGAAGGACGGGTTCTATTACCTGGGCATCATGAACAAAAAGAG<br>TAATCGCATCTTCGATGCTGACGTGACCCCTGCCGACGGGATTTGCTACGAAAAGATCGATTAT<br>AAACTCCTGCCTGGGGCCAACAAGATGCTGCCTAAGGTGTTCTTTTCTAAGAGTCGGATCGATG<br>AATTCGCCCCATCCGAGGCCATCCTGAGCAGCTACAAGCGGGGCACACATAAGAAAGGCGCCG<br>ACTTCTCTCCCTGTCCGACTGCCACCGGCTGATCGATTTCTTCAAGGCTTCCATCAACAAACACGAG<br>GACTGGAGTAAGTTTGGCTTCCAATTCTCCGATACCAAGACCTATGAGGACATCAGCGGCTTTT<br>ACAGGGAGGTGGAGCAGCAGGGATATATGCTGTCATCCCACCAGGTGAGCGAAGCCTACATC<br>AACCAGATGGTGGAGGAGGGCAAGCTCTTTCTGTTCAGGATCTGGAACAAAGATTTCTCCGAG<br>TACAGCAAGGGCACCCCAAATATGCACACTCTCTACTGGCGGATGCTGTTCGACGAACGCAATC<br>TGGCCGATGTGGTGTACAAGCTGAATGGACAGGCCGAAGTGTTCTACCGGAAGGCTTCCATTA<br>AGGCCGAGAACCAGATTATGCACCCCGCTCATCACCCCATCGAAAACAAGAATACACTGAACG<br>AGAAGCGAAGTAGCACCTTCGACTACGACCTGGTGAAAGACCGGAGGTACACCGTGGACAAG<br>TTCCAGTTCCACGTCCCCATCACCATCAACTTCAAGGCCATCGGCCAGACCAACGTCAATCCCAT<br>CGTGCACGAGACCATTAGACGGGGCGGCTTTACTCACGTGATCGGCATCGATGGGCGAGA<br>GACACCTTCTGTACCTTAGCCTGATCGATCTGAAGGGCCATATCGTGAAACAGATGACCCTGAA<br>CGAGATTATCAACGAGTACAATGGCCTGGCCCACAAGACCAACTACTACGACCTGCTGGTGAA<br>GCGAGAGGGTGAGCGAACTACCGCTAGGCGCAGCTGGGACACCATCGAAAACATCAAGGAAC<br>TGAAAGAGGGCTACCTGAGCCAGGTGATCCACATTATCTCCAAGATGATGGTGGAGTATAACG |

TABLE S9B-continued

Human Codon Optimized Nucleotide Sequences Group 9

| SEQ ID NO | Corresponding AA | Sequence |
|---|---|---|
| | | CCATTGTGGTGCTGGAGGATCTGAACATGGGGTTTATGCGGGGAAGGCAGAAGATCGAGAGA CAGGTGTACGAGAAGTTTGAGAAGATGCTGATTGATAAACTGAACTGCTACATCGATAAGCAG GCCGACAGTCAGTCTGAGGGCGGCCTGCTGCACCCCATCCAGCTGGCCAATAAGTTCGAGAGC TTCAGGAAGCTGGGTAAGCAGAGCGGCTGCCTGTTTTATATCCCTGCATGGAACACCAGCAAG ATCGATCCAGTGACCGGCTTTGTCAACCTGTTCGATACCCGGTACGAAACTAGGGAAAAGGCC AAGCTCTTTTTCAGCCATTTCCAGCGTATCTGCTTTAATGCTGAGAAGGACTGGTTTGAATTCAG TTTTGATTACAACGACTTCACTACCAAAGCCGAGGGCACCAGGACCCAGTGGACACTGTGCTCT TATGGCACCAGAATCAGAAATTTCCGCAATCCTCTGCAGAATCATCAGTGGGACGATGAAGAG ATTGTGCTGACCGAGGCCTTCAAGGCTCTGTTCGACAAGTACGACATCGACATCCATGCCAATC TGAAGGAAGCCATTAACGCCCAGACCGATGCTCAGTTCTTCAAGGATCTGATGGGCCTGATGA AGCTGCTGCTGCAGATGAGGAACTCCAAAACTAACAGCGAGGTGGACTATCTGCTGAGCCCTG TGGCTGATGAGCACGGCCGCTTCTTCGATAGTAGAGCCGGCGCCGGCTCTCTGCCTGACAACG CCGATGCCAATGGCGCCTACAACATCGCCAGAAAGGGACTGTGGGTGATCCGGAAGATCCAA GAGACCCCCGAGGGCGAGAAGCTGAGTCTGGCCATCACCAACAAGGAATGGCTGGAGTTCGC CCAGACAAAGCCCTACCTGAATGACTAG |
| 187 | 147 | CTGGGCCTGTTCCTGAGACTCCGGCCAAAGCTGTTCGTGATCCTGTGCAAGAGCAACTCAAACG TGATGAGGAACCTGACCAACCTGTACCCCGTGTCTAAGACTCTGCGGTTTGAACTGCAGCCCAT CGGGAAAACCAAAGAGAACATCGAGAAGAATGGAATCCTGCAGAGGGACGAAAAGCGGGCC GAGGACTACCAGAAGGTCAAGAACCTGATCGACGAGTACCACAAGCAGTTCATCAAGGACAG ACTGTGGACCTTCGAGCTCCCCCTGGAGATTCTGGAGGAGTACAAAGAACTGTATGAGACCCC TAAGCGAGACGAAGCCGCCTTTACCGAGGTGAAGGATAACCTGCGGGCCCTGATCGCCTCCCA GCTGAAGGCCAAGGGAAGTATCTATGACCGCATCTTCAAGAAAGAGCTGATCAGAGAGACCT GATCGAGTTCCTGGATAACGAGGAGGATAAGGAGATCGTGAGACAGTTTGCCGACTTTACCAC TTACTTCAGTGGCTTTCACAAGAACCGGGAGAACATGTACTCCGCAGAGGAGAAGAGCACCGC TATCGCATACAGACTGATCCACCAGAATCTGCCCAAGTTTATGGACAACATGAAGGCCTTCGCC CTGATTGCTAAATCCCCCGTCGCCGAGCACTTCCCCGATCTGTACTCAGCCTGGGAGGAGTGCC TGAACGTGGCATCCATCGAGGAAATGTTTCGCCTGGACTATTTCTCCCAGACACTGACCCAGAC CGGCATCGAAGTGTATAACTATATCATCGGCAAAAAAATTCTGGAGGATGGCACAGAGATCAA GGGAATTAACGAGTACGTCAATCTGTACAATCAGCAGCAGAAGGACAAGAAGGAAAGACTGC CCCTGCTGGTCCCACTTTATAAACAGATCCTGTCTGATCGCGAGAAACTGTCTTGGTTGGCAGA GGAGTTTGACTCCGATGAAAAGATGCTGAACGCAATTAATGAGCTGTATGCCCACCTTCATGAC CTGCTGATGGGCGAAGAGAACGAGTCTCTGCACTCTATTCTCCTGCAGCTGAAAGAATACGACC TGTCTCAGATTAACATTGCCAACGATCTGTCTCTGACAGCCATTAGTCAGCAGATGTTCGGCAG ATATGACGTGTTTACCAACGGAATGAAAGATATTCTCAGGACCATCACTCCTCACAAGAAGAAG GAGACCGAGGAAGATTTCGAGGAGAGGATCAGCAAAATCCTGAAGATCCAGAAGTCTATCTCT ATCGCAGAACTGAACAAGCTGCCTCAGCCCATTAGCGAGGATGGCGGGAAACCCAAACTGGTG GAAGATTATTTCATGAGCCTGGGGGCCGTGGACGACGGCGTAACCCAGAAGGCTAATCTGTTC GCCCAGATTGAAAACGCCCACACCGACGCTCTGTCCGTGCTGCAGCTGACAGGTACCGGCGAC ACCCTGTCCCAGAACAAGACAGCCGTGGCCAAGATTAAAACTCTGCTGGATGCCTTTAAGGATC TGCAGCACTTCATTAAGCCACTGCTGGGGAGCGGCGAGGAGAACGAGAAAGATGAGCTGTTTT ACGGCAGCTTCCAGCTGTTTTGGGACGAGCTGGACGCTGTGACCCCCCTGTACAATAAGGTGA GAAACTGGCTCACCCGGAAGCCATATTCCACAGAGAAGATCAAGCTCAACTTCGATAATGCCCA GCTGCTCGGGGGCTGGGACGTGAACAAGGAGCCAGATTGCACTGGCATCCTGCTGAGGAAGG ACGGACTGTATTACCTGGGAATCATGAACAAGAAGAGCAACAGAATCTTCGATGCCAGCGTGA CCCCTAGTGACGGAGACTGCTATGAGAAAATCGACTACAAACTGCTGCCCGGCGCCAACAAGA TGCTGCCCAAGGTGTTTTTCAGCAAGTCCAGAATTGACGAGTTTGCCCCCAGCGATGCCATCAT CAATTCCTATAAGAGAGAGACACACAAGAAAGGCGCCAATTTCTCCCTGAGGGACTGCCACAG ACTGATCGATTTTTTCAAACAGTCCATCAGCAAGCATGAAGACTGGAGTAAGTTCGGCTTCCAC TTTTCCGATACATCCAGTTATGAGGACATCTCCGGGTTCTATCGGGAAGTGGAGCAGCAGGGCT ACATGCTGAGCTCTCACCCTGTGAGCAGTGCTTATATCCACCAGATGGTGGATGAGGGGAAAC TGTTTTTGTTCAGGATTTGGAACAAGGATTTCAGCGAATACTCTAAAGGTACACCCAACTTACAT ACCTTGTATTGGAAGATGCTGTTCGACGAAAGAAATCTGGCTGATGTGGTGTACAAACTGAAC GGCCAGGCCGAGGTGTTCTACCGGAAAGCCTCTATCAAGCCTGAGAATAGAATCATACACCCC GCCAATCAGGACATTAAGAATAAGAATGCTCTGAACGAGAAGGCCACTTCTCGGTTTGAATAT GACATTGTGAAGGACCGGAGATACACCGTGGATAAGTTTCAGTTCCACGTGCCTCTGACCATCA ATTTCAAAGCCACTGGACAGGCAAATGTGAACCCCGTGGTGCAGGAGGCCATCCGCAGGGC GAGTTCACTCACATTATTGGGATCGACCGCGGCGAGAGACACCTGCTGTATCTGTCTCTGATCG ACCTGAAAGGGAGAATCGTGAAGCAGATGACACTCAATGAAATCGTGAACGAGTACAATGGC CACTCTCACACAACAGACTACCATGGACTGCTCGCCGATCGGGAGGGCCAGCGCACCACTGCA AGGAGATCTTGGGATACTATCGAAAACATCAAGGAGCTGAAAGAAGGATATCTGAGCCAGGT GATCCACGTCATCACAAAGATGATGGTGGAATACAAGGCCATCGTGGTGCTGGAAGACCTGAA CATGGGTTTATGAGAGGCAGACAGAAGATCGAAAGGCAGGTGTATGAGAAGTTCGAGAAAA TGCTGATCGAGAAACTGAACTGCTATATCGATAAGCAGGCCGATCCCACCGATGTGGGCGGCC TGCTGCACGCCCTGCAGCTGACAAACAATTCGAGTCCTTCAAGAAACTGGGCAAGCAGAGCG GCTGCCTGTTCTACATCCCAGCCTGGAATACCAGCAAAATTGACCCAGTGACTGGCTTTGTGAA TCTGTTTGATACCAGGTACGAGACAAGGGAGAAGTCCAGACTGTTTTTCTCTAGATTCGATAGG ATTGCCTATAATCAGGACAAGGACTGGTTTGAGTTCTCATTTGACTATGACAACTTTACTACTAG GGCCGAAGGGTGCAGGACCCACTGGACTCTGTGCACCCAGGGCAAGAATCAGAAACTTCC GGAACCCACAGAAGAATAACCAGTGGGATGACGAAGAGGTGAACCTGACCGCCCTGTTCAAA CAGCTGTTCGACCTGTATGACATCGATATCCACGGCAACCTGATGGAGGCCATCCAGAGACAG ACAGAGGCCAAGTTCTACCAGGAGCTGATGCACTTAATGAAGCTGACCCTGCAGATGAGGAAT AGCAGAATCAACTCCGAGGTGGACTACCTGCTGAGCCCTGTGGCTGACGAAAAGGGCAGGTTT TTCGATTCCAGATCCGGGGATTGTGTGCTCCCCGACAACGCCGACGCCAACGGCGCTTACAACA |

TABLE S9B-continued

Human Codon Optimized Nucleotide Sequences Group 9

| SEQ ID NO | Corresponding AA | Sequence |
|---|---|---|
| | | TCGCTAGAAAGGGCCTGATGCTGATTCAGACCATCAGAGAAACCCCCGATGGCGAGAAGCCCA GCCTGACCATCACCAATAGGGAGTGGCTGCGATTCGCCCAGGAGAAGCCTTACCTGGTCGACT AA |
| 188 | 148 | ATGAAGCAGTTCACTAATCTGTACCCTGTGAGCAAGACACTGAGATTCGAGCTGCAGCCCATTG GAAGTACAAAGGAGAACATTGAGAAGAACGGGATTCTGTCTAGAGATGAGCAGAGGGCCGAA GACTACAAGAAAGTGAAGAACCTGATTGATAAATACCACAAACAGTTTATCAAAGACCGGCTG TGGAATTTTCAGCTCCCACTGGAGAATAAGGGGAACCTGGACAGTCTGGAGGAGTATCGCATC CTGTACGAGACCCCCAAGAGGGATGAGGCCGTGTTCACTGAGGTGAAGGACAACCTGAGGGC TCTGATTGTGAATCAGCTGAAGGCCAAGGGCAGCGCCTATGAGCGCATCTTCAAGAAGGAACT GATCCGGGAAGATCTGATTGAGTTTCTGGACATGGAGGAGGACAAGAAAACAGTGAGACAGT TCGCTGATTTTACCACCTACTTCACTGGATTCAACGAGAACAGGGCCAATATGTACAGCGCCGA GGGAGAAAAGTACTGCTATCGCATACAGACTGATCCATCAGAATCTGCCTAAGTTTATGGACAAC ATGAAAGCTTTTGCCCAAATCGTGCAGTCACCAGTGGCCGAACACTTTACCGACCTGTACTCCT ACTGGGAAGAGTACCTCAATGTGGCCTCCCATCGAGGAGATGTTTCAGCTGGATTTCTTCAGCCA GACCCTGACCCAGACCGGGATCGAAGTGTATAACTACATCATCGGCAAGAAGATTCTGGAGGA TGGAACCGAGATCAAGGGTATCAACGAGTACGTGAACTATTACAACCAGCACCAGAAGGATAA AAAGCAGCGCCTGCCCCTGCTGGTGCCACTGTACAAGCAGATCCTGTCTGACAGAGAGCGCCT GTCATGGCTCGCTGAGGAATTCGATTCCGATGAGAAGATGCTGAAGGCCATCAACGAGCTGTA TGTGCACCTGCACGACCTGCTGATGGGAAAGGAGAACGAGTCCCTTAGATCTCTGCTGCTGAA GCTCAAGGAGTATGACCTGAGCCAGATCAATATTGCCAATAACTTCTCTCTGACCGCCATCTGC CACCAGATGTTCGGCAGATATGACGTGTTCATTAACGGCATGAAGGATATTCTGAGAGCCATTA CACCCCACAAAAAGAAGGAGACCGAAGAGGAGTTTGAAGAGAGGATTTCAAAGATCCTGAAG ACCCAAAAGTCTATCAGTATCGCCGAGCTGAACAAGCTGCCACAGCCCGTGTGCGAGGACTGC TGCAAGCCCAAACTGGTTGAGGATTACTTCATGTCCCTGGGGGCAGTGGATGATGGCGTGACA CAGAAGCTCAACCTGTTCGCCCAGATCGAGAACGCCCACACAGATGCTCTGAGCGTGCTGCAG CTGACCGGCACAGGAGATACGCGTGTCTCAGAATAAGCCCGCCGTGGCCAAGATCAAAAACCTG CTGGACACCTTCAAAAATCTCCAGCATTTTATCCAGCCACTGCTGGGCAGCGGCGAGGAGAAT GAGAAGGACGAACTCTTCTATGGCTCCTTTCAGCTGTTCTGGGACGAGCTGGATGCTGTAACCC CACTGTATAACAAGGTGAGGAACTGGCTGACACGGAAGCCTTACTCCACCGAGAAGATTAAAC TGAATTTCGACAATGCCCAGCTGTTGGGCGGCTGGGACGTGAACAAAGAGAGCGACTGCACC GGCGTGCTGCTTAGAAAAGGGGCCTATTACTATCTGGGAATCATGAACAAAAAGGCCAATAGG ATTTTCGATGCCTGTATCACCCCCTCAAACGGCGACTGCTATGAAAAGATCGATTATAAGCTCCT GCCCGGCGCAAACAAGATGCTGCCAAAAGTGTTCTTTTCTAAGAGCCACATCGATGAGTATGCC CCCAGCGACGTGATCATCGAGAATTATAAAAAGGGCACACATAAGAAGGGCGCCGACTTCAGC CTGCAGGACTGCCACAGACTGATTGATTTCTTTAAGCAGTCCATCTCAAAGCACGAGGATTGGT CTAAATTCGGCTTTCAGTTTAGCCCCACCTGCTCATACGAAGATATCAGCGGGTTCTATCGGGA AGTGGAGCAGCAGGGCTATATGCTGTCCACACACCCTGTGTCTAGCGCCTATATCGATGAGAT GGTGGCCGAGGGCAAGCTGTTCCTGTTCAGGATTTGGAATAAGGATTTTTCCGAATACTCTAAA GGCACTCCCAATCTGCACACCCTGTATTGGAAGATGCTGTTCGACAAGAGAAACCTGGCCGAT GTGGTCTACAAGCTGAACGGCCAGGCCGAAGTGTTCTACAGGAAGGCTAGCATCAAACCAGAC AACCGGATCATTCACCCTGCTAACCAAGATATCAAGAACAAGAACGCCCTGAACGAGAACAAG ACTTCTAGGTTCGAGTATGATATCATCAAAGACCACAGATACACCGTGGATAAGTTCCAGTTTC ACGTGCCCATTACAATTAACTTCAAGGCCATCGGCCAGGCCAATATTAATCCCATTGTGAACAA TGCCATCAGGAAGGGCGTGTTCACACACATCATCGGAATCGATCGGGGAGAGCGGCACCTGCT GTATCTGTCCCTGATTGATCTGAAGGGGCGCATTATCAAACAGATGACCCTGATGAGATCGTG AATGAGTACAACGGCCACTCCCACGCCACCAATTATCGGGACCTGCTGGCCAACAGAGAGGGC GAGAGAACTACCGCCCGCAGGTCTTGGGATACCATCGAGAACATCAAGGAGCTGAAGGAAGG CTACCTGAGCCAGGTGATCCACGTGATTACCAAGATGATGGTGGAATACAAGGCCATCGTGGT CCTCGAAGACCTGAATACCGGCTTCATGAGGGGAAGGCAGAAGATCGAGAGACAGGTCTACG AGAAGTTCGAGCGGATGCTGATCGAGAAGCTGAATTGCTACATTGACAAACAGACAACCCCCA CCGCCGAGGGCGGCCTGCTGCATGCCCTGCTGCCAATAAATTCGAGAGCTTTAAGAAGC TGGGGAAGCAGTCCGGGTGCCTGTTCTACATCCCTGCCTGGAATACCTCTAAGATAGACCCCAC CACCGGGTTCGTGAATCTGTTCGACACCAGATACGAAACTCGGGAGAAATCGCGGCTGTTCTTC AGCAGATTTGATAGAATTGCCTATAACAGAGACAAAGATTGGTTCGAATTCTCATTTGATTACA ATAATTTCACAACCAAGGCCGAGGAGTGTCGGACCAGGTGGACCCTGTGTACCCAGGGAACCC GGATTATCAACTTTAGAACCCCTCAGAAGAACAATCAGTGGGAGGACGAGGAAGTGAACCTGA CCGTGCTGTTCAAGCAGTTGTTCGACCGGTACGACATCAACATCCATGGAAATCTGATGGAGAC AATTCAGCAGCAGACCGAGGCCAAGTTCTACCAGGAACTGATGCACCTGCTGAAGCTGACACT GCAGATGCGCAACTCTAGGACCAACTCCGAGGTGGACTACCTGCTTTCCCCTGTGGCTGATGAG CACGGACACTTCTTCGATAGCAGGAGGACATCGAAACTCTGCCAACAACGCCGACGCCAAC GGGGCCTACAACATTGCCCGGAAGGGCCTGTGGGTGATCAGAAAGATCCAGGAGACACCAGA GGGCGAGAGACCCTCCCTGGCCATCACAAATAAAGAGTGGCTGCAGTTCGCCCAGACTAAACC CTACCTGAATGATTGA |
| 189 | 149 | ATGACTCAGAAAATTCGACGACTTCATTCACTTATACTCTCTGAGTAAGACTCTGCGGTTCGAGGC AAGGCCCATCGGTGACACTCTGCGCAACTTTATTAAAAACGGGCTGCTTAAACGGGACGAACA TCGAGCCGAGTCATACGTGAAAGTGAAGAAGCTGATTGACAGTACCACAAGGCGTTCATTGA CAGAGTTTTGTCTAACGGGGGACTGAATTATGAGGATAAAGGGGAGTATGACTCCCTGACTGA GTACTATGTCCTATATTCCACGACCCGCCGGGACGAAACCACCCAGAAACATTTTAAAGCCACA CAGCAGAACCTGCGAGATCAGATAGTGAAAAACTCACGATGACGACGCTTATAAGCACCTT TTCGGCAAGGAATTGATCGAATCCTACAAAGACAAAGAAGATAAGAAGAAGTCCATGAGGCA GATCTGGTACAGTTCATTAATACCGCCAATCCGAAACAGAGACTGAATTTCTCTAAGAAGGAGG CTATTGACCTTGTCAAAGAGTTTTGTGGGTTCACCAGTTATTTTGGCGACTTCCACAAGAATAGA |

TABLE S9B-continued

Human Codon Optimized Nucleotide Sequences Group 9

| SEQ ID NO | Corresponding AA | Sequence |
|---|---|---|
| | | AAGAATATGTACAGCGCCGAAGAAAAGTCAACCGGTATCGCGTATCGCTTGATCAATGAGAAT<br>CTGCCAAAATTCATTGATAACATGGAGTCCTTCAAGAAAATTGCTGCAATCCCAGAAATGGAAG<br>ATAACCTGAAAGAGATTCACGACAATTTTGCCGAGCACTTAAATGTCGAGAACATTCAGAACAT<br>GTTCCAGCTCAACTATTATAACCAGTTGCTTACCCAGAAACAGATCGATGTGTACAATGCCATA<br>ATCGGGGGTAAAACGGATGAGGAGCATAAAGAAAAGATCAAGGGGATTAACGAATATGTGAA<br>CCTCTATAACCAGGCTCACAAGGACGCTAAGTTACCAAAGCTTAAGACCCTGTTTAAGCAGATA<br>CTCTCTGACCGTAACGCAATCTCCTGGCTGCCCGAGGAGTTCGACAATGACCAGGAGGCCCTCA<br>ACGCTATCTTAGACTGTTACGCGCGGCTCAGTGAAAATGTTCTGGGGAAGGAGAATCTTAAAC<br>GGCTGCTGTGCAGCTTGAGCGAATATGATACTAAGGGTATATTTCTGCGGAATGATCTCCAACT<br>TACGTCAATCTCAAAAAAGATGTCAGGTAGTTGGACTGATATCCCCTCTGCAATCAAAAATGAC<br>ATGAAGGATGGAGCCCCTGCCAAAAAAGAAAAGAAAGCGAAGAGGATTACGAAAAGCGCTT<br>TCGACAACCTGTTTAAGAAACTCGACTCTTTCTCTATAGGCTACATCGACGATTGTTTGAACAAG<br>TTCGACAACAACAATACCTTTACAATCGAAGGATATTTCAAGGAATTGGGAGCAAAAGATACCC<br>AGTCAGAAGACATCTTCAAGCAAATCGCTAACGCATACACAGACGTCAAGCCTCTCCTGAACTC<br>TCCTTACCCCAAGTCCAAGAATCTGAGCCAAGATAAGGAGAACGTCAAAAAGATTAAGAGGTT<br>CCTTGACGCCCTGATGTCCCTGGTTCACTTTGTGAAACCATTGCTGGGAAATGGCGATGAGAGC<br>AATAAAGATGAGAAGTTCTACGGAGAGCTCTCACTACTGTGGACAGAGTTAGAGACAATAGTG<br>CCTCTTTATAACATGGTACGAAATTACATGACACGGAAGCCATACAGTAACTCCAAGATCAAAC<br>TCAATTTCGAAAATAGCCAACTGCTTGGGGGGGATGTAAATAAAGAAAAGGAGCGCGCTT<br>CCATCCTACTCAGACGCAATGGCCTGTACTATCTGGCTATTATGGATAAAGACTCTAGCAAACT<br>GTTGGGCAAAAGTATGCCAAGCGACGGTGAGTGCTATGAGAAGATGGTGTATAAACAAATCTC<br>GTTTAACAGCGGCTTTGGGGGGTTCATTAGGAAGTGCTTTAACTCAGCTACGGAATTAGGATG<br>GAAATGTAGCCCTACATGCCTCAATAAGGATGGCAAGATAATAATACTCGACGAGGAAGCTAC<br>AGACATAAGACCAGAGCTCATTGACAACTATAAATCATTCCTCGATATCTACGAGAAAGATGGC<br>TATAAATACAAGAACTTTGGGTTTCACTTCAAGAAATCGTCTGAATATGAGAACATCAACGATT<br>TCTTCAAAGAAGTCGAGCAGCAAGGATATAAGATCACCTTCACGAATGTCTCAGTGGCATTTAT<br>CGACAAGCTGGTGAAAGAAGGAAAGATGTACCTTTTCCAAATCTACTCCAAGGATTTTTCCGAG<br>TACTCTAAGGGCACACCGAATATGCACACTCTGTACTGGAAAGCCTTGTTCGATGATAGGAACC<br>TAAAGGATGTTGTGTACAAGCTAGACGGCCAGGCTGAGATGTTTTTCCGAAAAAAGAGCATCA<br>ACTGTAATCACCCAACACATCCTGCCAATCAGCCCATTCAGAACAAGAACAAGGATAACAAGAA<br>AAAGGAGAGTGTCTTTAAGTATGACCTCACTAAGGACAGGAGATATGCCGTGGATAAGTTTAT<br>GTTTCATGTGCCTATCAAGATGAACTTTAAGTCCACTGGGACAGAGAGAACATCAACCTGCCTGTG<br>AGAGAGTACCTGAAAACTAGTAATGACACTCATATTATCGGAATTGACAGAGGCGAGAGGCAC<br>CTGCTCTACCTGGTGGTCATTGATTTACACGGTAACATCGTGGAACAGTATTCACTCAATGATAT<br>CGTAAATGAGTACAATGGCAATACTTACAGGACCAACTACCATGATCTGCTTGATGCTCGTGAA<br>GAAGACAGGCTGAAGCAGAGGCAGTCGTGGCAAACAATTGAGAACATCAAAGAACTGAAGGA<br>GGGTTACTTAAGTCAGGTTATACACAAGATAACCCAGCTGATGATCAAGTACCATGCAATCATA<br>GTGTTAGAAGATCTGAACATGGGATTTATGCGTGGCCGTCAAAAAGTGGAGAAGCAGGTCTAC<br>CAAAAGTTCGAGAAGATGCTGATTGATAAGCTAAATTACCTGGTCGATAAGAAGGCGGACATT<br>GAGAGCACTGGAGGTCTGCTTAACGCCTATCAGTTGACTAATAAGTTTCCCGGTTTCAAAACC<br>TGGGCAAGCAGAGCGGGTTTCTTTTCTACATTCCCGCATGGAACACCAGCAAAATCGACCCCGT<br>AACCGGGTTTGTTAACCTGCTCGACATTCGCAATGTTGATAAGGCCAAGGCATTCTTCGCCAAA<br>TTTGACAGCATTTGGTACAATAAAGAGAAGGACTGGTTTGAGTTTGCCTTAGACTATGATAAAT<br>TCGGCAGCAAAGCCGAGGGCACCAGAACTAAATGGACCCTTTGCACCCAGGGCAAACGCATCA<br>AGACATTCAGGAATGCCGACGAAAACTCCAACTGGGATTATCAGATTATAGACTTGACCAAGG<br>ATCTGAAGCAACTATTTGCCCAATACAATATCGACATCAATGGGAACCTAAAAGAAGCGATCTC<br>TAATCAGACAGAAAAGACGTTTTTCGTGGAGCTTTTGGGCCTGCTGAAACTGACATTGCAGATG<br>CGGAACAGTATTACCGGAACGGAAACCGATTATTTGGTGAGTCCGGTTGCCGACGAAAATGGA<br>AATTTCTATGATTCCCGAACATGCGGGCATAGCCTCCCTGAAAACGCCGACGCTAACGGAGCTT<br>TTAATATAGCACGCAAGGGCTTGATGATTATTGAACAGATTAAAGCGTCCGACAACCTCTCCAA<br>GCTCAAATTTGACATTTCTAACAAATCCTGGCTCAATTTCGCACAGCAAAAACCCTACAAACATG<br>AGTGA |
| 190 | 150 | ATGAAAAGAAAGTTCGACGATTTCATCCACCTGTACAGCCTGAGCAAGACTCTGCGATTCGAG<br>GCCAGCCCCATCGGAGACACACTGCGGAATTTCAAAAAGAATGGCCTGCTGGAGCGGGATAA<br>ACACAGAGCCGAGTCATACGTGAAAGTGAAAAAGCTTATCGACGAGTACCACAAGGTGTTTAT<br>CGATAGAGTGCTGAACGGCAGCGTGCTGAACTACGTGAACAAGGCAAGTATGACTCCCTGAC<br>AGAGTACTATGACCTGTACAGCGTCCCAAAGAAGGATGAAACCTCTCAGAAGCACTTCAAGGC<br>CATCCAGCAGCACCTGAGCAGCAGATTGTGAAGAAATTCACCGACGACAAAACTACAAGAG<br>ACTCTTTGGCAAAGAGCTGCTGGAGTCCTACAAGGATAAGAGGACAAGAAGAAGCTGAATG<br>AGGCCGACCTGGTGCAGTTCATTAATGCCGCCAACCCCGAACAGCTGCTGTCCCTGAGCAAGA<br>AGGAGGCCATCGATCTGGTGCAGGAATTTTCCGGATTCACCACTTACTTCAACGAGTTTCACAA<br>GAACAGGAAAATATGTACAGCGCCGAGGAAAAAGTACAGGCATCGCCTACAGGCTGATCA<br>ACGAGAATCTCCCAAAATTCATCGATAATATGAAGAGCTTCAAGAAGATCGTGGACATCCCAGA<br>GATGAAGGATAATCTCAAGCAGATCCACGAATATTTCGTGGACTACCTGAACGTCGAAAACATC<br>CACGAAATGTTTCAGCTGGACTACTATAACCAGCTGCTGACCCAGAAGCAGATCGACGTGTACA<br>ATGCAATTATCGGAGGGAAACCGACAATGAGCATAAGGAGAAATCAAAGGGATCAATGAG<br>TACGTGAACCTGTACAACCAGACCCACAAGGACGCCAAACTGCCCAAGCTGAAGGTGCTGTTT<br>AAGCAGATCCTGAGCGACAGGAACGCCATCAGTTGGCTGCCAGAGGAGTTCAAGGATGATCA<br>GGAGGTGCTGAACGCCATCAAGGATTGCTACGCCCGGCTGTCTAAAAACGTGCTGGGAGATAA<br>TATCCTGAAAGAACTGCTGTGCTCACTGGCCGAATACGACACCAAGGGCATCTTCCTGCGGAAC<br>GACCTGCAGCTGACCGATATTAGCCAGAAGATGTTTGGAACTGGTCAGTGATTCCCAGCGCC<br>ATTAAGAAGGATGTGGCCCCTGCAAAGAAGCGTAAAGAGCTGGAGGAGGACTATGAGAAACG<br>GATCGACAACCTGTTCAAGAAACGCGAAAGCTTCAGCATTGACTATATCGACAGCTGCCTGGAT |

TABLE S9B-continued

Human Codon Optimized Nucleotide Sequences Group 9

| SEQ ID NO | Corresponding AA | Sequence |
|---|---|---|
|  |  | AAATTCGACGAGAACAACACTCACACAATCGAGGGGTACTTTGCCACACTGGGCGCCGTTGAT<br>ACCCCCACCACACAGAGAGAGAACATCTTTGCCCAGATCGCTAACACCTACACAGACCTGGAAC<br>CACTGCTGAAGTCACCCTACAGCAAGAATAAGAACCTGAGTCAGGACAAGGACAATGTCGCCA<br>AGATTAAGCTGTTTCTGGATGCCCTGATGAGCCTGATGCACTTCGTGAAGCCACTGCTGGGCAA<br>GGGGGACGAGAGCAACAAGGATGAGAAGTTTTATGGCGACTTCACACTGCTCTGGACCGAGC<br>TTGAGACCGTTGGTGCCTCTGTATAACATGGTGAGAAACTACATGACCAGAAAGCCTTACTCAAA<br>ATCCAAAATTAAGCTGAATTTCGACAACAGCCAGCTGCTGGGCGGGTGGGACGCCAACAAGGA<br>GAGCGACTACGCTAGCATCCTGCTGCGCAGAGATGGGAAGTACTACCTGGCCATCATGGACAA<br>GGATTCTAAGAAACTGCTGGGCAAGAGCATGCCTTCTGACGGCGAGTGCTACGAAAAGATGGT<br>GTATAAGCTGCTGCCAGGCGCCAATAAGATGCTGCCAAAGGTCTTCTTTGCCACAAGCCGCATT<br>AAGGACTTCAAGCCATCAGAGCAGCTGCTGGAGAACTACAACAAGGGAACCCACAAAAAGGG<br>AGTCAATTTCTCCATCTCTGATTGCCATGCCCTGATCGATTACTTTAAGCAGTCCATTAATAAGC<br>ACGAGGATTGGAAGAATTTCAACTTTAACTTCAGCGAGACATCCACATACGAGGACCTGTCAGC<br>CTTCTACAGGGAGGTGGAGCAGCAGGGCTACAAGATCACCTTTACCAATGTGAGCGTGTCATT<br>TATCGACAAACTGGTGAGGAGGGCAAGATGTACCTGTTCCAGATCTATAACAAAGATTTTTCA<br>GAGTACTCCAAGGGCACCCCGAACATGCATACTCTCTATTGGAAGGCCCTGTTCGACGAGCGG<br>AACCTGAAGGATGTGGTGTACAAGCTGAATGGCCAGGCCGAAATGTTCTTCAGGGAGAAATCC<br>ATCAAGGTCAGCACAATCCACCCCGCTAATCGCCCTATCCAGAACAAAAATAAGGACAACAAG<br>AAAAAAGAGTCAATCTTCGAGTACGACCTCATCAAGGACAGGCGCTACACCGTGGATAAGTTC<br>ATGTTCCACGTGCCCATCACTATGAACTTTAAGTCTGCCGATACCGAGAACATTAATCTGCCCGT<br>GAGAGAATACCTGCAGACTTCTGACGACACACACATCATCGGAATCGATCGCGGCGAACGGCA<br>TCTGCTGTACCTGGTCGTCATCGATTTGCAGGGCAATATCGTGGAGCAGTATACTCTGAATGAT<br>ATTGTGAACGAATACAACGGCAACACCTACAGGACAAACTATCATGATCTGCTGAACGCTAGA<br>GAGGCAGAGAGGCTGAAGGCCAGACAGTCTTGGCAGACCATTGAGAACATCAAGGAGCTGAA<br>GGAGGGGTACCTGTCTCAGGTGATCCATAAGATCACCCAGCTGATGATTAAATACCACGCCATC<br>GTGGTGCTGGAGGATCTGAACAAGGGCTTTATTCGCGGCCGCCAGAAGGTGGAGAAGCAGGT<br>GTATCAGAAGTTCGAGAAAATGCTGATCGATAAGCTCAATTATCTGGTGGACAAAAAAGCTGA<br>TATCGAGACCACCGGGGGCCTGCTGAACGCCTACCAGCTGACCAGTAAATTCGAGTCTTTCCAG<br>AAACTGGGAAAGCAATCCGGTTTCCTGTTTTACATCCCCGCCTGGAACACAAGCAAGATCGATC<br>CAGTGACCGGCTTCGTGAATCGGCTGGACACCAGGTACCATAACGTGGACAAAAGTAAAGCTT<br>TTTTCGCTAAATTTGATAGCATCCGGTACAACAAAGAAAAGGACTGGTTTGAGTTCGCCCTGGA<br>CTATAAGAACTTTGGAAACAAGGCCGAAGGGACAAGAACAAAGTTGGACCCTCTCTGCACCCAGG<br>GCAAACGGATCAAGACATTCAGGAACGCCGAGAAAAATAGCAATTGGGACTACCAGATCATCG<br>ACCTGACTAAAGAACTGAAGCAGCTGTTCGCCCATTACGACATAGACATCAATGGCAATCTGAA<br>AAAGGCTATCTCTAACCAGACTGAGAAGACATTTTTCGTGGAGCTCATGCAGTTTCTGAAGCTG<br>ACCCTGCAGATGCGTAATTCAATCACCAACACTGAGACCGATTATCTGGTGTCCCAGTGGCCG<br>ATGAGAATGGCAATTTCTACGACAGCCGCAAATGCGGCTCCTCACTGCCCGAGAATGCCGACG<br>CTAACGGCGCTTTTAACATCGCTAGGAAGGGGCTCATGATCATCGAGCAGATCAAGGCAAGTG<br>ACGACCTGTCCAAGCTGAAGTTCGACATTTCTAACAAAAGTTGGCTGAACTTCGCCCAGCAGAA<br>ACCCTACAAACATGAATGA |
| 191 | 151 | CTGGTCCAGTTCATCAATACCGCCAATCTGAAGCAGAGACTGAACCTGAGCAAAGAAGAAGCC<br>AAAGACCTGGTGCAGGAATTTTGTGGCTTCACCACATATTTTGGCGACTTCTACCAGAACCGCG<br>AAAACATGTACTCCGCCGAGGAGAAGTCACCGGCATCGCCTACCGGCTGATCAACGAGAATC<br>TGCCCAAGTTCATCGATAATATGGAGACTTTTAAAAAGATCGCTGCCATCCCCGAGATGGAGGA<br>CAACCTGAAGGAAATTCACGACAATCTGTCTGAGCACCTGAATGTGGAGAACATCCAGGACAT<br>GTTTCAACTGAATTACTATAATCAGCTGCTGACCCAGAAGCAGATCGATGTGTACAATGCCATT<br>ATCGGCGGGAAGACCGATGATGAGCACAAAGAGAAGATTAAGGGCATTAACGAATATGTCAA<br>TTTATACAACCAGGCTCACAAGGACGCCAAACTGCCTAAGCTGAAGACCCTGTTTAAGCAGATC<br>CTGTCTGACAGGAATGCTATCTCCTGGCTGCCTGAAGAGTTTGACAACGATCAGGAGACCCTGA<br>ACGCCATCAAGGACTGCTATGCCCACCTGTCCGGCAACATCCTGAAGGACGAGAACCTGAAAC<br>GGCTGCTGTGCTCCCTGAGCGAGTACGATACCAAAGGCATCTTCCTGAGAAATGATAGCCAACT<br>GACCTCCATCTCCAAGAAAATGTCCGGGTCTTGGACAGACATCCCCAGCGCCATCAAGAATGAC<br>ATGAAGGACGGAGTGCCCGCTAAGAAGAGAAAAGAGAGCGAAGAGGATTATGAGAAACGGA<br>TCGACAACCTCTTCAAGAAGCAGGACTCTTTCAGCATCGATTACATGGATGCCTGCCTGAATAA<br>GTTCGTGGAAAACAACCCTTACACTATTGAGGGGTATTTCAAAGAGCTGGGGCTAAGGATAC<br>TCAGAGCGAAGATATCTTTAAGCAGATCGAGAACGCCTACACCGACGTGAAACCTCTGCTGAA<br>TAGCACATATCCTAAGAATAAGAACCTGTCCCAGGACAAGGAGAACGTGGCCAAGATTAAACG<br>CTTCCTGGATACCCTGATGAGTCTGGTGCACTTCGTGAAGCCTCTGCTGGGAAAGGCGACGA<br>GAGGAACAAGGACGAAAAATTCTATGGCGAGCTGTCCCTGCTGTGGACAGAACTGGAAACCAT<br>CGTGCCTCTGTACAACATGGTGAGAAATTACATGACCAGGAAGCCTTACTCCAACAGCAAAATC<br>AAGCTGAATTTTGATAACTCACAGCTGCTGGGAGGATGGGACGCCAACAAAGAAAGCGATTAC<br>AGCTCCATCCTGCTGTATAGGGATGGAAAGTACTACCTGGCCATCTTCGACAAGGATTCTAAGA<br>AACTGCTCGGGAAAGTATGCCCTCCGACGGGAGTGCTACGAGAAGATGGTGTATAAGCTG<br>CTGCCTGGAGCCAATAAAATGCTGCCCAAGGTGTTCTTCGCCAAGAGCAGGATTAAGGACTTTA<br>AACCCAGCGAGCAACTGCTGGAAAAGTATAACAAAGGTACTCACAAAAAGGGCAAGAATTTCT<br>CCATCAGCGACTGCCACGCACTGATTGACTTTTTCAAGCAGAGCATTAACAAACACGAAGATTG<br>GAAAAACTTTGACTTCAACTTTAGTGAGACCTCCACCTACGAGGACCTGAACTCCTTTTATAGG<br>GAGGTGGAACTCCAGGGCTATAAGATCACATTCACTAAGGTGGCGCTTCCTTCATCGACAAG<br>CTGGTGGAAGAAGGCAAAGTGTACCTGTTCCAGATCTACAATAAGGACTTCAGTGAGTATTCTA<br>AGGGCACTCCTAACATGCACACCCTGTACTGGAAAGCCCTGTTCGACGATAGAAACCTGAAAG<br>ATGTGGTGTATAAACTGAACGGCCAAGCCGAGATGTTTTTCAGAAAGAAGTCTATCAACTGCA<br>ACCACCCCACACACCCAGCAAACCAGCCCATTCAGAACAAGAACAAGGACAATAAAAAGAAGG<br>AGAGCGTGTTTGAATATGACCTGATCAAAGACCACCGGTATACCGTGGATAAATTCATGTTCCA |

TABLE S9B-continued

Human Codon Optimized Nucleotide Sequences Group 9

| SEQ ID NO | Corresponding AA | Sequence |
|---|---|---|
| | | TGTGCCCATTACAATGAATTTTAAGTCCACAAACGAGAAGGATATCAATCTGCACGTGCGCGAG
TACCTGCAGACCAGTAATGACACCCACATCATTGGCATCGACCGGGGCGAGCGCCATCTGCTGT
ATCTGGTGGTGATCGACCTTCACGGCAATATCGTGGAACAGTACACACTGAACGACATCGTGA
ATGAGTATAATGGCAATACCTACAGGACCAATTACCACGACCTGCTGGACGCAAGGGAGGAG
GACAGGCTGAAGCAGAGGCAGTCCTGGCAGACCATCGAGAACATCAAGGAACTGAAGGAGG
GATATCTGTCTCAGGTGATCCACAAAATCACCCAGCTGATGATTAAATACCACGCCATTATCGT
GCTGGAAGACCTGAATATTGGCTTCATGAGGGGCAGACAGAAAGTGGAGAAGCAGGAGTACC
AGAAGTTCGAGAAGATGCTCATCGACAAGCTGAACTACCTGGTGGACAAGAAAGCTGATATCG
AGAGCACCGGAGGCCTGCTCAACGCCTATCAGTTGACCAATAAGTTCGCCAGCTTTAAAAAGCT
GGGGAAGCAGTCCGGCTTTCTGTTTTACATCCCTGCCTGGAATACGAGCAAAATTGATCCTGTG
ACTGGCTTCGTGAATCTGCTGGACACCCGTTATCAGAACGTGGACAAGGCTAAGGCTTTCTTCG
CCAAATTCGATAGCATCAGGTACAACAAGGACAAGGACTGGTTCGAGTTCGCCCTGGATTACA
ACAATTTCGGCAGCAAGGCCGAGGGAACCAGGACCAAATGGACACTGTGTACACAGGGAAAG
AGAATCAAGACATCCTTCAATAAGATGAGTTCCAAATGGAACAACCAGGAAATCGACCTTACTA
AGGATCTGAAACAGCTGTTTGTGCAGTACGATATCGATATCAACGGCAACCTGAAAGAGGCCA
TCTCTAAACAGACCAAATATACCTTTTTCGTGGAGCTCATGGGCCTGCTGAAGCTGACCCTGCA
GATGAGAAATTCCATCACCGGAACCGAGACAGACTACCTGGTGTCCCCCGTGGCCGACGAGAA
TGGCAATTTCTATGACTCCAGAACCTGTGGCCCCAGCCTTCCTGAGAACGCCGATGCCAACGGC
GCCTTCAACATCGCCCGGAAGGGTCTGATGATTATCGAGCAGATTAAGGCATCCGACGACCTG
AGCAAGCTGAAGTTCGATATCAGCAATAAGAGCTGGCTGAATTTTGCCCAGAAGAAGCCCTAC
AAGCACGAATAG |
| 192 | 152 | ATGGCCAAGAAATTCGAGGACTTTACCAAACTGTATCCTCTGTCCAAGACCCTGTGCTTCGAGG
CCAGGCCTATCGGAGCCACTAAGTCCAATATCATTAAGAATGGACTGCTGGACGAAGACAAGC
ATAGAGCTGAGAGCTACGTGAAAGTGAAGAAGCTGATTGACGAGTATCACAAGGCCTTTATCG
ACAGGGTGCTGGCCGACGGGTGTCTGTGTTACAAGAACGAGGGAAACGAGGACTCACTGGAG
GAGTATTACGAGTTCTACAGCCTCTCCTCCAAGGATAAAAGCGATGACACCCAGAAAGCACTTTG
CTACAATCCAGCAGAACCTGCGGTCTAAAATCGCCGAGACCCTGACCAAGGACAAAGCCTACG
CTAACCTTTTCGGGAACAAACTGATTGAATCACATAAAGATAAGGAGGATAAGAACAATATCAT
TGATAGTGATCTGATCCAGTTTGTGAGCACCGCTACCCCCGATCAGCTGGACAGCCAGAGCAA
AGATGATGCCACCAAACTGATTAAGGAGTTCTGGGGATTTACTACCTACTTCACCGGGTTTTTC
GAAAATCGGAAAAACATGTACACAAGCGAAGAGAAGTCCACAGGGATCGCATACAGGCTGAT
CAATGAGAACCTGCCCAAGTTTATTGATAACATGGAAAGCTTCAAAAAGATCATGGAGAAACC
CGAAATGTCCGCCAACATGGAGGAACTGAGAGCCAACCTGGAAGAGTACCTGAACGTGGAAT
CCATCTCCGAAATGTTCGAGCTGAATTACTACAACATGCTGCTGACTCAGAAGCAGATCGACGT
GTATAATGCCGTGATCGGCGGCAAGACCGACGAAGAACGGAGTATATCAAAACAAAGGGAATTA
ATGAGTACGTGAACCTGTATAATCAGCAGCACAAAGACGCCAAGCTGCCCAAGCTGAAGACCC
TGTTCAAGCAGATTCTCAGCGACAGAAACGCTATTTCATGGCTGCCCGAAGAGTTCGACAAGG
ACCAGAATGTGCTGAATGCCATCAAGGACTGTTACGTGAGACTGACCGCAAACGTGCTGGGCA
ACAATGTGCTGAACAGCCTGCTGAGCACTCTGTCTGAGTACAACACAGAGTCAATCTTCATCAG
GAACGACATCCAGCTGACTAACATTTCCCAGAAGATGGCCGGCTGGAACTACATCCAGGA
CGCCATCAAGCAGGACATCAAGAACGTGGCCCCTGCCCGTAAGAGAAAAGAGAGCGAGGAGG
ACTATGAGGAGAATCTCTAAAAACTTCAAGAAGGCCGACTCCTACTCCATCAAATACATTGA
CGACTGCCTGAATCGCGCCTACAAGAACAACACCTACACAGTGGAGGGCTACTTCGCCACCCTT
GGCGCCACCAATACCCCTTCCCTGCAGAGGGAGAATCTGTTCGCCCAGATCGCTAACGCCTATA
CAAACATCTCCAGCCTGCTGTCTAGCGACTACTCCGCCGAAAAAAACCTGGCCCAGGATAAGG
AGAATGTGGCCAAGATCAAGACCCTGCTGGACTGCATCAAATCACTCCAGCATTTCGTGAAACC
ACTGCTGGGAAAAGGGGACGAGTCAGATAAAGACGAGAGGTTCTACGGCGAGCTGAGCATGC
TGTGGAAAGAACTGGATACTGTGACCCCTCTGTATAACATGGTGAGGAATTACATGACCCGCA
AGCCTTACAGCCAGAAGAAGATCAAGCTGAACTTCGAAAACCCCCAGCTGCTGGGAGGCTGGG
ATGCCAACAAGGAGAAAGACTACGCCAGCATCCTGCTGCGCAGGGACGGCAAATACTATCTGG
GAATTATGGACAAAGAGAGCAAGAAGCTGCTCGGAAAGCCCATGCCTAGCGATGGCGATTACT
ACGAAAAGATGGTGTACAAGTTTTTTAAAGATATTACAACCATGATCCCAAAGTGTAGCACCCA
GCTGAAGGCCGTGAAGGAGCACTTTTCTAAGAGCAACGCTGACTTCGTGCTGTCCGGCAAAAA
CTTCAATACCCCACTGATCATTTCCAAAGAGGTCTTCGAACTGAACAATGTGAAGTATGGGCAG
TTCAAGAAATTCCAGAAGGACTATGTGGCCACCACCAACGATATCGAAGGGTACGCCCACGCC
GTGAAGATCTGGATTAAGTTCTGCATGGATTTCCTGGGCACCTACGACAGCACTATTTCTTATG
ACCTGTCAAGTCTGGCCAGTAACGAGTATACCAGCTTGGATACATTCTACCAGGATGTGAATCG
CCTGCTGTATGCCGTGAGCTTCATCAAGTGAGCGTGTCTCATATCGACTCCTGGTGGAGGAA
GGAAAAATGTACCTGTTCCAGATCTATAATAAAGACTTCAGCGAATATAGCAAGGGTACCCCCA
ACATGCACACCCTGTACTGGAAGGCCCTGTTCGATGAGAGGAATCTGGCCGACGTGGTGTATA
AGCTGAACGGACAGGCCGAGCTCTTCTATAGAGAGAAGTCCATCGATTGCACACACCCTACTCA
CCCAGCCAACCACCCAATCTTGAATAAGAATAAGGACAACGAAAAAAAGGAGTCCATCTTCGA
GTACGACCTCATCAAGGACCGCCGATACACCGTGGATAAGTTCATGTTCCACGTGCCCATTACT
ATGAATTTCAAAAGCACCGGGCCGACAATATCAATCAGCTGGTGAGAGAGCACCTGAAGGAC
GCCGACGCCCCCACATTATCGGAATCGACAGAGGTGAGAGACACCTGCTCTATCTGGTGGTC
ATTGATATGCACGGCAACATCAAAGAGCAGTTCACCCTGAACGACATCGTCAATGAGTATAATG
GCAACACCTATCGGACCAATTATCACGATCTGTTGGATGCTCGGGAGGACGCAAGGCTGAAGG
CCAGGCAGAGCTGGCAGACAATTGAGAATATCAAGGAGCTGAAGGAAGGCTACTTGTCTCAG
GTGATTCACAAAATCACCCAGCTGATGGTGAAGTACCATGCTATTGTAGTGCTGGAGGACCTG
AGCATGGGTTTCATGAGGGCAGGCAGAAGGTGGAAAAACAGGTGTATCAGAAGTTTGAGAA
GATGCTGATCGACAAGCTGAACTACTATGTGGACAAGAAGGCCAACGCCGAGCAGGCTGGAG
GTCTGCTGAATGCCTACCAGCTGACCTCCAAATTCGACTCTTTCCAGAAGCTCGGCAAGCAATCT
GGATTTCTGCTGTACATTCCCGCCTGGAACACATCCAAGATTGACCCAGTGACCGGCTTTGTGA |

TABLE S9B-continued

Human Codon Optimized Nucleotide Sequences Group 9

| SEQ ID NO | Corresponding AA | Sequence |
|---|---|---|
| | | ATCTGCTGGACACCCGCTACCAGAATGTGGAAAAGGCCAAAGCCTTCTTCTGCAAATTCGAGGC CATCAGATATAACTCCAACAAGAATTGGTTCGAATTTACCATTGATTACAACAACTTCGGCCAG AAAGCCGAGGGCACAAGGACAAAATGGACCCTGTGCACACAGGGGAAGAGAATCCGGACCTT TAGGAACCCCGAGAAGAACTCCGAGTGGGACAATCAGGAGATCGATCTGACCAGCGCCCTGA AGAACCTGTTTGCCCACTACCACATCGACATCAATGGGAACATTAAGGAGGCCATCTCCGCACA GTCTGACAAGACCTTTTTTACCGAGCTGCTGCATCTGCTGAAGCTGACCCTGCAGATGCGGAAC AGTATCACTGGAACTGAAACAGATTACCTGATTTCTCCCGTGGCCGACGACAATGGCTATTTCT ATGACAGCAGGACCTGTAATGATACTCTGCCCAAGAATGCCGACGCCAACGGCGCCTACAATA TAGCCAGGAAGGGCCTGATGCTGATCGAGCAGATTAAGAAGGCAAAGGATATCGCTAATATCA AATTCGATATTAGCAATAAGTCTTGGCTGAACTTCGCTCAGCAGAAACCTTATAAGGACGAGTA A |
| 193 | 153 | ATGATTAAGGAGTTCGAGGACTTCAAAAGGCTGTATCCTATCCAGAAAACCCTGAGGTTCGAG GCTAAACCTATCGGAAGCACCCTGGAACACCTGGTGAAGTCAGGTATCCTCGATGAAGACGAG CATCGGGCCGCCAGCTACGTGAGGGTGAAGAAGCTGATTGATGAGTATCACAAGGCCTTTATC GATAGAGTGCTGAACGACGGATGCCTCCCCTTTAAGAATAAGGGCGAGAAGAATTCCATTGAA GAGTACTACGAATCATACACCAGCAAGGATAAAGAGGAGGATAGCAAGAAGAGGTTCAAAGA GATCCAGCAGAACCTGCGAAGCATCATCGTGAATAAGCTGACAAAAGACAAGGCCTATGCCAA CCTGTTTGGGAACTACCTGATCGAATCCCATAAGGATAAGGAAGACAAGAAAACAATGATCGA CAGCGACCTGATCCAGTTTATTAAAGACGCCGACTCTCTGGAGCTGGGCTCTATGTCTAAGGAC GAAGCCATCGAGCTGGTGAAGGAGTTTTGGTCCTTCACCACCTACTTTGTGGGCTTCTACGACA ATAGGAAGAACATGTATAGCGCCGAGGAAAAGAGCACAGCCATTGCCTACCGGCTGATCAAC GAGAACCTCCCCAAGTTCATTGATAACATGGAGGCCTTCAAGAAAATTATAAGCAGACCTGAG ATTCAGGCCAACACGGAGCAGCTGTACAGCGACTTTGCAGAGTACCTGAACGTGGAATCCATT CAGGAGATGTTCCAGCTGGATTATTATGACATTCTGCTGACTCAGAAACAGATCGACGTGTACA ACGCCATCATTGGGGGAAGACCGACGAGAAACACGACATCAAGACCAAGGGCATCAATGAG TACATTAATCTATATAACCAGCAGCACAAGGAGGACAAGCTCCCCAAGCTGAAAGTGCTGTTCA AACAGATCCTGAGCGACCGAAATGCCATCTCCTGGCTCCCTGAGGAGTTTAACTCCGACCAGGA GATGCTGATCTCTATCAAAGACTGCTACGAGAAACTGTGCGTGAACGTGCTGGGCGACAAGGT TCTGAAGAGCCTGCTGTCCTCCCTGGACGACTATGAGCTGGAGGGCATCTTTCTGCAGAATGAC CAGCAGCTGACAAATATCAGCCAGAAGATTTTTGGCTCCTGGAGCGTGATCCAGGAAGCTATT ATTAGGAATATCAAGAATACCGCCCCCGCCAGGAAGCATAAGGAGACAGAGGAGGATTACGA GAAGAGGATCTTCAGCATTTTTAAGCAGGCTGGGAGCTTCAGTATTAAATACATCGACGACTGC CTGTATGACCTGGACAAGAATAACATCAACACAATTGAGAACTACTTTGCCACTCTGGGCGCCG AGAATACCCCCGAGATCCAGAGAGAGAATCTCTTTGCTCTGATCAAGAACGCCTATACTGATGT GGCCGGACTGCTGTGCAGCGAGTACCCTACTGAGAAGAATCTGTCACAGGATGAAAATCACGT GGCCAAAATTAAGGCCCTGTTGGATGCTATCAAGAGCCTGCAGCACTTTGTGAAACCTCTTCTG GGCAATGGAGACGAACACGATAAGGACGAGAGGTTCTATGGAGAGCTGGTGTCCCTCTGGAC AGAGTTAGACACCGTGACTCCCCTGTACAACATGGTGCGCAACAGGATCACACAGAAACCTTAT AGCCAGAAGAAGATCAAGCTGAATTTCGAGAACCCCCAGCTGCTGGGAGGATGGGACGCCAA CAAGGAGAAAGACTACTCCTGTATCATCCTGCGCCGGGAGGGCATGTATTACCTGGCCATCAT GGACAAGGATAGCAGAAAGCTGCTGGGCAAAGAGATGCCTAGCGACGGCGAGTGTTACGAG AAGATGGTTTACAAGCTGCTGCCCGGCGCTAATAAAATGCTGCCCAAGGTGTTCTTCGCCAAGT CCCGGATCGAGGAGTTCATGCCCTCCGAGCAGATCATCGAAAAGTACAACAACGGCACCCATA AAAAGGGCAAGGATTTCAACATCACCGATTGCCACAACCTCATTGACTACTTTAAGCAGTCTAT CAATAAACACGAAGACTGGTCCAAGTTCGGGTTTACTTTCTCAGAGACTAGCACCTACGAGGAC CTCAGCGGGTTCTACAGGGAGGTCGAGCAGCAGGGGTATAAGCTGAGTTTCACCAATGTTTCC GCCAGCTATATCAATAGCCTGGTGGATGAGGGAAAGATGTATCTGTTTCAGATTTACAACAAG GACTTCTCCGAATACAGCAAGGGCACTCCTAACATGCACACCCTGTATTGGAAGGCACTGTTCG ATGAGCAGAACCTGGCCGACGTGGTGTACAAGCTCAATGGCCAGGCCGAGATCTTTTACAGGA AGAAGAGCATCGATGCCACCCACCCCACACACCCAGCCAACAGACCTGTGCAGAACAAGAACA AGGACAACAAGAAGAAGGAATCCCTGTTCGAGTACGACCTGATCAAAGACCGGAGATACGAC GTGGACAAATTTATGTTTCATGTGCCTATCACCATGAATTTTAAGTCCAATGGCTCCGAGAATAT CAACCAGCAGGTGAAAGAGTACCTGCAGCTGGCCAACGACACCCACATCATTGGCATTGACAG GGGAGAGCGCCACCTGCTGTACCTGGTGGTGATCGACATGCATGGGAATATTAAGGAGCAGTT TAGCCTGAATGAGATCGTGAATACCTACAAAGGAAATATCTACCACACTAATTATCACGACCTG CTGGAGGCCCGGGAGGAGGAGAGGCTGAAAGCCCGGCAGAGCTGGCAGACAATCGAGAACA TTAAGGAGTTGAAGGAGGGCTACCTGTCTCAGGTGGTGCACAAAATCACCCAGCTGATGGTGA AGTATCACGCCATCGTGGTGCTGGAGGACCTGAACATGGGATTCATGAGGGGCCGGCAGAAG GTCGAGAAGCAAGTGTATCAGAAGTTCGAGAAGATGCTGATCGACAAGCTGAATTACCTGGTG AACAAACAGGCTAATATTACAGAGGCCGGGGGGCTGCTGAATGCCTATCAACTGACCTCAAAA TTTGACAGTTTTCAGAAGCTGGGCAAGCAGAGCGGCTTCCTGTTCTACATTCCTGCCTGGAACA CCTCCAAGATCGACCCCGTGACCGGCTTCGTCAACCTGCTGGATACCAGGTACCAGAATGTGGA GAAGGCCAAGGCCTTTTTCAGCAAATTTGACGCCATCAGATTCAACCAGGATAAAGACTGGTTT GAGTTCAACCTGGACTACAACAATTTGGGGAGAAGGCCGAGGGAACCAGAACCAGATGGAC TCTGTGTACCCAGGGGAAGAGAATATACACATTCAGAAACGAGGATAAAAATTCTCAGTGGGA CAACATTGAGATCGATCTGACTTCCGAAATGAAATCCCTGCTGGAGCTGTACCACATCGATATT CAGGGCAATCTGAAGGAGGCCATCAATAGCCAAACCGATAAGTCCTTCTTTACAAAGCTCATCC ACCTGCTGAAGCTCACACTGCAGATGAGGAACTCTATTACCCGACAGAGACTGACTACTTCGAT TAGCCCCGTGGCCGACGAGGATGGCGAGTTCTACGACAGCAGATCCTGTGGTCCTGAGCTGCC CAAGAACGCCGACGCCAACGGCGCATACAACATTGCTAGAAAGGCCTGATGCTGATCAGGCA GATCAAGGAGGCAAAAGAGCTGGATAAGATCAAGTTCGATATCTCTAACAAAGCCTGGCTGAA TTTCGCCCAGCAGAAACCATACAAGAATGACTGA |

TABLE S9B-continued

Human Codon Optimized Nucleotide Sequences Group 9

| SEQ ID NO | Corresponding AA | Sequence |
|---|---|---|
| 194 | 154 | ATGGCTAAGATTTTCGAGGATTTCAAGCGGCTGTACCCTCTGAGCAAGACACTGAGATTCGATG
CTAAGCCCGTGGGCGCTACCCTGGACAACATAGTGAAAAGCGGCCTGCTGGAGGAAGACGAG
CACAGGGCCGCCTCCTACGTGAGAGTGAAGAAGCTCATTGACGAGTACCACAAGGTGTTTATT
GACCGGGTCCTCGACAATGGGTGTCTGCCCCTGGAGAACAAGGGCGAAAATAATTCACTGGCC
GAGTACTACGACTCCTATGTGTCAAAAAGCCAGAACGAGGACGCCAAGAAGGCCTTTGAGGAA
AACCAGCAAAACCTGAGATCCATCATCGCCAAGAAGCTCACAGGAGACAAGGCTTATGCTAAC
CTGTTTGGTAAGAATCTGATCGAGAGCTATAAGGATAAAAAAGACAAAAAAAAAATTATCGAT
TCTGATCTGATTCAGTTCATCAATACCGCCGATTCCACCCAGCTGGATTCTATGACCCAGGTGGA
GGCCAAAGAGCTGGTGAAGGAATTCTGGGGCTTTGTGACCTATTTCTACGGCTTCTTTGACAAC
AGAAAGAACATGTACACTGCCGAGAAGAAGAGCACCGGCATTGCCTACCGGCTGATTAACGA
GAATCTTCCTAAGTTCATTGACAATATGGAGGCCTTCAAGAAGGTGATTGCCCGCCCCGAGATA
CAGGCCAACATGGAAGAGCTGTACTCCGATTTCAGCGAGTACCTGAACGTGGAATCAATTCAG
GAGATGTTCCAGCTGGATTACTACGATATGCTGCTGACTCAGAAGCAGATCGATGTGTATAACG
CCATCATTGGCGGCAAGACAGACGACGAGCACGACGTGAAGATCAAGGGGATTAACGAGTAC
ATCAACCTCTACAATGCAGCACAAGGACACCCGGCTGCCTAAGCTGAAGGCCCTGTTTAAAC
AGATTCTGTCCGACAGGAATGCCATCTCCTGGCTGCCCGAGGAGTTTAACAGCGATCAGGAGG
TGCTGAATGCTATCAAGGATTGTTACGAGCGGCTGTCTGAGAACGTGCTGGGAGATAAAGTGC
TGAAGTCACTGCTGGGCAGCCTGGCCGATTACTCACTGGAGGGCATCTTCATCAGAAACGACCT
CCAGCTGACCGATATCAGCCAGAAGATGTTTGGCAACTGGGGTGTTATCCAGAACGCTATCAT
GCAGAATATCAAACATGTGGCCCCTGCCCGGAAACACAAGGAGTCCGAGGAGGAGTACGAGA
AACGGATTGCCGGCATCTTTAAGAAGGCAGACTCCTTTAGCATTTCCTATCTGAACGATTGCCT
GAATGAGGCCGACCCCAATAATGCATACTTCGTGGAGAATTACTTCGCTACTTTTGGCGCCGTG
AACACCCCAACAATGCAGCGGGAGAACCTGTTCGCTCTGGTGCAGAACAAGTACACAGAGGTG
GCTGCCCTGCTGCACTCTGATTACCCAACCGCAAAGCACCTGGCCCAGGATAAGGCTAACGTG
GCCAAGATCAAGGCCCTGCTGGACGCTATCAAGAGCCTGCAGCATTTCGTGAAACCTCTGCTG
GGAAAGGGTGATGAGAGTGACAAGGACGAGCGCTTCTACGGCGAGCTGGCCAGCCTGTGGGC
CGAGCTGGAGACTGTGACACCTCTGTACAATATGATCCGCAATTACATGACAAGAAAGCCCTAC
TCTCAGAAGAAGATTAAGCTGAACTTCGAGAATCCCCAGCTGCTGGACGGGTGGGACGCAAAC
AAGGAGAAGGATTATGCCACCATCATCCTTAGACGGAATGGCCTGTACTACCTGGCCATCATG
GGAAAGGACTCAAAGAACCTGCTGGGGAAGGCTATGCCCAGCGACGGAGAGTGCTATGAGAA
GATGGTGTACAAGCAGTTCGACATTTCCAAGCAGCTGCCAAAATGCACCACAGAGCTGAAACA
CGTGAGGAAGGCTCTGGTGGAGGACGCCAAGAGAAGCTGCCTGCTGAGCGACTTCAATAATT
GGAACAAGCCACTGAACGTGACTAGGAAGCTGTGGGAGCTGAACAATTTCGTGTGGGACAAG
AAGAAAGAGGATTGGGTGCTGAGAAAGAAGGATAACGAGACCAGACCAAAGAAGTTTCACAA
AAAGTACCTGGAGCTGACCAGCGACAAGAAGGGCTACAACCAGGCAAAGAATGACTGGATCA
AGTTCACCAAGGAGTTCCTGAGCAGCTATAAAAAGGTGGAGGCATACGACATCCACTATAAGA
AAAGGTACAATTCTGTGGACGAGCTGTACAAGCAGCTGAACGGGGACCTGTATGCAATCTCTT
TCACATACGTGAGCGCTTCTTTCATTGAACAGCTGGTGTCTGAAGGAAAGATGTACCTGTTCCA
AATCTACAACAAGGACTTCAGTGAGTACTCCAAGGGAACTCCCAATATGCATACACTGTATTGG
AAGGCTCTCTTTGACGAGAGGAATCTCGCCGATGTGGTGTACAAACTGAACGGGCAGGCAGAA
ATGTTCTACCGCAAGAAATCTATCGAGAACACCACCCAACCCATCCAGCCAATCATCCAATCCT
GAATAAGAATAAGGATAACAAAAGAAGGAGAGTCTGTTTGATTACGATCTGATTAAGGACAG
AAGGTACACAGTGGACAAGTTTATGTTTCATGTTCCTATCACCATGAATTTTAAGAGCAGCGGG
AGCGAGAACATCAACCAGGACGTGAAGGCATACCTGAGACATGCCGACGATATGCACATCATC
GGTATCGATAGAGGCGAGAGACATCTGTTGTACCTGGTGGTGATCGACCTGCAGGGCAACATC
AAAGAGCAGTACTCACTGAATGAGATCGTGAACGAATATAACGGCAACACATACCACACCAAC
TACCATGATCTGCTGGACGTGCGGGAAGAGGAGCGGCTGAAGGCCCGGCAGAGCTGGCAGAC
CATTGAAAACATCAAAGAGCTGAAGGAGGGCTACCTGAGCCAGGTGATCCATAAGATCACCCA
GCTGATGGTGAAATACCACGCAATCGTGGTGCTCGAAGACCTGAACATGGGGTTCATGAGAGG
CCGCCAGAAGGTGGAGAAACAGGTGTACCAGAAGTTCGAGAAGATGCTGATCGATAAGCTCA
ATTACCTGGTGGATAAGAAGGCTGACGCTTCCGTTTCCGGCGGACTGCTGAATGCCTACCAGCT
GACCTCTAAGTTTGATTCCTTCCAGAAAATGGGGAAGCAGAGCGGATTTCTGTTTTACATCCCC
GCTTGGAATACCAGCAAGATCGACCCTGTGACCGGATTCGTGAACCTGCTGGATACCCGGTATC
AGAACGTGGAAAAGGCCAAAGTGTTCTTCAGTAAGTTTGACGCCATCAGGTACAACAAGGATA
AGGATTGGTTCGAATTTAACCTGGATTATGACAAGTTTGGAAAGAAGGCCGAGGGGACCAGA
ACAAAATGGGCTCTGTGCACCAGGGGCATGAGGATCGACACTTTCCGCAACAAGAGAAGAA
CTCTCAGTGGGATAACCAGGAGATTGATCTGACAGCCGAGATGAAGAGCCTGCTGGAGCACTA
CTACATCGACATTCACGGCAACCTCAAGGACGCCATCTCCGCCCAGACCGATAAGGCTTTCTTT
ACCGGGCTGCTGCATATTCTGAAGCTGACACTGCAGATGAGGAACTCCATTACCGGGACCGAG
ACCGACTATCTCGTGAGCCCCGTGGCCGACGAAAATGGGATCTTCTACGACAGTAGGAGCTGC
GGGGACGAGCTGCCAGAGAACGCCGATGCCAATGGTGCTTATAATATCGCCAGGAAGGGCCT
GATGATGATCGAGCAGATCAAAGACGCCAAGGACCTGAACAACCTGAAATTCGATATCTCTAA
CAAGGCGTGGCTGAACTTCGCCCAGCAGAAGCCCTATAAGAACGGATGA |
| 195 | 155 | ATGGAGTTTAACGATTTCAAGCGCTTGTATCCCCTGAGCAAGACCCTGAGGTTCGAGGCCAAGC
CTATCGGCGACACCCTGAAGAACATCATCAAGAATGGCCTGCTGGAGGAGGACGAGCACAGG
GCCCAGAGCTATGTGAAAGTGAAGAAGCTGATTGACGAGTACCACAAAGTGTTCATCGACCGT
GTGCTGAATGACGGATGCCTGACCATCGAAACAAGGGAAAAAAGGATTCTCTGGAGGAGTA
TTATGAGTCCTATATGTCCAAGTCCAATGATGAGAATGTGTCTAAGCACATTCAAGGACATCCAG
GAAAACCTGCGCTCTGTGATCGCCAACAAGCTGACCAAGGACAAAGGCTACGCCAACCTGTTT
GGAAATAAGCTGATCGAGTCCTATAAGGATAAGGACGATACAAAGAAGATCATTGATAGCGAC
CTGATCCAGTTTATCAATACCGCCGAGCCTAGCAATCTGGACTCAATGTCCCAGGATGAGGCAA
AGGAGCTGGTTAAAGAGTTCTGGGGCTTTACCACCATTTCGAAGGGTTCCACAAGAACAGAA
AGAATATGTACACCTCAGAAGAAAGAGTACCGGAATCGCCTACAGGCTGGTGAACGAAAACC |

TABLE S9B-continued

Human Codon Optimized Nucleotide Sequences Group 9

| SEQ ID NO | Corresponding AA | Sequence |
|---|---|---|
| | | TGCCTAAGTTTATCGATAATATGGAGGCCTTCAAGAAGGCCATCGCCAAGCCCGAGATCCAGG<br>CTAATATGGAGGAGCTCTATAGCAATTTTGCTGAGTACCTGAACGTGGAATCCATCCAGGAAAT<br>GTTTCAGCTGGACTACTACAATATGCTGCTGACCCAGAAGCAGATTGACGTGTACAACGCCATC<br>ATCGGCGGCAAGACCGACGAAGACCACGACGTGAAGATCAAGGGCATCAACGAATACATCAA<br>CCTGTACAATCAGCAGCACAAAGATGAGAAACTGCCCAAGCTGAAAGCACTGTTTAAGCAGAT<br>CCTGAGTGACCGGAACGCCATCAGTTGGCTGCCTGAAGAATTTAACTCCGATCAGGAAGTGCT<br>GAACGCAATTAAGGATTGTTACGAGCGCCTGAGCGAGAACGTGCTGGGAGACAAGGTGCTGA<br>AGAGCCTGCTGTGCAGCCTCTCTGACTACAACCTGGATGGCATCTTCGTGAGAAATGACACCCA<br>GCTGACCGATATAAGCCAGAAATGTTTGGCAATTGGTCTGTCATTCAGAATGCCATCATGCAG<br>AACATTAAGAAAAGAAACTGGCCCGGAAAAGAAAAGAATCTGAGGAGGATTATGAGAAGAG<br>AATCCCTGATATTTTTAAGAAGGCCGACTCTTTCAGCATCCAGTACATTAACGACAGCCTCAATA<br>AAATGGACGATAATAACCTGCACGCAGTTGATGAATATTTTGCGACACTGGGCGCTGTGAACA<br>CACCAACAATGCAGCACGAAAATCTCTTCGCCCTGATCCAGAACGCCTACACCGACATCTCCGA<br>CCTGCTGGACACACCATACCCAGAGAATAAGAACCTGGCCCAGGATAAGACAAATGTGGCTAA<br>GGTGAAGGCCCTGCTCGACGCCATTAAGAGCCTGCAGCACTTCGTGAAGCCCCTTCTGGGCAA<br>GGGCGATGAAAGCGACAAAGATGAGCGCTTCTACGGCGAACTGGCCAGCCTATGGACCGAGC<br>TGGACACCGTGACACTGCTGTTTAACATGGTGCACAATTACATGACCAGAAAACCCTACTCTCA<br>GAAGAAGATCAAGCTGAACTACAAAACACCCAGCTGCTGGCTGGCTGGGATGCGAACAAAG<br>AGAAAGAGCACGCCGCCATCATCCTGCGGAGAAACGGTATGTATTACATCGCCATCATGGACA<br>AAGACTCCAAGAATCTGCTGGATAAAGCTATGCCCAGTGACGGCGAGTGCTACGAAAAGATGG<br>TGTATAAGCAGTTTGATATTTCAAAGCAGCTGCCTAAGTGCACAACTGAGCTGAAACGCGTCCG<br>CAAGGCCCTGATAGAGGACGCCAAGCGGTCTTGCCTGCTGTCCGACAGCAAAGATTGGAATAA<br>GCCTCTCAATGTGACCAGGAAGCTGTGGGAGCTCAATAACTATGTGTGGGACAAGAAGAAAGC<br>CGACTGGGTGCTCAGGAAGAAGGAGAATGAGACTAGACCAAAGAAGTTCCACAAAAAGTACC<br>TGGAGCTCACCAGCGACAAGAGGGGTATAACCAGGCCAAAAACGACTGGATCAAGTTCACCA<br>AGGAATTCCTGTCAAGCTATAAGAAAGTGAAAGACTACGATATTCACTACAAGAAGCGATACA<br>ACTCAGTGGACGAGCTGTACAAACAGCTGAACTCTGATTTTTACACCATCTCCTTCACCTATGTG<br>TCTGTGAGTTTCATTGACAAGCTGGTCAATGAAGGCAAAATGTACCTGTTCCAGATCTACAACA<br>AGGATTTCAGCAATTACAGTAAGGGCACACCAAATATGCACACCCTGTACTGGAAAGCCCTGTT<br>CGATGAGCGGAACCTGGCCGACGTGGTGTATAAGCTCAACGGAGAGGCAGAGATGTTTTATC<br>GGAAGAAGAGCATCAACAACACCCACCCAACCCATCCCGCCAACCACCCCATCCAGAACAAA<br>ACAAGGACAACAAAAAAAAGGAAAGCGTGTTTGAGTACGACCTGGTGAAAGATTACCGGTAC<br>ACCGAGGACAAGTTCCTGTTCCATGTGCCAATCACCATGAATTTCAAGAGCGTGGGTTCTGAGA<br>ACATCAATCAGCAGGTGAAGGAATACCTGCAGCAGGCCGACGACACTCACATCATCGGCATCG<br>ACAGGGGCGAGCGCCACCTGCTGTACCTCGTGGTGATCGACATGGAGGGGAATATCAAGGAG<br>CAGTTTAGTCTGAACGAAATTGTGAACGAGTATAACGGCAATCATATCGGACTAACTACCACG<br>ACCTGCTGGACGTGTGCGCAGATAAGCGGCTGAAGGCTAGCCAGAGCTGGCAGACAATCGAG<br>AACATCAAGGAGCTTAAGGAGGGATACCTCAGCCAGGCCATTCACAAGATTACTCAGCTGATG<br>GTGAAGTACCATGCCGTCGTGGTGCTGGAAGACCTGAACAAAGGCTTCATGAGAGGGCGGCA<br>GAAGGTGGAGAAGCAGGTGTATCAGAAGTTCGAGAAGATGCTGATCGATAAGCTGAACTACC<br>TGGTGGACAAAAAGGCCGACGCTGCCCAGAGCGGCGGGCTGCTGAATGCTTATCAGCTGACCT<br>CCAAGTTCGACTCATTCCAGAAGCTGGGAAAGCAGAGTGGCTTTCTGTTCTATATCCCTGCCTG<br>GAACACTAGCAAGATTGATCCTGTGACAGGCTTCGTGAACCTGTTCGACACCAGATACACCAAC<br>GCCGACAAGGCCCTCAAATTCTTCTCAAAATTTGACGCCATCAGATACAACGAGGAGAAGGAC<br>TGGTTCGAGTTCGAGTTCGACTACGACGAGTTCACCCAGAAAGCCCACGGGACCAGAACCAAG<br>TGGACTCTGTGCACATATGGCATGAGGCTGTGTTCCTTTAAAAATCCCGCCAAACAGTATAATT<br>GGGACTCCGAAGTGGTGGCCCTGACAGACGAGTTCAAGAGGATCCTGGGAGAGGCAGGCATC<br>GATATTCACGAGACCTGAAGGACGCAATCTGCAATCTGGAGGGCAAATCCCAGAAGTACCTG<br>GAGCCCCTGATGCAGTTCATGAAACTGCTGCTGCAGCTGCGGAATTCCCGCAAGAACCCCGAG<br>GAGGATTACATCCTGTCCCCCGTGGCCGATGAGAACGGCGTGTTTTATGACTCCAGAAGCTGT<br>GGCGACAAGCTGCCTGAGAACGCAGACGCCAACGGCGCATACAACATTGCCCGGAAGGGCCT<br>GATGCTGATCAGACAGATTAAAAAGGCCAAGGAGCTGGATAAGGTGAAATTCGATATTAGCAA<br>CAAGGCCTGGCTGAACTTTGCCCAGCAGAAGCCATACAAGAACGAATGA |
| 196 | 156 | ATGGAATTCAACGACTTCAAACGCCTGTACCCTCTGTCTAAGACACTGAGGTTCGAGGCTAAGC<br>CCATCGGTAGCACACTGAACAATATCATCAAATCCGGCCTGCTGGAAGAGGACGAGCACCGCG<br>CTCAGTCCTATGTGAAGGTGAAGAAGCTGATCGATGAGTACCATAAGGTGTTCATCGACCGGG<br>TGCTGGATGACGGCTGCCTTACCATCGAGAACAAGGACAAGAAGGATTCCCTGGAGGAATATT<br>ACGAATCCTATATGTCCAAGTCTAACGACGAGAACGTGAGCAAGCACATTTAAGGAGATTCAGG<br>AAAACCTGCGCTCTGTGATCGCTAAGAAGCTCACCGACGATAAAGCCTACGCCAATCTGTTCGG<br>CAAGAACCTGATTGAAAGCTATAAAGATAAGGACGATAAGACAAGATTATCGATTCTGACTT<br>GATCCAGTTCATTAATACAGCCGAGCCTTCTCAGCTCGACTCTATGTCTCAGGACGAGGCCAAA<br>GAGCTGGTGAAGGAGTTCTGGGGCTTTACCACATATTTCGTGGGATTTTTTGACAACAGAAAG<br>AACATGTACACCTCCGAGGAGAAGTCTACCGGCATTGCCTACAGACTGGTGAACGAAAACCTG<br>CCAAAGTTTATCGATAACATGGAGGCCTTCAAGAAGGCCATCGCCAAACCTGAGATCCAGGCA<br>AACATGGGCGAACTGTATAGCAACTTCGCCGAATATCTGAATGTGGAAAGCATCCAGGAGATG<br>TTCCAGCTGGACTACTACAACATGCTCCTGACACAAAAGCAGATCGACGTGTACAATGCCATCA<br>TTGGGGGCAAAACAGATGAGGAGCATGACGTTAAGATCAAGGGCATCAATGAATACATCAAC<br>CTGTACAATCAGCAGCACAAGGACGAGAAGCTGCCCAAACTGAAGGCCCTGTTCAAGCAGATT<br>CTGAGCGACAGAAATGCCATTAGCTGGCTGCCAGAGGAATTCAATAGTGATAAAGAGGTCCTG<br>AACGCTATCAAGGACTGTTATGAGAGGCTGAGCGAGAATGTGCTGGGGGACAAGGTGCTGAA<br>ATCCCTGCTCTGCAGCCTGAGCGACTATAACCTCAACGGCATTTTTGTGCGCAATGACCTGCAG<br>CTCACAGACATTAGCCAGAAGATGTTCGGCAATTGGAGCGTGATCCAGAACGCCATTATGCAG<br>AACATTAAAAACGTGGCCCCAGCACGCAAGAGAAAGGAGAGTGAGGAAGATTACGAGAAGCG |

TABLE S9B-continued

Human Codon Optimized Nucleotide Sequences Group 9

| SEQ ID NO | Corresponding AA | Sequence |
|---|---|---|
| | | CATCAGCGATATCTTCAAGAAGGCCGACAGTTTCTCCATCCAGTACATCAACGATTGCCTGAAT GAGATGGACGATAATAACCTGCACGCCGTGGATGGCTACTTTGCCACCCTGGGCGCCGTGAAC ACTCCAACTATGCAGCGGGAGAATCTGTTTGCCCTGATCCAGAATGCTTATACAGACATTTCCA ACCTGCTGGACACACCCTATCCCGAGAACAAAAATCTGGCTCAGGATAAAACCAATGTGGCCA AGGTGAAAGCCCTGCTGGACGCCATTAAGAGCCTCCAGCACTTTGTGAAGCCTCTGCTGGGCA TGGGCGACGAGTCAGACAAGGACGAGAGGTTCTACGGCGAGCTGGCCTCCCTCTGGACCGAA CTGGACACTGTGACCCCCCTGTATAACATGATCCGCAACTACATGACCCGCAAACCCTATAGCG AAAAGAAAATCAAGCTCAACTTTGAGAACCCCCAGCTGCTGGGCGGCTGGGACGCCAACAAG GAGAAAGACTACGCCACAATCATCCTGCGCAGGAACGGGATGTACTATCTGGCAATCATGAAC AAGGACAGCAAAAAACTGCTGGGGAAGACCATGCCTTCTGATGGGGAGTGCTATGAGAAAAT GGTGTACAAGTTTTTCAAGGATGTGACCACCATGATCCCTAAGTGTAGCACCCAGCTGAAGGAC GTGCAGGCCTACTTTAAGGTGAACACCGATGATTTCGTGCTGAATAGCAAAGCCTTTAACAAGC CTCTTACTATCACAAAGAGGTGTTCGATCTGAATAACGTGCTGTACGGCAAATTCAAGAAATT CCAGAAGGGGTATCTGTCCGCCACCGGCGACACCGCCGGCTACACACATGCCGTGAACGTCTG GATTAATTTTTGCATGGACTTTCTGAATTCCTATGAAAGCACATGTATGTACGACTTCACAAGCC TGAAGAGCGAGAGCTATCTGTCCCTGGACGCCTTCTATCAGGACGCCAACCTGCTGCTGTACAA ACTGTCCTTCACCAACGTGTCTGTTTCTTTTATCGACAAACTGGTGGATGAGGGCAAGATGTAC CTGTTTCAGATCTACAACAAGGATTTCAGCGACTACAGCAAGGGTACACCTAACATGCATACTC TGTATTGGAAAGCACTGTTTGATGAACGGAACCTGGTCGACGTGGTGTACAAGCTGAATGGAC AGGCCGAGATGTTCTACCGGAAAAAGTCCATCGACTACACCCATCCCACTCACCCTGCCAACCA CCCCATCCAGAACAAGAACAAGGATAATAAAAAGAAGGAGTCTGTGTTCGAATACGATCTGGT GAAGGACAGGCGGTACACGGTGGATAAGTTCCTGTTTCACGTCCCAATCACAATGAACTTTAA GAGCGTGGGCTCTGAGAATATCAACCAGCAGGTGAGAGAGTATCTCCAGCAGGCCGATGACA CACACATTATCGGCATCGACAGGGGCGAGCGCCACCTCCTGTACCTGGTGGTGATCGACATGC AGGGCAACATCAAAGAACAGTTCACCCTGAACGAGATCGTGAACGAGTACAACGGAAACACAT ATAGGACTAACTATCATGACCTTCTGGACACACGGGAGGAAGAAAGACTGACAGCCAGACAGA GCTGGCAGACCATCGAGAACATCAAGGAGCTGAAGGAGGGGTACCTGTCCCAGGTGATCCAC AAGATCACCCAGTTGATGGTTAAGTACCACGCAGTGGTGGTGCTGGAGGATCTGAACAAGGG GTTCATGAGAGGCCGCCAGAAGGTGGAGAAACAGGTGTACCAGAAATTCGAAAAGATGCTGA TCGACAAACTGAACTACCTGGTGGACAAGAAGGCCGACGCAACTCAGAGCGGAGGGTTGCTG AACGCATACCAGCTGAAGAGCAAGTTCGACAGCTTCCAGAAGCTGGGCAAGCAGTCAGGGTTT CTGTTCTACATTCCAGCTTGGAACACCAGCAAGATCGACCCCGTGACAGGCTTCGTGAACCTGC TTGACACCAGATACCAGAACACTGAGAAGGCCAAGGCTTTCTTCTCCAAGTTCGATGCCATCCG CTACAATGCCGACAAAGATTGGTTCGAATTCAATTTGGACTATGATAAGTTCGGAACAAAGGCC GAGGGAACACGTACAACCTGGACCCTGTGCACCCAGGGCAACCGCATCTGCACATTTAGAAAT GCAGAGAAGAACTCCCAGTGGGACAACCAGGAGATTGACCTGACAAGAGAAATGAAGTCTCT GTTCGAGCACTATCACATCAACATCTGTGGCAATCTGAAGGAGGAAATTTGCTCCCAGACCGAC AAAGCCTTCTTCACCGGGCTGCTGCACATCCTGAAACTCACCCTGCAGATGAGGAACAGCATTA CCGGCACCGAGACCGACTATCTGGTGTCCCCTGTGGCCGACGAAAATGGCGTGTTTTATGACA GCGAAGCTGCGGGGATATGCTGCCCAAGAACGCCGACGCTAATGGCGCTTACACATTGCTC GCAAAGGCCTGATGCTGATCGGCCAGATCAAGGAGACTAAGGACCTGGCCAACTTCAAATACG ACATCAGCAACAAAGCCTGCTGAACTTTGCCCAGCAGAAACCATATAAGAATGAGTGA |
| 197 | 157 | ATGGACAAGAAGTTCGAGGATTTCAAGAGACTGTACCCCCTGAGTAAAACCCTGCGGTTCGAG GCTAAACCAATTGGCTCTACCCTGGATAACATCATTAAAAGCGGCCTGCTGGACGAAGATGAG CACAGGGCCGTGTCATACGTGAAGGTGAAGAAGTTGATCGACGAGTACCACAAATCCTTTATA GACAGAGTGCTGGATGAGGGCTGCCTGCCATTTGAAAACAACGGGGAGAAAGACAGCCTGGA GGAGTACTACGAATCATATAAACTGAAAAGTAACGACGAGAACGCTAACAAGACCTTTAAGGA AATCCAGCAGAACCTGAGGTCTGTGATCGCCAATAAGCTGACCGACGATAAAGCATACGCCAA TCTGTTTGGCAACAAGCTGATCGAATCTTACAAGGATAAGGAGGATAAAAAGAAGACCATTGA CTCTGACCTGATCCAGTTCATCAACACAGCCGAACCATCTCAGCTGGACTCTATGAGCCAGGAT GAGGCCAAAGAGCTGGTGAAAGAGTTCTGGGGATTCACAACCTACTTCGTGGGCTTTTTCGAC AATAGGAAAAATATGTACACATCAGAGGAGAAGAGCACCGGGATCGCCTACCGCCTGGTGAA TGAGAACCTGCCCAAGTTTATCGACAATATGGAAGCCTTCAAGAAAGTGATCGCAAAAAGCGA AATCCAGGCCAACATCGAAGAGCTGTACTCCAATTTTGCCGAGTACCTGAACGTTGAATCTATC CAGGAGATGTTTCAGCTCGACTACTACAACATGCTGCTGACTCAGAAGCAGATCGACGTTTACA ACGCCATCATCGGCGGCAAAACAGACGAGAAGCACGACGTGAAGATCAAGGGCATAAACGAG TACATTAATCTGTATAACCAGCAGCAAAGGATGAGAAGCTGCCTAAACTGAAAGCCCTGTTCA AGCAGATCCTGTCAGATCGGAATGCTATTTCATGGCTGCCCGAGGAATTCAACGATGATCAGG AGGTGCTGAACGCTATCAAAGACTGTTATGAACGGCTGAGCGAGAACGTGCTCGGCAACAAG GTGCTGAAGAGTCTGCTGTGTTCCCTGGCCGATTACAACCTGGACGATATTTTTATTCGGAACG ACCTGCAGCTGACAGACATCAGCCAGAAAATGTTTGGCAACTGGAGCGTGATCCAGGACGCCA TCATCCAGAACATCAAAAACGTGGCCCCCGCAAGAAAGAGGAAAGAGAGCGAAGAGGACTAC GAGAAGAGAATTTCCGGAATCTTTAAGAAAGCCGACAGCTTCTCCATTCGTACATCAACAGCT GTCTGAATGAGATGGACGATAACTCACTGCATCCGTGGACGGCTACTTTGCCACTCTCGGAGC CGTGAACACACCCACCATGCAGCGCGAGAATCTGTTTGCTCTGATCCAGAACGCTTATACGGAC ATTTCCGATCTTCTGAACACCAAGTACCCCGCCAACAAAATCTGGCCCAGGACAAAACTAATG TGGCCAAGGTGAAGGCCCTGCTGGACGCTATCAAGTCCCTGCAGCACTTCGTGAAGCCACTGC TGGGGAAGGGCGACGAATCCGATAAAGACGAGATTCTATGGGGAGTGGCCTCTTCGTGG ACCGAGCTGGACACCGTGACACCTCTGTACAACATGATCAGGAATTACATGACACGGAAACCA TATAGCGAGAAGAAAATTAAGCTGAACTTCGAGAACCCTCAGCTGCTGGGCGGTGGGACGC CAATAAGGAGAAGGATTATAGCACCATTATTCTGAGACGGAACGGCATGTACTACTTGGCAAT TATGAACAAGGATTCCCGGAGGCTGCTCGGAAAGGCCATGCCAAGCGATGGGGAATGTTATG AGAAGATGGTGTACAAGCTGCTTCCTGGCGCCAACAAAATGCTGCCAAAGGTGTTCTTTGCTAA |

TABLE S9B-continued

Human Codon Optimized Nucleotide Sequences Group 9

| SEQ ID NO | Corresponding AA | Sequence |
|---|---|---|
| | | GTCCAGAATCGACGACTTCAAGCCCAATATCCAGATCGTGGAGAACTATAACAACGGCACTCAC<br>AAAAAACGGAAGAATTTCAACATACAGGATTGCCACGACCTGATCGACTTCTTTAAGCAGAGCA<br>TTAAAAAGCACGAGGACTGGTCTAAATTCAGCTTCAACTTTAGCGATACTTCTACCTACGAGGA<br>CCTGTCCGGGTTTTACAGAGAAGTGGAACAGCAGGGGTACAAGCTCTCCTTTATGAATGTCAG<br>CGTGTCCTTCATCGATAAACTCGTGGACGAGGGCAAGATGTACCTGTTTCAGATTTACAACAAG<br>GACTTCAGCGAGTATTCCAAGGGCACCCCAAACATGCACACACTCTACTGGAAGGCCCTGTTCG<br>ACGAGCGCAACCTGGCTGACGTGGTTTACAAGCTGAACGGCCAGGCCGAAATGTTCTATCGGA<br>AGAAATCCATAGACTACACCCATCCAACCCACCCCGCAAACCCACCCGATCCTGAACAAGAATAA<br>GGACAACAAGAAGAAGGAGTCCCTGTTTGAGTACGATCTGATTAAAGACCGCAGATACACCGT<br>GGACAAATTCCTGTTCCACGTGCCAATCACCATGAACTTTAAGAGCGTGGGCTCAGAAAACATC<br>AACCAGCAGGTCAGAGAGTATCTGCAGCAGGCCGACGACACCCACATCATCGGCATCGATAGG<br>GGAGAAAGACACCTGCTGTACCTGGTGGTGATTGACATGCAGGGAAACATCAAGGAGCAGTTT<br>ACACTGAATGAGATCGTGAACGAGTACAATGGGAACACCTATCGCACCAACTATCACGACCTG<br>CTGGATATTAGAGAGGAGGAGCGGCTGGCCGCTCGCCAGTCTTGGCAGACCATCGAGAACATC<br>AAGGAGCTGAAGGAAGGATACCTGAGCCAGGTGATCCACAAGATCACCCAGCTGATGGTGAA<br>GTACCACGCTATCGTAGTGCTGGAGGACCTGAACATGGGCTTCATGAGGGGGAGACAGAAAG<br>TGGAGAAGCAGGTGTACCAGAAATTTGAGAAGATGCTGATCGACAAGCTGAACTATCTGGTGG<br>ATAAGAAGGCCGATGCTACACAGCCCGGCGGCATCCTGAACGCCTACCAGCTGACTAGCAAGT<br>TTGACTCTTTCCAGAAGCTGGGGAAGCAGTCTGGCTTTCTGTTTTACATCCCCGCTTGGAATACC<br>TCCAAGATTGACAGCGTGACTGGCTTTGTGAACCTGCTGGACACCAGGTACCAGAACACCGAG<br>AAGGCCAAAGTGTTCTTCTCAAAATTTGACGCCATCCGGTACAATGAGGAAAAGGATTGGTTC<br>GAATTCTACCTGGACTACGACAAGTTCGGTTCCAAGGCCGAAGGGACCAGAACCAAGTGGACC<br>CTGTGCACCCAGGGCAAGAGAATCAGGACATTCAGAAACCCAGACAAGAACTCTCAGTGGGAC<br>AACCAGGAGGTGGACCTGACCAGAGAGATGAAGAGCCTGTTTGAGCACTACCACATCAACATC<br>TGCGGCAATCTGAAGGAGGAGATCTGCAGCCAGACCGACAAAGCCTTTTTCACAGGTCTGCTC<br>CATGTGCTGAAGCTGACCCTGCAGATGCGCAATAGCATCACCGGGACCGAGACAGACTACCTG<br>GTGAGCCCTGTCGCCGATGAGGAGGGCAACTTTTATGACAGCCGCTACTGCAACATCACCCTGC<br>CAAAGAATGCCGACGCCAACGGTGCCTACAATATCGCTAGAAAGGGCCTGATGCTCGTGAAGC<br>AGATCAAAGCCGCCACAGACCTGGCCAACTTTAAGTACGATATCTCTAACAAGGCCTGGCTGAA<br>TTTCGCCCAGCAGAAGCCCTATAAGAATGAATGA |
| 198 | 158 | ATGAAGAAATCCTCACTGCAGGATTTTTACAAATCAGTACAGCCTGTCAAAAACCTTGAGATTCG<br>AGCTGATTCCCCAAGGAGAAACCTTGGAGCACATTGAGAAAAACGGACTGTTAAGCCAGGACG<br>AACATCGAGCTGAGTCTTATATTATCGTGAAGAAGATCATCGATGAGTATCACAAGGCCTTCAT<br>AACCCAAAGCCCTGGACGGGGTGAAACTAAATTCACTGGAGGACTACTTCCTATACTACCAGCTG<br>CCTAAACGGGACGAGGAGCAAAAGAAGAAATTCGAGGAAATTCAGACCAAGTTAAGGAAGCA<br>GATCGCCGATCGATTCGCTAAACAGGAGAGCTTTAAAAATCTCTTCGCAAAAGAGCTTATCAAG<br>GATGACTTGATCAACTTTGTCAAGAGTAACGACGACAAGCTCCTGGTCGCGGAATTTCAAATT<br>TCACTACCTACTTCACGGGCTTCCACGAAAACCGAAAAAATATGTACAGCGCTGAAGATAAATC<br>AACTGCCATTGCTTTTAGGTTGATACACCAGAACTTGCCAAAGTTCATAGACAATATGAGAGCA<br>TTCGACAAGATAAAGATCTCTAAAGTGAAAGACAGCTTTAAGACCATACTGGCGGACGATGAA<br>CTGGGCGCAATTATCCAGGTGATAGCCGTAGAAGACGTGTTCACCCTTAACTACTTTAATGATA<br>CACTCACACAGTTGGGCATAGATAAGTATAATCAGCTCATAGGAGGGTTCACAAGCGAAGACG<br>GTAAGATCAAGATCAAAGGTCTGAACGAGTACATCAACCTATACAACCAAACTGCAAAGAAAG<br>AGGAGAGACTGCCGAAATTGAAGCCGCTCTACAAGCAAATTCTGTCCGACCGCTCCACTGCCTC<br>CTTCATCCCTGAGGCGTTTTCGAATGATAATGAAGTGCTGGAGTCCATCGAGAAACTGTATCAG<br>GAAATTAACGACTTGGTTCTCAATAAGCGGGTAAAGGGTGAACACAGCCTTAAAGAATTGCTC<br>CAGAGTCTAAACGAATACGACTTTCCAAGGTGTACTTGAGAAGATGACCTGTCACTCACTGATA<br>TCTCACAGAAGATGTTTGGAGACTGGGGAGTATTTCAGAAAGGAATGCAGACCTGGTACGCCG<br>TGAATTATAAGGGCAAGAATAAGGCCGGCACCGAAAAGTACGAGGATGAGCAGAAGAAATAT<br>TTCTCAAACCAGGATAGCTACAGTATTGGCTTTATTAACGAGTGCTTACTCCTCTTAGATACCGT<br>GTATCAGAAGCGGATTGAGGACTATTTTAAATTGCTGGGAGGAGAGGAATACTGAAGAGGAGA<br>AATCCGAGAATCTCTTCGTCCTAATTGAGAAAAACTACAACGGCATTAAGGATCTGCTTAACAA<br>TCCATATCCCCACGACAAAAATCTTGCCCAAGATCAGGCCAACGTGGACAAGATTAAGAACTTT<br>TTAGACGTCGTGAAAACATTGCAGTGGTTTATTAAACCTCTTCTGGGCAAGGGAAACGAGGCT<br>GAGAAAGATGAGCGATTTTACGGTGAGTTTACTTCTCTATGGACCACACTGGACCAGGTGACA<br>CCCCTCTACAACAAAGTTCGGAATTACATGACCCAAAAACCCTACTCAACCGAGAAGATTAAGC<br>TGAATTTTGAGAATTCCACACTCCTTGACGGGTGGGATGTTAACAAGGAGGTGGACAATACTG<br>CAATGATTTTTCGCAAGAACGGTCTTTATTATCTGGGCATCATGAACAAGAAGCATAACAAGAT<br>TTTCAAGACCGACATCGCAAATACTGGGGGTGAGTGCTACGAAAAGATGGAGTACAAACTGTT<br>ACCAGGGGCCAACAAAATGCTGCCCAAAGTTTTTTTTTCAAACAGCCGTATCGATGAATTCAAG<br>CCGGGAACAGAACTTCTCGAGAATTATAAGAACGAGACGCATAAGAAGGGTGATAATTTTAAT<br>CTCAACGATTGTCACCACCTTATTGATTTCTTCAAGACCAGTATCAACAAGCACGAGGACTGGA<br>AGCACTTTGGCTTCCAGTTTTCTGATACAAAAACGTACAATGACTTGTCTGGATTCTATAGAGAA<br>GTGGAACAACAGGGCTATAAGATCACATATAAGGCAATCAGCGAAAACTACATTGCTCAAATG<br>ATCGCAGAGGGGAAACTGTACTTGTTCCAGATCTACAATAAAGATTTCAGTCCTTACTCCAAAG<br>GGATGCCAAATATGCATACCCTGTACTGGAAAATGCTTTTCGACGCCGTCAATCTGAAGAACGT<br>TGTCTATAAGCTGAACGGGCAGGCAGAAGTGTTCTATAGGAAACTGTCTATCAAAGCCGAAAA<br>CATTATCACACATAAGGCGAATGTGCCTATTCACAATAAAAATGAGGAGAACGAGAAAAAGCA<br>ACAATCCCGCTTTGATTATGATATAATCAAGGACAAGCGGTACACTATGGACAAATTCCAGTTC<br>CATGTCCCTATTACTATGAATTTCAAGGCTAAAGGCTTGAATAACATCAACATCGAGGTAAACC<br>AGTACCTTAAGAAAGAATCGGACATTCATATCATAGGAATAGACCGGGGGGAAAGGCATCTGC<br>TATATTTGACATTAATTGATGGCAAGGGCAACATCAAACAGCAATTTAGTCTCAACGAGATCAT<br>TAATGAGTATCAGGGAAAGACCTATAAGACTAATTACCACGATTTACTCGACAAGAAAGAAGG |

TABLE S9B-continued

Human Codon Optimized Nucleotide Sequences Group 9

| SEQ ID NO | Corresponding AA | Sequence |
|---|---|---|
| | | CGACCGGGATGATGCTCGTAGAAATTGGAAGACCATCGAGACAATCAAGGAGCTTAAGGAGG<br>GATATCTCTCGCAAGTCATCCATAAAATCTCTGAACTCATGGTAGAACACAACGCTATAGTCGT<br>GCTGGAAGACCTCAACATGGGCTTCATGAGGGGGCGCCAAAAAGTTGAGAAGCAGGTGTACC<br>AGAAGTTTGAAAAGATGCTAATCGACAAACTGAACTACCTGGTCGATAAGAAGAAAAACCCCA<br>CAGATCTGGGTGGCACTTTAAATGCTTATCAGCTGACGAACAAGTTTGAGTCTTTCCAGAAGAT<br>GGGGAAACAGTCTGGCTTCCTCTTTTATGTCCCTGCTTGGAACACCAGTAAAATGGACCCAGTC<br>ACCGGGTTCGTAAACCTGCTGGACACACGCTACGAAAACATTGAAAAGGCCAAAACGTTTTTCT<br>CTAAATTCGATAGCATCCATTACAATCCCCTTAAGAAGTATGTGGAGTTCGAGTGCGACTACAA<br>TCGATTTACCACCAAAGCCGAGGGGACACAAACTAAATGGACGCTGTGTACGTATAAGGAAAG<br>AATTGAAACCTTTCGTGACCCAACCCAGAACAGCCAGTGGAAGTCCAGGGAAATAGTTCTTACA<br>GATGAATTCATCAGCCTGTTTGAGCAGTACGGTATTGCTTACAAGAACAAGGAAGAACTGAAA<br>GATGCAATTGCGAGGCAGACAGAGAAGGTGTTCTTTGAGCGCCTGCTGCACCTGCTGAAACTG<br>ACTCTGCAGATGCGGAATAGTATCACAGGGACTGAAACCGATTATCTCATAAGCCCAGTGGCA<br>AATGCCAAAGGCGAGTTCTATGACTCCCGCACTGCTTCCGAAACGCTTCCCAAGAATGCCGACG<br>CCAATGGAGCATATAACATCGCCAGAAAGGCCTGTGGGTGGTTGAGCAGATTAAACAAGCCG<br>ATGATCTGAAAAAGCTCAAGCTCGCTATCTCTAATAAGGAATGGCTGGGATTTGTGCAGAACTA<br>TGGGAAATGA |
| 199 | 159 | ATGGGCTGGAGAAACGGCTTCCAGAAGATCCTGATCCTGATCAACAACAAGAAGATGGGCAAT<br>ACAAATCTGTTCAAGGGATTTACAAACTTTTACCCCGTCTCCAAAACCCTCAGATTCGAACTGAA<br>GCCCATCGGCAAAACCCTGGAGCACATCGAAAAAAACGGCCTCCTGCTGCAGGATGAGCACCG<br>CGCCGAGTCCTACGTGACAGTGAAGAAGATTATTGACGAATACCACAAAGCCTTTATTGCCAAA<br>GCCCTGGATGGCCTGGTCCTGAACGTGCTGGAGGACTATCACCTGTATTATCAACTGCCTAAAC<br>GGGACGAGGCCCAAAATAAAAAATTCGAGGAGCTGCAGACAGAGATGAGAAAGCAGATCGCC<br>GATAGGTTCACAAAGCAGGACGGCTTCAAGAACCTGTTCGCCAAGGAGCTGATTAAGGAGGA<br>CCTGAAGGCCTTCGTCCAGACACTCGAGGACAGACAGCTGGTGGAGGAGTTCGGCAACTTTAC<br>CACATACTTCACTGGGTTTCATGAGAATAGGAAAAACATGTATAGCGCCGAGGACAAGAGCAC<br>CGCCATCGCCTACAGGCTGATTCACCAGAACCTGCCCAAATTCGTGGACAACATGAAGGCTTTC<br>GATAAGATCAGAAATAGCGCCGTGAAGGAGAAATTCGCCCTGATCATCTCAGATGACGAGTTG<br>GGCCCCATCATCCAGGTGAAAGACATCGAGGAAGTGTTCTGCCTGGATTACTTTAACGAGACCC<br>TGACCCAGAAGGGCATTGACAAGTACAATCAGCTGATCGGAGGATATATGCCAGAAGACGGC<br>AAGGAGAAGAAAAAGGGCCTGAACGAATATATCAACCTGTTCAACCAGACCGCCAAGAAGGA<br>GGAGCGGATCCCTAAGCTGAAGCCACTGTATAAACAGATCCTGTCTGACCGGAGCACAGCCTC<br>CTTTTATTCCTGAGGAGTTCGAGTGTGATAACGAGGTGCTGGAGTCAATCGAGAAGCTGTACCA<br>GGAGATTAACAAACACGCCCTTCCCCAGCTGAAGGGCCTGATGAATAACCTGCACGATTTTGAT<br>CTGCACAAGATCTATCTGCGTAATGACCTGTCTCTGACAGACATCAGCCAGAAAATGCTGGGCG<br>ACTGGGGAGCCTTCCAGAAGGCCATGAATAAGTGGTTTGACCTGAATTATAAGGGCAAGGCAA<br>AACCCGGCACCGAGAAGTACGAGGAGGAGCAGAAAAAGTACTTTAGGAATCACGAGTCATAC<br>AGTATCGGGTTCATCAACGATTGTCTGGCCAAGAGCGACATTGCCGAGCACCATAAGAAAATC<br>GAAGACTACTTTAAGCGGGCAGGAGAGCAGATTAATGAGACCGAGAATCTCTTTACCCTGGTG<br>GAGAAGGGGTACTCCACCGTGAACGACTTACTGAATAACCCATACCCAAAGGAGAAGAATTTG<br>AGCCAGGACCAGCAGAATGTGGATAAGATTAAGGCCTTTCTGGACGGCATCAAGGCCCTGCAG<br>TGGTTTATTAAGCCTCTGCTGGGCAAGGGGAATGAGGCCGAGAAAGACGAGAGATTCTACGG<br>GGAGTTCGCAATGCTGTGGACCACCCTGGACCAGATCACCCCTCTGTACAATAAGGTGCGCAAT<br>TACATGACCCAGAAGCCTTACTCCACCGAGAAGATCAAGCTGAATTTTGAGAATTCCTACTTCCT<br>GAACGGATGGGCCCAGGACTACGAATCCAAGGCCGGCCTGATCTTCATCAAAGACGGCAACTA<br>CTACCTGGGAATTAATAATAAGAAGCTGACAATCGAGGAGAAGGAACTGCTGAAGGGCACGG<br>ATGCCAAGCGCATCATCCTGGACTTCCAGAAGCCCGACAACAAGAACATCCCTAGACTGTTTAT<br>TAGGAGCAAGGGCGACAACTTTGCCCCTGCCGTGGAAAAGTACAACCTGCCTATTAAAGATGT<br>GATCGAGATTTACGACTCCGGAAAGTTCAAAACCGACTATCGGAAGACCAACGAGGAGGATTA<br>TACCAAGAGCCTGCATAAGCTGATCGATTACTTTAAGGAGGGGTTCAGCAAGCATGAGTCCTA<br>CAAGCATTATCCCTTTAGCTGGAAGAGCACAACCGAATACAAGGATATCGCAGAGTTCTACAAC<br>GATGTGGAGGTGAGCTGCTATCAGGTGTTTGAGGAGGGAGTGAACTGGGGGAAGATCATGGA<br>CTTCGTGGATCAGGGGAAGCTGTACCTGTTTCAGATCTATAATAAAGACTTTTCCCCCTATAGCA<br>AGGGAACCCCTAATATGCATACCCTGTACTGGAAAATGCTGTTCGACGCCGAGAATCTGAAGG<br>ACGTGGTGTACAAGCTCAACGGCCAGGCCGAGGTGTTCTTCAGGAAGTCCAGCATCAAGGCTG<br>AGAATAAGGTGGTGCATAAGGCCGAGGGCAGCATCCCTAACAAAAACGAGCTGAATGCCAAG<br>AAGCAGAGCACCTTCGACTACGATATCATTAAAGACAGGCGCTACACCACCGACAAGTTCCAGT<br>TCCATGTGCCCATCACCATGAATTTCAAGGCCAGAGGACTGAATAACATTAATACCGAGGTGAA<br>TCAGCTGATTAAGAAGGAGAATGAGATCCACATCATTGGGATCGATAGGGGCGAGCGCCACCT<br>GCTGTACCTGACACTGATCGACTCAAAGGGCAGCATTAAGCAGCAGTTTTCCCTGAACGAGATC<br>ATCAACCAGTACAATGGCCAGAATTATAAGACCAATTATCACAATCTGCTGGACAAAAAGGAA<br>GGCGGCAGAGATGAGGCTCGGCGCAACTGGAAGACCATCGAAACTATCAAGGAGCTGAAAGA<br>AGGATATCTGTCTCAGGTGATCCACAAGATCGCAGAGCTGATGGTGGAGTACAATGCCATCGT<br>GGTCCTGGAGGACCTGAACATGGGATTTATGAGAGGGCGCCAGAAGGTGGAGAAGCAGGTCT<br>ATCAGAAATTCGAAAAAATGCTGATTGACAAACTGAATTACCTGGTGGACAAGAAGAAAAAGG<br>CCGGGGAATTCGGCGGGACGCTCAAGGCCTACCAGCTGACAAACAAATTCGAGTCCTTTCAGA<br>AGATGGGGAAGCAGAGCGGCCTGCTGTATTACGTGCCAGCCTGGAACACCTCCAAGATGGACC<br>CAGTTACCGGGTTCGTTAATCTGCTGGACACACGCTATGAAAATATGGAAGGCCAAGCAGT<br>TTTTTGGAAAGTTTGAAGCCATCTCCTACAAGCAGACAAAGGGCTATTTCGAGTTCGAGTTTGA<br>CTACATGAAGTATACCAATAAGGCCGAGGGAACTAAGACCAGGTGGACCCTGTGTACCAACAA<br>CGAGAGAATCGAGACTTACAGGAATCCAGAAAAAAATAGCCAGTGGGACAGCAGGGAGGTG<br>GGACTGACCAAGGAGTTTGTGTCCCTCTTCGAGCAGTTCGGCATCAATTTTAAAGATAACGCCG<br>GGCTGAAGGAGGCCATTTGCAGGCAGACTGAGAAAGCATTTTACGAGAGGCTGCTGCACCTGC |

TABLE S9B-continued

Human Codon Optimized Nucleotide Sequences Group 9

| SEQ ID NO | Corresponding AA | Sequence |
|---|---|---|
| | | TGAAGCTGACTCTGCAAATGAGAAACTCTATTACCGGAACCGAGATCGACTACCTGATCAGCCC
CGTGGCCAACGACAAAGGTGAATTCTACGATAGCAGAACCGCCGCCGAGATTCTGCCACAGAA
TGCCGATGCCAACGGGGCCTATAATATCGCCAGAAAAGGCCTGTGGGTTATCGACCAGATTAA
GCAGGCCGACGATCTGAAGAAGCTGAAGCTGGCCATTAGCAATAAAGAGTGGCTCGGCTTCGT
GCAGAAGGACGTGTGA |
| 200 | 160 | ATGAAGAACCTGACCGAGTTCACCGGCCTCTACCCTGTGAGCAAGACCCTGCGATTTGAGCTGA
AGCCCCAAGGCCGGACCCTGGAGTACATCGAAAAGAACGGACTGCTGGAACAAGACGAACAC
AGAGCCAGCAGCTATATCCTGGTGAAGAAGATCATCGACGACTACCACAAAGCCTTTATCGCTA
ACGCCCTCCGCGATTTTAAGCTGTACAGCCTGGAGGATTATTACCTGTATTACAATATCCAGAA
GAGAGACGACGAACAGAAAAAGAAATTTGAGGATATCCAGTCTAAACTGCGGAAGCAGATCG
CCGACAGATTTACCAAAGAGGAGTCTTTTAAGAACCTGTTCGCCAAGGAATTGATTAAGGAGA
ACCTGATCGAGTTCGTGCAGACCGTGGAGGACCGCGAGCTGATCAAGGAGTTTGAGAGCTTCA
CTACCTATTTCACCGGCTTCCACGAGAATAGAAAGAACATGTACTCCGCCGAGGAGAAGAGCA
CCGCCATGCCTATCGCTGATCCACCAGAACCTGCCCAAGTTCATCGACAACATGAGGGTGTT
CGAGAAGATCGCCAATTCCCCTGTGAAGGACAAGTTCCAGACCATCCTGTCCGACAACCAACTG
GGCCCAGTCATCCAGGTGATGGCCGTGGAGGACATGTTCCGCCTGGATTACTTTAACGAGACA
CTGACTCAGATCGGCATCGACAAATACAATTCACTGTGCGGCGGCTTTTCACCAAATGAGGGCA
AGGAAAAGATCCAGGGGCTGAATGAGTATATTAACCTGTATAACCAGACAGCTAAGAAGGAA
GAGAGAATCCCCAAGCTGAAGCCACTGTTTAAGCAGATTCTGTCTGATAGATCTACCGCCAGCT
TCATCCCTGACGAGTTCGAGAACGACTCCGAGGTGCTGGAGAGCATCGAGCTGTTTTATCAGG
AGGTGAACGAACAGGTGATTAATAAGAACGTGGAAGGAGAGCACTCACTGAAGGAGCTGCTG
AAGAGCCTGCCCGAGTACGAGCTGACCAAAATTTATCTCCGCAACGATCTGTCAATCACAGACA
TTAGTCAGAAGATCTTTGGAGACTGGGGCGTGTTCCAGAAGGCCATGAATACCTGGTTTGAGC
TGAATTATAACGGCAAGGCCAAGTTCGGAACCGAGAAGTACGAAGAGGAGCAGCGGAAGTAT
TTTGCCAATCTGGATAGCTTCTCCATAGGCTTCATTAATGAGTGCCTGCTGCAGCTGGATACACC
CTACCACAAGAACATCGCCGACTATTTTGCCCTCAGAGGGAAGACCGATACCGAAACCCAGGA
CCTGTTCGCCGTGCTGGAGGACAAGTACAACGCCGTGACCGACCTGCTGAATAACCCCTACCCC
CAGGACCAGGATTTAGCCCAGGACCAAAAGCAGGTGGATAAGCTGAAAGAGCTGCTGGATGC
CGTGAAGGCTATCCAGTGGTTCATTAAACCCCTTCTGGGAAAGGGCAACGAGGCCGACAAAGA
TGAGAGATTCTACGGAGAGTTCACCAGCCTGTGGATCACACTGGATCAGATTACACCTTTGTAC
AACAAGGTGAGAAACTACATGACCAGAAAACCCTACAGCACCGATAAGATTAAGCTGAATTTT
GAGAACTCCTATTTTCTGAATGGCTGGGCTCAGGACTACGAGTCCAAGGCCGGGCTGATCTTCA
CCAAAGACGGCAACTATTATCTCGGCATCAATGACAAGAAGCTGAGCAACGAGGATAAGACAC
TGCTGAAGAGCAACTCTGAGCTGAACCTGGCAAAGAGGATCGTGCTGGATTTCCAGAAACCTG
ATAATAAGAACATCCCCCGGCTGTTCATCCGGAGTAAGGGAAACAACTTTGCCCCTGCCGTGGA
GAAGTACAACCTGCCCATTCATGAGGTCATTGAGATTTACGATAACGGCAAGTTTAAAACAGA
GTACCGCAAGATTAATGAAACAGACTACCTGAAGTCTCTGCACCTGCTGATCGACTACTTTAAG
ATTGGCTTCTCTAAGCACGAGAGCTACAAGCATTACCCCTTCTCCTGGAAGAACACCACCGAGT
ACAAGGACATCGCCGAGTTTTACCACGACGTTGGAGGTGAGTTGCTACCAGGTGTTCGAGGAGA
ACGTGAATTGGGACACCCTGATGAATTTCGTGGATGAGGGGAAGCTGTATCTGTTCCAGCTGT
ACAACAAGGACTTCTCTCCCAACAGCAAGGGAACCCCAAACCTGCACACACTGTATTGGAAGAT
GCTGTTCGATGCTGACAACCTGAAAGACGTCGTGTACAAGCTGAACGGGCAGGCCGAAGTGTT
TTTTAGAAAGTCCTCCATCAAGCCCGAGAATATCGTGCTGACATAAGGCCAACGAGGCCGTCAAC
AACAAGAACGAGCAGAACACAAAGAAGCAGTCTAGATTTGAGTATGATATCATCAAGGATAAG
AGATACACCGTGGACAAGTTCCAGTTCCACGTCCCTATCACCATGAACTTTAAGGCCAGAGGGC
TCAACAACATTAACACCGAGGTGAACCAGTGGCTGCAGAAGAGCGATAACGTGCACATCATCG
GCATTGACAGGGGTGAGAGGCCACCTGCTGTACCTGACCCTGATCGACAGCAAGGGGACATTA
AACAGCAGTTCAGCCTGAACGAGATCGTGAATGAGTATGAGGCAAGACCTACAAGACCGACT
ACCACAAACTGCTGGACAACAGGGAAGGGAACCGCGACGAGGCCCGGAAGAACTGGAAAACC
ATCGAAACCATCAAGGAACTGAAGGAGGGCTACCTGAGCCAGGTGATCCACAAGATTTCTGAG
CTGATGGTGGAGTACAACGCCATTGTGGTGCTGGAAGATCTGAACATGGGCTTCATGAGGGGA
CGGCAGAAAGTGGAGAAGCAGGTGTACCAGAAGTTCGAGAAGATGCTGATCGACAAGCTGAA
CTACCTGGTGGACAAGAAGCAGAACCCAGCTGAGATGGGGGAACCCTGCATGCCTATCAGTT
TACCAACAAGTTTGAATCCTTTCAGAAGATGGGCAAGCAGTCTGGGATGCTGTTCTACGTTCCC
GCTTGGAATACTTCCAAGATGACCCCGTGACCGGCTTCGTGAATCTGTTCGACACCAGGTACG
AAAACATGGAAAAGGCCAGATCCTTCATCGGCAAGTTTGACACAATTCGCTACAATCCCAAGAA
GGAGTACTTTGAATTTGACTTCGACTATAACAAATTCACCGCCAAAGCCGAGGGTACCAGAACT
AGATGGACCCTGTGTACAAACGATACCAGGATCGAAACCTTCAGGAACCCCGCCAAAAATTCC
CAGTGGGATAACCGGGAGATCATTCTGTCTGACGAATTCATCAACCTGTTTAAACTCTACAACA
TCGACTACCAGAATTCCGACCTGAAGGTCCAGATCTGTAAGCAGACCGAAAAAGCCTTTTTGA
GAGGCTGCTGCACCTGCTGAAGCTGACCCTGCAGATGAGGAATAGTATGACTGGCACAGAGGT
GGACTACCTTATCTCACCCGTGACCAATTCCAGGGGCGAGTTCTACGACAGTAGGACTGCAAGC
GACATCCTGCCCAAGAATGCCGATGCCAATGGCGCCTACAATATTGCCCGCAAGGGGATGTGG
GTCATCGAACAGATCAGGAAGGCCACAGACTTCCGGAAGCTGAAGCTGGCTATCAGCAACAAA
GAGTGGCTGAGTTTTGTGCAGCACTGA |
| 201 | 161 | ATGAAGAGGTTTACCAATTTGTATCAGCTGTCAAAGACCCTCAGATTCGAGCTCAAGCCAATAG
GCAAGACTCTGGAGAATATCGAAAAGCACGGCTTCCTCGAGCAGGATACACATAGGGCCGAG
TCCTACGTGAAGGTAAAAGACATTATTGACGAGTATCACAAGGCCTTTATCGAAGAGTATCTCA
ACACTTTCGCGGATTCCTCAGAGACTTACGCAGAGCAAAACAAGAACTTCGTCAAACTGCTCCA
AGAACTGTACACCAATTACATGTGTAAGACGAAGGATGAAACTCAGCAGAAGCTACTGACTGA
GAGTCAGGCAAAGCTACGTAAGATCATAGCCAAAGTTTTAACAACGACAAATACAAACGGCT
GTTCGGTAAGGAATTAATCAAGGAAGAGTTGATCGACTTTCTCAAGGATGACGTCGAGGACAT |

TABLE S9B-continued

Human Codon Optimized Nucleotide Sequences Group 9

| SEQ ID NO | Corresponding AA | Sequence |
|---|---|---|
| | | TACACTGGTGCAGGAGTTCAAGGATTTTACTACATATTTCACCGGCTTTCACGAAAATCGCAAG<br>AACATGTATTCTGATGAAGACAAATCTACCGCCATAGCCTACCGACTGATACACGAGAATCTGC<br>CTAGGTTTATAGATAACATCCTGGTGTTCGAAAAGATTGCCCAAAGCGATGTGGCCCAGAAATT<br>TACAGAGCTGTATAAGAACTTCCAGTCATACCTCAATGTTAAAGAGATCTCCGAGATGTTCAAA<br>TTAGGATACTATAACATGGTGCTGACACAGACACAGATCGACGTGTACAATGCTATAATTGGA<br>GGCAAGACCATCGAGGATAATGACATTAAAATCAAAGGGCTCAATGAATACATCAACCTGTAC<br>AACCAGCAACAGGAGGATAAGCATAACAGGTTACCCAAGCTCAAACCGCTCTATAAACAGATT<br>TTATCTGACCGAACGCCATTAGCTGGCTTCCTGAGCAGTTCGATGCTAATGAGAAAGGCGGCA<br>AAGTTCTGGAGGCTATTCAGAAGGCTTACAATGAGCTGGAGCAACAGATTCTGAACAATTCAA<br>ATGAGGCGGAGCATTCACTGCCTGAACTGCTGAAACTTCTGAGTAACTACGACCTAAACAAGAT<br>CTACATACCCAACGACGCCCAATTGACCGATATTAGCCAAAAGGTGTACGGACACTGGAACAT<br>AATTTCGAAGGCACTGATCGAAGATCTGAAGCTGACCACACCACGGAAATCTCGCAAGGAGAC<br>AGATGAAAAGTACGAAGAGAGACTCAACAAAATCCTGAAGAGTCAATCATCTTTCAGCATCCG<br>CAAGATAACTGACTCCGTGCACAACACATACCCCGAGATCAAATCTAGCATTATAACGTACTTC<br>GAGAATATCGGCAATATCGACAACGAAGAGGAAAACATTATTAGCAAGATCACTAACAGCTAT<br>AACATCGCCAAAGACTTACTGAACACCCCCTACCTCGGGAATAACCTCAGTCAAGACACGGTAA<br>ATGTCGAGAAGATTAAAAACCTCCTGGACGCGATTAAGGACTTGCAGCATTTTATTAAGCCCCT<br>GCTAGGAAAAGGCGATGAGTCTGAGAAAGATGAAAAGTTTTATGGGGAGTTCACTTTATTGTG<br>GGACGAACTGAACAATATTACCCCTCTGTATAACATGGTGAGGAATTATATGACTAGAAAGCCA<br>TACTCCACTGAAAAGATCAAACTGAACTTCGAAAACAGCACACTTCTGGACGGATGGGATTTGA<br>ATAAAGAGACAGACAATACGTCCGTCATTCTGCGGAAAGATGGAATGTACTATCGGCTATAAT<br>GAACAAGAAGCACAATAGGGTGTTTAATATCGATTCGATACCCACCGAAGGGGACTGCTTTGA<br>AAAGATGGAATATAAGTTGTTGCCTGGCGCTAATAAGATGTTGCCAAAGGTATTTTTCTCTAAG<br>TCACGCATCGACGAGTTTGCGCCATCTAAGCAGTTGATAGAAAAATACCAGTCTGGTACTCATA<br>AGAAGGGTGATAACTTTTCTCTGATCGACTGCCATAATCTCATCAACTTCTTCAAAGACTCCATC<br>AATAAACATGAGGACTGGAAAAAGTTCAACTTCAATTTCAGTGACACGAACACTTATGAGGACC<br>TGTCTAATTTCTATAGGGAAGTGGAAAAACAGGGCTATAAAATCAGCTTCCGGAATGTATCTTC<br>AGAGTACATAAACTCACTGGTTGAAGACGGGAAAATCTACCTTTTCCAGATCTACAACAAGGAT<br>TTTTCCAGCTATAGCAAGGGAACACCTAATATGCACACACTGTACTGGAAGATGCTGTTTGACG<br>AAACTAATATGAGTGACGTCTGCTATAAACTGAACGGGCAGGCAGAAATCTTTTTCCGGAAATC<br>CTCGATTAAGGCAGAACATCCGACCCACCCCGCTAATCAGCCGATCGAGAACAAAAATACCCTC<br>AGCAATAAGAAACAATCAGTGTTCACCTATGACCTGATTAAGGACAAACGGTATACTATCGACA<br>AATTCCATTTTCACGTCCCCATCACAATGAACTTTAAAGGCATCGGCATTAACAACATTAACAAC<br>ATCGTGAATCAGTTTATCCAGGAACAAGAAGATCTTCACATAATTGGAATTGACAGAGGAGAA<br>AGGCACTTGCTATATCTAACCGTCATCGACTTACAGGGGAATATCAAGGAGCAGTACAGTCTTA<br>ATGAGATCATCAACAACTATAACGGCAATACCTATAAGACCAACTACCACGATCTTCTCGAAAA<br>AAGAGAAAAAGAACGAATGGATGCTCGTCAGAGTTGGAAGAGTATTGAGAGCATCAAGGAGC<br>TGAAGGAAGGTTACCTCAGCCAGGTTATTCATAAGATCACTAAGCTCATGATCAAATACAACGC<br>TATCGTGGTGCTTGAGGACTTAAATATTGGCTTCATGCGGGGCGACAAAAAGTTGAGGCTTC<br>CGTTTATCAGAAGTTCGAGAAAATGCTCATTGATAAGCTGAACTATCTGGTGGATAAAAAAA<br>GCAGCCTGAGGAACTTGGGGGCACATTGAATGCTTTACAGCTTACCAACAAATTCGAATCCTTT<br>CAAAAGCTGGGCAAGCAGTCTGGATTTCTATTTTATACCCAGGCCTGGAATACCTCTAAAATAG<br>ATCCTGTCACGGGGTTTGTTAACCTGTTCGACACACGCTACGAAACACGCGAAAAAGCAAAGG<br>AGTTCTTTAAGAAGTTTGATTCCATCGTTACAACAGCGAGAAAGATTGGTTTGAGTTCTCCTTT<br>GACTATAACAATTTCACGACTAAGGCTGAGGGTACTAGAACCAACTGGACATTATGTACGTACG<br>GTAAACGAATTGAGACATTTAGAGACGAGAAACAGAATAGTCAGTGGGCCTCAAATGAGATTA<br>ACCTTACCGATAAGTTCAAGGAGTTTTTCGCGAAGTACAACATTGATATCAACGCAAACCTCAA<br>GGAAAGCATTACAGCCCAAGAATCCGCAGATTTTTTCAAAGGGATTCTCGCACTCTTGAAACTA<br>ACCCTGCAAATGCGTAATTCAATGACCGGTACCGATGTAGATTATCTTCAGTCGCCAGTGGCCG<br>ACAACAATGGCGTGTTCTTCAATTCCCAGGAGTGCGACAATAGCCTGCCACAGAATGCCGACG<br>CAAATGGGGCCTACAATATTGCCAGAAAAGGACTTTGGATTGTCAACAAAATCAAGATCAGCA<br>ATGATCTGTCCAACTTGAATTTCGCCATATCCAATAAAGAGTGGCTTCAGTTTGCACAGGAGAA<br>GCCCTACCTTTTGAATGATTGA |
| 202 | 162 | ATGGCAAGTCTGAAAAAATTCACAAGATTGTACCCCCTGTCCAAGACCCTGAGATTCGAGCTGA<br>TTCCACTGGGCCTGACCGCCGACCATATCGGCAAGAGTGGCATCCTGAGCCAGGACGAACACA<br>GGGCCGAATCTTATAAGAAGGTGAAGAAATTATCGATGAGTACCACAAGGCCTTCATCGAGA<br>AGGTGCTGAACAACATCCACCTGCAGTATGACAACATCGAACAGAACAATAGCCTGGAGGAGT<br>ATTTCCTGTACTACATGATCAAAAACAAAGACGAGAAGAAGGAGAAGATCTTTGAGGAGATCC<br>AGAAGAAGCTGCGGAAGCAGATCGCCGATAGATTTATCGACGATCCATCTTTCAAGAATATTG<br>ATAAGAAAGAACTGATTCGCTCCGACCTGAAGGATTTCGTGTGTAGCCAGGAGGATCTGCAGC<br>TGGTGGACGAGTTCAAGGATTTCACCACCTATTTCACAGGCTTCCATGAAAATAGAAAGAACAT<br>GTACTCCTCTGAGGCCCAGAGCACCGCCATCGCCTTCAGACTGATCCATGAGAACCTGCCTAAG<br>TTTATCGATAACATCCAGGTGTTCAACAAGGTGGCCGCCTCATCCGTGTCAGAGTTTTTCACTGA<br>GCTGTACGCCAACTTCGAAGAGTGCCTCACAGTGACCGAGATCGCCGAGATGTTCAAGCTGGA<br>GTACTTTAACAGCGTGCTGACACAGAAGCAGATCGACGTGTACAATTTCATTCTGGGTGGAAA<br>GTCCATCGAGGGGGGCTCTAAGATTAAGGGGCTGAACGAGTACATCAACCTGTACAACCAGCA<br>GCAGAAGGACAAGTCCAAGCGGCTGCCAAAGTTCAAGCCTCTGTTTAAAGAGATTCTGAGCGA<br>CCGAAATAGCATTTCTTGGCTGCCAGAAAAGTTTAAAAGCGACGAGGAAGTGCTGGAGACAAT<br>CGAGAAGGCTTATCAGGAACTCAATGAGCACGTGTTGAACAGAACGTGGGGGGGGAGCACT<br>CTCTGAAGGAGCTGCTGGTGCGGCTGGAGGACTTCAACCTCGACAAGATCTACGTGAGAAACG<br>ACCAACAGCTGACCGACATCAGTCAGAAAATCTTCGGCCACTGGGGGACTATATCCAAAGCCCT<br>GCTGGAAGAGCTGAAGAACGAGGTGCCCAAGAAAGCAACAAGGAGACAGACGAGGCCTAC<br>GAGGAACGGCTGAACAAGATCCTCAAATCCCAGGGAAGTGTGTCTATCGCCCTGATTAACAAC |

TABLE S9B-continued

Human Codon Optimized Nucleotide Sequences Group 9

| SEQ ID NO | Corresponding AA | Sequence |
|---|---|---|
| | | TCCATCCAGAAGCTGAATATCGAAGAGAAAAAGACCGTGAACAGTTACTTCAGCCTGAACAGC<br>AATATTTGCCCCAAGGACAATCTGTATACAAGGATTGAGAACGCCTACCTGGAGGTGAAAGAC<br>CTGCTGAATACCCCTTATACTGGCAAAAATCTGGCCCAGGACAAACTGAACGTCGAAAAAATCA<br>AGAATCTGCTGGACGCCATCAAGTCACTGCAGCATTTCGTGAAGCCCCTGCTCGGCGACGGAA<br>AGGAACCCGAGAAAGACGAGAATTCTATGGCGAGTTCTTGTCTCTGTGGGAGGAACTGGACA<br>AGATCACTCCACTGTACAATATGGTGAGGAATTACATGACACAGAAGCCCTACTCTACCGAGAA<br>GATCAAGATCAACTTTGAAAACAGTACCCTGATGGATGGATGGGATGTGAACAAGGAGCGGG<br>ACAACACCAGCGTGATTCTGCGAAAAGACGGCCTGTATTACCTGGCCATCATGAACAAGAAGA<br>ACAACCAGGTATTTGATGCCCACAATACTCCCAGTAATGGCATCTGCTACGAAAAATGGAGTA<br>CAAACTTCTGCCCGGAGCTAACAAGATGCTGCCTAAAGTGTTCTTCTCCAAATCCCGGATCCAT<br>GAGTTTGCCCCCTCCAAGAAGCTGATCGAGAATTACAAGAACGAGACCCACAAGAAAGGCACC<br>ACTTTCAATCTGGACGACTGTCACAAGCTGATCGACTTTTTCAAGACCAGCATCAAGAAGCATG<br>AGGATTGGAACAGATTTGAGTTTAAGTTTTCTGATACTACCACCTACGAGGATCTGAGCGGGTT<br>TTACAAAGAAGTGGAGCAGCAGGGCTACAAAATCTCTTTCCGCAATGTGAGCGCCGATTACATT<br>GATAATCTCGTGAAGGAGGGCAAGATCTACCTGTTCCAGATTTACAACAAGGACTTCTCCCCAT<br>ATTCCAAGGGCACCCCAAATCTGCACACCCTGTACTGGAAAATGATTTTCGACGAGCGGAATCT<br>GGCCAATGTGGTGTACAAGCTGAACGGCCAGGCCGAGGTGTTTTTTCGGAAGAGCTCCATCTC<br>ATACGACAAGCCTACCCACCCCGCCAACCAGGAGATTGATAACAAGAACATCCTGAATAAGAA<br>AAAGCAGTCCATATTCTCCTACGATCTGATTAAGGACAAGAGATATACTGTGGACAAGTTCCAG<br>TTTCATGTGCCTATCACCATGAATTTCAAGTCCACCGGGCAGGATAATATCAATCTGAGCGTCA<br>ACGAGTACATCCGGCAGAGCGATGACCTGCACATCATCGGCATTGACAGAGGCGAGCGCCACC<br>TGCTGTATCTGACCGTGATCGACCTGGAGGGCAGAATTAAGGAGCAGTATTCCCTGAACGAGA<br>TTGTGAACATCTATAACGGCAATGAGTACCATACCAATTACCATGACCTGCTGTCAAAACGCGA<br>GGACGAGCGGGAGAAGGCCCGCCAGTCATGGCAGACCATCGAGAATATTAAGGACCTGAAGG<br>AGGGCTACCTGAGCCAGGTGATTCATAAAATTTCCGAGCTGATGATTAAATATAACGCCATCGT<br>GGTGCTGGAGGACCTGAACATCGGGTTTATGAGGGGTCGCCAGAAGGTGGAAGCCTCCGTGT<br>ACCAGAAGTTTGAAGAAGATGCTGATCGACAAACTGAACTACCTGGCCAACAAGAAGATTGATC<br>CTGAGGAGGAGGGCGGAATTCTGAACGCCTACCAGCTGACCAACAAGTTCACCAGCTTTCAGA<br>AGATCGGCAAACAGTCAGGCTTCCTTTTTTACACTCAGGCCTGGAACACCTCTAAGATCGACCC<br>CAGCACAGGCTTCGTGAATCTGTTTGATACCAGATACGAGACCCGCGAGAAGAGCAAGATGTT<br>CTTCAGTAAGTTTGACTCAATCAAATATAACAAAGATAAGGATTGGTTTGAATTTATCTTCGACT<br>ATACCAACTTTACCACCAAGGCCGAAGGCACACGCACCCAGTGGACAATCTGCTCCTACGGCAA<br>GCGGATTGAGACACTGAGGGATGAGAACAAAAACTCTAACTGGGTGAGTACCGAGATCGACC<br>TGACCCAATCCTTTAAGAACTTCTTTACCAAGTACGGCATCGACATCAACGACAACCTGAAAGA<br>GTTCATTGTGCAGCAGGATACTTCCGAGTTCTTCAAGGGCATCCTGTACCTGTTCAAGCTGACTC<br>TGCAGATGAGAAACAGCGCCATCGGCAAGGACATCGATTATATTATCAGCCCCATCGCCGAG<br>AGAAAGGCATCTTTTATAATTCCAATGAGTGCGACTCCAGCCTGCCTAAGAACGCCGATGCCAA<br>TGGGGCCTATAACATTGCCCGGAAGGGCCTGTACATTGTGCGAAAGATAAAGCACTCTGATGA<br>ACTCAAAAATCTGAATCTTGCCATAACTAACAAGGAGTGGCTTCAGTTCGCCCAGAGCAAGCCT<br>TACATCAATAAGTGA |
| 203 | 163 | ATGAAGAAACTGAATGCCTTCTCTCGGATCTATCCCCTGTCCAAAACCCTGCGGTTTGAACTGC<br>GCCCTATCGGCAAGACACTGGAGCACATCGAGAAATCAGGAATCCTGAGCCAGGACCAACACC<br>GCGCCGAGTCTTATGTGGAGGTGAAGAAGATCATCGATGAATATCACAAAGCCTTCATTGAGA<br>ATGTGCTGAAGGACTTCCGCTTTAGCGAAAACAGAGGCGAGAAGAACTCCCTGGAGGAGTTCC<br>TGGTGTACTATATGTGTAAGTCCAAGGACGAAACCCAGAAGCGGCAGTTCGCCGATATCCAGG<br>ACAAACTTAGAAAACAGATTGCTAAGAGGTTCTCCGACGACGATAGGTTTAAACGGATCGATA<br>AGAAGGAGCTGATCAAGGAAGACCTGCTGAGCTTCGTGGAGGACGTGGAAAAGCGGCAGCTG<br>ATTGAGGAGTTCAAGGACTTTACCACTTATTTTACCGGATTTCATGAAAATAGAAAGAACATGT<br>ACACTGATGAGGCCCAGAGCACCGCCATCGCCTACAGGCTGATCCACGAGAATCTGCCAAAAT<br>TCATCGACAATATCATGGTGTTTGATAAGGTGGCCGCCTCTCCCATCGCCAAGTACTTCGCCGA<br>GCTGTACTCCGATTTCGAGGAGTACCTGAACGTGTCCGAACTGGGGAGAGATGTTCCGGCTGGA<br>TTACTACAACATTGTGCTGACACAGACTCAGATCGACGTGTATAACGCTGTGGTGGGCGGCCG<br>GACCCTCGATGACGGCACCAAGATCCAGGGACTGAATGAATACATAAACCTGTATAATCAGCA<br>GCAGAAAGATAAGTCCGCCCGGCTGCCCAAGCTGAAGCCTCTGTACAAGCAGATCCTGTCCGA<br>CAGAAACGCTATTAGTTGGCTGCCTGAGCAGTTCCAGAGCGATGAGAAGGTGCTGGAAGCCAT<br>TCTGAAGGCTTATCAGGAGCTGGACGAGCAGGTGCTGAATAGGAAGAAGGAGGGCGAGCACT<br>CCCTGAAGGAGCTGCTCCTGAGCCTGTCCAATTACGACCTGACCAAGATTTACATCAGAAATGA<br>CACACAGATGACAGATATTTCCCAGAAAGCCTTTGGCCATTGGGACGTGATCCCTAAAGCCCTG<br>CTGGAACAGCTTAAGAAGGAGGTGCAGAAGAAGTCTAAAGAGTCCGAAGAGGCTTATGAGGA<br>GCGCCTGAACAAAATTATCAAGTCCCAGGGCTCCATTCCCATAGCCCTGATTAACACAGGGAGTG<br>CAGAAGCAGAACTCCGAAGAACAGAACACCCTGCAGACTTACTTCGCCAGTCTGGGAGCCGTG<br>GAGACCGAGTCCGTGAAGAAGGAGAATCTGTTTACCCAGATTGAAATGCTTACGCCGAGGTG<br>AAAGATCTGTTGAATACCCCTTATAGTGGCAAGAATCTGGCACAAGATAACGTGGCCGTGGAG<br>AAAATCAAAACCCTGCTCGACGCCCATCAAAGCCCTGCAGCACTTCGTGAAGCCTCTGCTGGGCG<br>ACGGAACCGAGAGCGAGAAGGATGAGAAGTTTTACGGCGAATTCTCCATGCTTTGGGAAGAG<br>CTGGACAAGATCACCCCCTGTATAATATGGTGAGAAACTACATGACCCGGAAGCCTTACAGCA<br>CAGAGAAAATCAAGCTGAATTTTGAGAACTCCACTCTGATGAACGGGTGGGACCTGAACAAGG<br>AGCAGGATAACACCACCGTGATCCTGAGAAAAGACGGGATCTATTACCTGGCTATCATGGATA<br>AGAAGCACAAGAAAGTGTTCGACGAGAAAAACATCCTGGGATCCGGGGAATGTTTCGAAAAA<br>ATGGAGTACAAGTTTTTCAAAGATCTCACCACCATGGTGCCCAAGTGCACAACCCAGCTGAAGG<br>TGGTGAAAGAACACTTCCTGACCCACAGCGAGCCCTACACCATCTCCAAGGACGTGTTTTACAG<br>CAAATTCGAGATCACTAAAGAGGGAGTACGAGCTGAACAATGTGCTGTATAATGGCAAAAAGAA<br>ATTCCAGAAAGATTACCTGAGACAGACCGGCGATGAGAAGGGTTATAAGGATGCCCTGACCAA |

TABLE S9B-continued

Human Codon Optimized Nucleotide Sequences Group 9

| SEQ ID NO | Corresponding AA | Sequence |
|---|---|---|
|  |  | GTGGATCCGGTTCTGCCTGAGATTTCTGGCTCAGTACAAGAGCACCATGATTTATGACATTTCCT CTTTTCAGGTGGACTGCAAAATTAACTTCATATACATCCATCGATGAATTTTACAGCGAGATCAAC CTGTATCTGTACAACATCACATTCCGGAACGTGTCGGTGGATTATATTAACTCTCTGGTGGAGG AGGGCAAGATCTACCTGTTCCAGATTTACAACAAGGACTTCAGCCCCTACAGCAAGGGCACTCC CAACCTGCACACCCTGTATTGGAAGATGCTGTTCGATGAAAAGAATCTGGCTGATGTGGTGTAC AAACTGAATGGCCAGGCTGAAGTGTTCTATAGAAAATCATCAATCATCTGTGAGAGGCCAACC CACCCTGCCAACCAGGCCATCAATAATAAAAACGTCCTGAACAAGAAAAAGCACTCCACATTCG TGTACGATCTCGTCAAAGATAAGCGGTACACTGTGGACAAGTTCCAGTTCCACGTGCCCATCAC AATGAACTTTAAGTCCACTGGCGGCGATAACATCAATCTCCTGGTGAACGAGTATATCCAGCAG AGCGACGATCTGCACATCATCGGCATCGATAGAGGCGAGCGCCACCTGCTGTACCTGACCGTG ATTGACCTGCAGGGGCGGATTAAAGAGCAGTATTCCCTGAACGAGATCGTGAACACTTACAT GGCAATGAGTACCGCACTAACTATCACGACCTGCTGAGCAAGCGCGAAGACGAGCGCATGAA AGCCCGGCAGTCATGGCAGACTATTGAGAACATCAAGGAGCTGAAAGAAGGCTATCTCAGCCA GGTGATCCACAAGATCTCTGAGCTGATTGTGAAGTACAATGCCATCGTGGTGCTGGAGGACCT GAACATGGGCTTCATGAGAGGCAGGCAGAAGGTGGAAAGCTCTGTGTACCAGAAGTTCGAAA AGATGCTGATCGACAAGCTGAACTACCTGGTGGATAAGAAGAAAAACCCTGAAGAGGATGGC GGAGTGCTCAACGCCTATCAGCTGACTAACAAGTTTGAGTCATTCCAGAAAGTGGGGAAACAG AGCGGGTTTCTGTTCTACACTCAGGCTTGGAATACATCTAAGATCGACCCCGTGACCGGCTTCG TGAACCTGTTCGACACTAGATACGAGACCAGAGAGAAAGCGAAGGACTTCTTTGGCAAGTTCG ACGCCATCCGCTACAACACCGCCAAAGATTGGTTCGAGTTCGCCTTCGACTACAGCAATTTCACT AGTAAGGCCGAGGGGTCTCGGACTAACTGGACCCTGTGTACCTACGGCAAAGGATCGAGAA GTTTAGAGATGAGAAACAGAACTCCAACTGGGCCTCCAGGGGCATCAATCTGACCGACAAGTT CAAAGAGCTGTTTGCCGAGTATAAGATCGACATTCAAACCGACCTGAAGGAGGTGATCAGCCG CCAGGATAGCGCCGATTTCTTCAAGCGCCTCCTGTATCTGCTCAAGCTGACCCTGCAGATGAGA AACTCCGAGACCGGCACCGAGGTCGACTACATGCAGAGCCCTGTGGCCGACGCAAATGGCAAT TTTTATAACAGCGAGACCTGCGACGACTCCCTGCCTAAGAACGCCGATGCCAACGGCGCCTATA ACATCGCCCGGAAGGGCCTGTGGATTGTGCAGCAGATTAAGGCCACCGACGACCTGAAGAAC GTGAAGCTGAGCATCTCCAATAAGGAATGGCTGAAGTTCGCCCAGGAGAAACCCTACCTGAAC GAGTAA |
| 204 | 164 | ATGAAGAAGCTGAACGCCTTCTCGAGAATCTACCCCCTGAGCAAGACCCTGCGCTTTGAGCTGA GACCCATTGGCAAGACACTGGAGCATATCGAGAAGTCCGGTATCTTGTCACAGGATCAGCACC GGGCCGAGTCCTATGTGGAGGTGAAGAAGATTATCGACGAGTACCACAAGGCCTTCATCGAAA ACGTGCTGAAGGACTTCAGATTTAGCGAGAATCGGGGCGAGAAGAATTCCCTGGAAGAATTCC TGGTGTACTACATGTGCAAGTCTAAAGATGAGATGCAGAAGAGGCAGTTCGCCGACATTCAGG ATAAATTGCGCAAGCAGATCACCCAGCGATTCAGCGACGACAACCGGTTTAAGAGAATCGACA AGAAGGAGCTGATCAAGGAAGACCTGCTGTCCTTTGTGGAGGATGTGGAGAAGAGACAGCTG ATTGAGGAGTTTAAGGACTTCACCACCTACTTTACCGGCTTCCACGAGAACAGAAAGAACATGT ATACCGACGAGGCCCAGAGCACTGCAATCGCCTATCGGCTGATCCACGAGAACCTGCCCAAGT TCATTGACAACATCATGGTGTTCGACAAGGTGGCCGCCAGCCCCATTGCCGAGCATTTTGCCAA GCTGTATTCCGACTTCGAGGAGTATCTGAACGTGAGCGAGCTGGGGGAGATGTTCAGGCTGG ATTATTATAATATCGTTCTGACACAGACCCAGATCGACGTGTACAATGCCATTGTGGGCGGGAA GACCCTGGAGGACGGGAAGAAAATTCAGGGACTGAATGAGTACATCAACCTGTACAACCAGC AGCAGAAGGACAAATCCGCCAGACTGCCTAAGCTCAAGCCCTCTGTATAAGCAGATCCTGTCTG ATAGGAATGCTATCTCCTGGCTGCCCGAGCAGTTTCAGTCTGACGAGAAGGTGCTGGAGGCCA TCCAGAAGGCCTACCAAGATCTGGAGGAGCAGGTCTTTAACCGCAAAAGGAGGGAGAGCAC TCACTGAAAGACCTCCTGCTGAGCTTGTCCGACTATGATCTGTCTAAAATTTACATCAGGAATGA CACTCAGATGACCGACATCTCCCAGAAGGCCTTCGGACACTGGGACGTGATCCACAAGGCCCT GCTGGAGCAGCTCAAGGAAGACGTGCAGAAGAAGCCCAAGAAAGAGAGCGATGAGGCCTAC GAGGAGAGGCTGAACAAGATTATAAAGAGTCAGGGCAGCATCCCCATTGCCCTGATCAATCAG GGGGTGCAGAAGCAGAACAGCGAGGAGCAGAACACCCTGCAGACCTACTTCGCCAGTCTGGG CGCCGTGGGACTGAATCCGTGAAAAAAGAGAATCTGTTTACACAGATCGAGAACGCCTACGC CGAGGTGAAGGACCTGCTGAATACTCCCTACTCCGGCAAGAATCTGGCCCAGGACAACGTGGC CATCGAGAAGATTAAAACACTGCTGGACACAATCAAGGCCCTGCAGCACTTCGTGAAACCCCT GCTGGGGGACGGCACAGAGTCTGAAAAGGATGAGAAATTTTATGGCGAATTTAGTATGCTGTG GGAGGAGCTGGACAAGATTACCCCTCTGTATAACATGGTGCGGAACTATATGACCAGAAAGCC CTACTCCACCGAGAAAATCAAGCTGAACTTCGAAAACAGCACTCTGATGAACGGGTGGGACCT GAACAAGGAGCAGGATAACACCACCGTGATCCTGAGGAAAGATGGGATGTATTACCTTGCTAT CATGAACAAGAAGCACAACAGAGTGTTTGACGTGAAGAACATCAGCAAAACGGCGAGTGTTT TGAAAAAATGGAGTACAAGCTGCTGCCCGGAGCCAACAAGATGCTGCCCAAGGTGTTCTTTTC AAAGAGCAGGATCGACAGTTCGCCCCCTCCGAACAGCTGCTGGAAAATTACAACAAGGGACC CCACAAAAAGGGCAATCTGTTTAACCTGTCTGATTGCCATGCCCTGATCGATTTTTTTAAGGCCT CTATCAATAAGCACAAAGACTGGAGCAAGTTCGGCTTCAAATTCTCTGACACTAACACATACGA GGACCTGTCTGGATTCTACCGAGAGGTGGAGCAGCAGGGATATAATATCTCCTTTCGGAATGT CAGCGTGGACTATATTAATAGCCTGGTGGAAGAGGGAAAGATCTATCTGTTTCAGATTTATAAC AAGGACTTCTCACCCATACAGCAAGGGCACCCCAAACCTGCACACACTTTACTGGAAGATGCTGT TTGACGAAAAAATCTGGCCGATGTTGTGTACAAGCTGAATGGCCAGGCCGAAGTTTTCTTTAG AAATCCTCTATCATTTGCGACAAGCCTACACACCCAGCAAACCAGCCCATCGACAACAAGAAC GCTCTGAATAACAAGCAGCAGTCTGTGTTCGAGTACGATCTGGTCAAAGACAAGAGGTATACC GTGGACAAGTTCAGTTCCATGTGCCCATCACCATGAATTTTAAGAGCACCGGCGGGGATAACA TCAATCTGCTGGTGAACGAGTATATCAGACAGAGCGACGATCTGCACATCATCGGAATCGACA GAGGTGAGAGACACCTGCTGTACCTGACGGTGATTGATCTGCAGGGCCGGATTAAGGACAAG GAGCAGTACAGCCTGAATAAGATCGTGAACACCTACAACGGCGACGAGTACCCAACAAATTAT CACGATCTGCTGAGCAAGCGCGAGGATGAGAGAATGAAGGCCAGGCAGAGCTGGCAGACAAT |

TABLE S9B-continued

Human Codon Optimized Nucleotide Sequences Group 9

| SEQ ID NO | Corresponding AA | Sequence |
|---|---|---|
| | | CGAGAATATCAAGGAACTGAAGGAGGGGTATCTGAGCCAGGTGATTCACAAAATCAGTGAAC
TGATTGTGAAATATAATGCCATCGTTGTGCTGGAAGATCTGAACATGGGATTCATGAGGGGTC
GGCAGAAGGTGGGAGAGCTCCGTGTACCAGAAGTTTGAGAAGATGCTGATCGACAAGCTGAAC
TATCTGGTCGATAAGAAAAAGAACCCTGAGGAGGATGGGGGAGTGCTGAACGCTTACCAGCT
GACAAACAAGTTCGATAGCTTTCAGAAACTGGGCAAGCAGTCTGGCTTCCTGTTTTACACTCAG
GCCTGGAACACCAGCAAGATTGACCCTGTGACAGGGTTTGTGAACCTGTTCGATACAAGATAT
GAAACAAGAGAAAAAGCCAAGGACTTCTTTGGCAAGTTTGACGCCATTCGGTACAACACCGCT
AAGGACTGGTTCGAGTTCGCGTTCGACTACAGCAACTTTACTAGCAAAGCAGAAGGCTCTAGA
ACAAACTGGACACTGTGCACCTATGGAGAACGGATCGAGAAGTTCCGGGACGAGAAGCAGAA
CAGCAATTGGGCCAGCCAGGGCATTAACCTGACCGATAAATTCAAGGAGCTGTTTGCCAAGTA
CAAAATTGATATTCAGGCCGATCTGAAAGAAGCTATCAGTCAGCAGGACTCCGCCGACTTCTTC
AAAGGCCTGCTGTACCTGCTGAAGCTGACACTGCAGATGAGAAATTCTGAGATCGGCACAGAG
ATTGACTACATGCAGTCACCCGTGGCAGATGCAAATGGCAACTTCTATAACTCTGATACATGCG
ATGACAGCCTGCCTAAAAACGCTGACGCAAATGGCGCCTACAACATCGCCCGGAAGGGCCTGT
GGATCGTTCAGCAGATTAAGGCCGCCGATGATCTGAAAAATGTGAAACTGAGCATCTCCAATA
AAGAATGGCTGAAGTTCGCCCAGGAAAAGCCTTATCTGAATGAGTGA |
| 205 | 165 | ATGTTTATCATGACTTCACTTAAACGGTTCACAAGAGTCTACCCCCTGAGTAAGACCCTGAGATT
TGAACTGAAGCCTGTGGGGAAGACCCTGGACCACATCGTGTCTTCTGGACTGCTGGAGCAGGA
CCAGCACCGCGCAGGCAGCTATGTGGAGGTGAAAAAGATTATCGATGAGTACCACAAAGCCTT
CATTGAGTCCAGCCTGGACGATTTTGAGCTGCAGTATTACAATGAGGGGAAGAATAACAGTCT
GGAAGAGTTCTACAGCTATTACATGTGTCGGTCTAAGGATGAAACACAGAAAAAGTTGTTCGA
GGAGAATCAGGACAAGCTCAGAAAGCAGATCGCCGATAGACTGAGCAAGGACGAGAGATTCA
AGCGCATCGACAAAAAGGAGCTGATCGAAAAGGATCTCATCGACTTCGTCAAGAAACCAGAAG
AGAGACAGCTGCTGGAAGAGTTCAAGGGATTTACCACCTATTTTACCGGCTTTCACGAGAATCG
CAAGAATATGTACAGTGCCGAGGCCCAGTCCACTGCCATCGCCTATAGACTGATTCACGAGAAC
CTGCCCAAGTTCATCGACAATATCATGGTGTTTGACAAGGTGGCCGCCTCCCCTGTGGCCGACT
CCTTCGCCGAGCTGTATGCCAATTTCGAAGAGTACCTGAATGTGACAGAAATCGCCGAAATGTT
TAACCTCGCCTATTATAACGTGGTGCTGACCCAGTCCCAGATCGACGTGTACAACGCCATCATC
GGCGGCAAGACCTTCGAGAACGGCGTGAAAATTAAGGGCCTGAATGAATACATCAATCTGTAC
TCCCAGCAGCAGAAGGACAAAAGCGCCCGCCTGCCTAAACTGAAGCCCCTGTACAAACAGATT
CTTAGCGACAGAAACGCCATCAGCTGGCTGCCAGAATACTTTTCAGAGGACGAAAAGCTGCTG
GAGGCTATCCAGAAGTCTTACCAGGAGCTGGATGAGCAGGTGTTCAACCGGAAGAGGGAGGG
CGAGCACAGCCTGAAGGAGCTGCTGCTGGGCCTTGAGGGGTTCGACCTGTCCAAGATTTATAT
CCGGAACGATTTGCAGCTGACAGACATTTCTCAGAAAGTGTACGGTAGCTGGTCAGTGATCCA
GAAAGCACTGCTGGAAGAACTGAAGGGCGAGGTGCAGAAGAAGAGCAAAAAGGAGACCGAC
GAAGCCTACGAAGATAGACTGAATAAGATCCTGAAGTCTCAGGGATCAATCTCCATCGCCCTG
ATTAACGATTGTGTGCACAAGCTGAATTCCGAGGAGCAGAACACAATCCAGGGGTACTTCGCC
ACCCTGGGCGCCGTGGACAACCAGATCCTGCAGAAAGAGAACCTGTTTGTGCAGATCGAGAAC
GCCTACACTGAGATTAAGGACCTGCTGAACACCCCATACCAGGGCAGAAACCTGGCCCAGGAC
AAGGTGAATGTGGAGAAGATCAAGAACCTGCTCGATTCCATCAAGAGCCTGCAGCACTTTGTG
AAACCACTGCTGGGCGACGGGAGCGAAGCCGAGAAGGACGAGAAGTTCTATGGGGAGTTTGT
CGCCCTGTGGGACGAGCTGGACAAAATCACCCCTCTGTACAACATGGTGAGAAATTACATGAC
CAGGAAGCCCTACTCCACAGAAGAATCAAGCTGAATTTCGAAAATTCTACCCTGATGGATGG
CTGGGACCTGAATAAGGAGCAGGCCAACACCACCGTGATCCTGAGAAAGGATGGGCTCTATTA
CCTGGCCATCATGAACAAGAAGAACAACAAAGTGTTCGACGTGAAGAACATTAGCTCTAAGGG
CGAGTGCTATGAGAAGATGGAGTATAAACTGCTGCCCGGCGCTAACAAGATGCTGCCCAAAGT
GTTCTTCTCCAAGAGCAGGATCCACGAATTCGCCCCCTCTGAGCAGCTGCTGGAAAACTATAAC
AACGAGACCCACAAGAAGGGCGCTACCTTCAACCTGTCCGACTGCCACGCCCTGATCGATTTCT
TTAAAGCCTCCATCAATAAGCACGAGGATTGGTCCAAATTCGGATTCAATTTTTCCGACACCTCC
TCCTACGAAGATCTGAGCGGATTTTATCGGGAGGTGGAGCAGCAGGGGTACAAGATCTCCTTT
AGGAATGTGAGCGTGGACTATGTGGATTCACTCGTGGAAGAGGGCAAGATTTATCTGTTCCAG
ATCTACAACAAGGATTTCAGTCTGTATAGTAAGGGCACACCCAACCTGCATACCCTGTACTGGA
AAATGCTGTTCGATGAGAAGAACCTGGCCGACGTGGTGTACAAGCTCAACGGACAGGCTGAA
GTGTTTTTTAGGAAATCCAGTATTAACTACGAGAGACCCACCCACCCCGCCAACCAGCCAATTG
ACAACAAGAATCCCCAGAATGAGAAAAAACAGAGCGTGTTTAACTACGATCTGATCAAGGACA
AGAGATACACAGTCGACAAGTTTCAGTTCCACGTGCCCATCACAATGAATTTTAAGTCCACCGG
CTCCGAGAACATTAATCAGAGCGTGAATGAGCACATCCAGAAGAGCGATGACCTGCACATCAT
CGGCATAGACCGCGGTGAACGCCACCTGCTGTACATCACCGTGATCGACCTCAAGGGAAGGAT
AAAGGAGCAGTTTAGCCTGAACGAGATTGTGAACCACTACAACGGCAAGAACCACTGCACCGA
CTACCACGCCCTGCTGTCCAAAAGGGAGGAGGAGAATGAAGGCTCGGCAGTCCTGGCAGA
CCATCGAGTCTATCAAGGAGCTGAAAGAAGGCTATCTGAGCCAGGTGGTGCACAAGATTAGCG
AGCTGATGGTGAAGTATAACGCCATCGTGGTTCTGGAGGATCTGAACATGGGGTTCATGCGGG
GCAGGCAGAAAGTGGAAGCTAGCGTGTACCAGAAATTCGAAAAAATGCTGATCGATAAGCTG
AACTACCTGGCCGACAAAAGAAAGGGCCAGAGGAGGAGGAGGGGCATTCTGAACGCCTACCA
GCTCACCAATAAGTTCGTGTCCTTCCAGAAGATGGGAAAACAGTCCGGCTTCCTCTTTTACGTTC
CAGCTTGGAACACCAGCAAGATTGACCCCGTGACTGGATTCGTCAACCTGTTTGATACTCGCTA
CGAGACCCGCGAGAAGGCTAAGGCTTTCTTCGCCAAGTTCGAGTCCATCAGGTACAACGAGGA
TAAGGATTGGTTTGAATTTGCATTCGACTACTCTAAGTTTACATCCAAGGCCGATGGCAGCTGC
ACAAAATGGACCGTGTGTACCTATGGCAAGCGAATTGAGACATTCAGAGACGAGAAGCAGAA
CTCTAACTGGGTGAGTAAGGAGGTGTGTCTGACTGAGAAATTCAAGGATTTTTTCGCCAAGTAC
GGCATCGAGCTGAGATCTAATCTGAAGGAGTACATTATCTCCCAGGATAGCGCTGATTTTTCA
AAGGACTGCTGTCCCTGCTGAAGCTGACCCTGCAGATGAGAAACTCCGAAACCGGGACAGATG
TGGATTATCTGCAGAGCCCCGTCGCCGACGCCAACGGGGAGTTCTACAACAGCGAGAACTGCG |

TABLE S9B-continued

Human Codon Optimized Nucleotide Sequences Group 9

| SEQ ID NO | Corresponding AA | Sequence |
|---|---|---|
| | | ACGAATCTCTGCCCGAGAACGCCGACGCAAACGGAGCCTATAATATCGCTCGAAAGGGGCTGT<br>GGGTTGTGAAACAGATAAAAGGGGCCGACGACCTGAAGAATCTGAAGCTCGCCATTTCCAACA<br>AGGAGTGGCTGCAGTTTGTGCAGGCCAAACCCTATCTTAACGACTGA |
| 206 | 166 | ATGAAGACTTTCCAGCAGTTTTCACGCGTGTACCCACTGTCAAAGACCCTGAGATTCGAACTGA<br>AGCCAATCGGCAGTACACTGGAACACATTAACAAGAACGGCCTGCTCGACCAGGACCAGCACC<br>GCGCCAAGAGCTACATTCAGATGAAGAACATTATCGACGAGTACCACAAGGAGTTCATCGAGG<br>ACGTGCTGGACGACCTGGAACTGCAGTACGACAACGAGGGAAGGAATAATAGCATCTCCGAA<br>TTCTACACCTGCTACATGATCAAGTCTAAGGACGACAACCAGAGGAAGTTATACGAGAAGATC<br>CAGGAGGAGCTTCGGAAGCAGATTGCCAACGCCTTTAACAAGTCCGACATTTATAAGAGGATC<br>TTCTCAGAGAAGCTGATTAAGGAGGATCTGAAGAACTTTATCACAAATCAGAAAGATAACGAT<br>AAGAGAGAGCAGGATATCCAGATCATCGAGGAGTTTAAGAATTTCACCACCTATTTCACCGGAT<br>TCCATGAAAATAGGAAAAACATGTACACCAGCGAGGCTCAGAGCACGGCCATCGCCTATAGGC<br>TGATCCACGAGAACCTGCCCAAATTCATCGATAATATTATGGTGTTCGATAAGGTGGCCGCCTC<br>TCCTATCGCTGACAGCTTCAGCGAGCTGTACACCAATTTTGAGGAGTGCCTGAACGTGATGAGC<br>ATCGAGGAGATGTTCAAGCTGAATTATTTTAATGTGGTGCTGACACAGAAGCAGATCGACGTTT<br>ATAACGCCATCATTGGCGGCAAGACCATCGATAATACTAACATCAAATCAAGGGGCTGAACG<br>AATACATCAACCTCTACAACCAGCAGCAGAAGGATAAGAGCGCCCGGCTGCCAAAGCTGAAAC<br>CTCTGTACAAGCAGATCCTGAGCGACCGTAACGCCATCAGCTGGCTCCCTGAACAGTTTGAGTC<br>TGATGACAAACTCCTGGAGGCCATTCAGAAGGCTTATCAGGAGCTGGATGAGCAGGTGCTGAA<br>CAGAAAGATCGAGGGGGAGCACAGCCTGAGGGAACTGTTAGTCGGGCTGGCCGATTACGACC<br>TGTCCAAGATCTACATCAGAAACGACCTGCAGTTGACTGACATTTCCCAGAAAGTCTTCGGCCA<br>TTGGGGCGTGATTAGCAAAGCCCTGCTGGAGGAAGCTGAAGAACGAGGTGCCTAAGAAGAGCA<br>AAAAGGAGTCCGATGAGGCCTACGAAGACCGTCTGAACAAGGTCATCAAATCACAGGGCAGC<br>ATCTCCATTGCGTTCATTAACGACTGCATCAACAAGCAGCTGCCCGAAAAACAGAAGACTATCC<br>AGGGCTACTTCGCAGAGCTGGGAGCCGTGAACAACGAGACTATCCAGAAGGAGAACCTGTTC<br>GCCCAGATTGAAAATGCCTACACAGAGGTGAAGGACCTGCTGAATACTCCATATACAGGAAAG<br>AACCTCGCTCAGGACAAGGTGAATGTCGAGAAAATTAAAAACCTGCTGGACGCCATCAAGGCA<br>CTGCAGCACTTCATTAAGCCCCTGTTGGGCGACGGAACCGAGCCTGAGAAGGACGAGAAATTT<br>TATGGAGAGTTTGCTGCCCTGTGGGAGGAGCTGGATAAAATCACCCCCCTGTATAATATGGTG<br>AGAAACTACATGACCAGAAAGCCTTACTCAACCGAGAAAATCAAGCTGAACTTCGAAAATTCCA<br>CTCTGATGGATGGCTGGGATCTGAACAAGGAACAGGCTAATACTACAGTGATCCTGAGGAAGG<br>ACGGCCTCTACTACCTAGCCATTATGAACAAGAAGCACAACAGAGTGTTTGATGTGAAGGCCAT<br>GCCAGACGATGGGGACTGCTACGAAAAGATGGAGTACAAGCTGCTGCCCGGCGCTAACAAAA<br>TGCTGCCCAAGGTGTTTTTCAGCAAGTCCAGGATCCAGGAGTTCGCCCCAAGCTCTCAGCTGCT<br>GGAGAATTACCACAACGACACCCACAAGAAGGGCGTGACATTCAACATCAAGGACTGCCACGC<br>CCTGATCGACTTCTTCAAAGCCTCCATTAACAAGCACGAGGATTGGTGCAAGTTCGGATTCAGA<br>TTCTCTCCCACCGAGACCTACGAGGACCTGTCTGGCTTCTACAGGGAGGTGGAACAGCAGGGC<br>TACAAGATCAGCTTCAGAAATGTGTCCGTGGACTATATCCACTCCCTGGTGGAGGAGGGAAAA<br>ATCTTCCTGTTCCAGATCTACAACAAGGACTTCAGCCCATACAGTAAGGGGCACACCCAATCTGC<br>ACACACTGTACTGGAAGATGCTGTTCGACGAGAAGAATCTGGCCGACGTGGTGTACAAGCTGA<br>ACGGCCAGGCCGAGGTGTTCTTTAGAAAGAGCAGCATTAATTACGAGCAACCTACACACCCAG<br>CCAATAAGGCAATCGACAATAAGAACGAACTGAACAAGAAGAAGCAGAGCCTGTTTACATACG<br>ACCTGATCAAGGATAAGCGGTACACTATTGATAAATTCCAGTTTCACGTCCCAATCACCATGAA<br>CTTCAAGTCTACCGGTAACGATAACATCAATCAGAGCGTGAACGAGTACATCCAGCAGTCAGA<br>CGACCTGCATATTATCGGGATCGACAGGGGCGAAAGGCACCTGCTGTACCTGACTGTGATCAA<br>CCTGAAGGGCGAAATTAAGGAGCAGTACAGTCTGAACGAGATCGTGAACACCTACAAGGGCA<br>ATGAGTACCGGACTGACTATCATGACCTGCTGAGCAAGAGAGAGGATGAGAGAATGAAAGCC<br>AGGCAGAGCTGGCAGACCATCGAGAACATTAAAGAGCTGAAGGAGGGCTACCTGTCTCAGGT<br>CGTGCACAAGATCGCTGAGCTGATGATCAAGTACAATGCAATTGTGGTGCTGGAGGACCTGAA<br>TGCCGGCTTCATGAGGGGCAGACAGAAGGTGGAGTCCTCTGTGTACCAGAAATTCGAGAAGAT<br>GCTGATCGATAAGCTGAATTACCTGGCCGACAAGAAGAAACAGCCCGAGGAGCCCGGCGGGA<br>TCCTGAACGCCTACCAACTGACTAACAAATTCGTGTCCTTCCAGAAGATGGGTAAGCAGTGTGG<br>GTTCCTGTTCTACACCCAGGCTTGGAACACAAGTAAGATTGACCCTGTGACTGGCTTCGTGAAT<br>CTCTTCGACACACGGTACGAGACTAGGGAGAAGGCCAAGACTTTCTTCGGCAAGTTCGACTCC<br>ATTAGGTACAATGATGAGAAGGATTGGTTCGAGTTTGCTTTTGATTATACTAACTTCACTAGCA<br>AGGCCGACGGTTCTAGGACCAACTGGAAACTGTGTACATATGGCAAGAGGATCGAGACCTTCA<br>GAGATGAGAAGCAGAACTCTAACTGGACTAGCAAGGAGGTGGTGCTGACCGACAAATTTAAA<br>GAGTTCTTCAAAGAGTAATATCGACATCCACAGCAACCTGAAGGAGGCTATCATGCAGCAG<br>GACAGCGCCGATTTTTTCAAGAAGCTGCTGTATCTGCTGAAGCTTACCCTGCAGATGAGAAACT<br>CCGAAACCGGTACAAACGTGGATTACATGCAGAGCCCCGTGGCCGACGAGGAGGGCAACTTCT<br>ATAACTCTGATACCTGCGACTCCAGCCTGCCAAAGAATGCCGACGCGAATGGGGCCTACAACA<br>TCGCCAGAAAGGGTCTGTGGATCGTGCAGCAGATCAAGACATCCGACGATCTGAGAAATCTGA<br>AGCTGGCCATTACCAACAAGGAATGGCTGCAGTTTGCCCAGAGGAAGCCCTACCTGGACGAGT<br>GA |
| 207 | 167 | ATGGGCACACTGAAGCAGTTCACCCAGGGTTTACCCTTTGTCCAAGACCCTGCGGTTTGAACTGA<br>AACCCATTGGCAGAACCCTGGAATTCATTAACTCCTCCGGCCTGCTGGAACAGGACCAGCACAG<br>GGCAGACTCCTATATCAAGGTCAAGGGGATCATCGAGAC<br>CGTGCTGAACGACTTTAAGCTGAATTACACCGACGAGGGCAAGAAGAACAGCTTGGAAGAATT<br>TTACACCTGCTATATGTGCAAGGCAAAGATGAGGCCCAGAAAAAGCTGTTTGAGGAAATACA<br>GGGGAAGCTGCGAAAGCAGATCGCCGACTGCTTTTCCAAAGATGACAAGTTCAAGCGCATCGA<br>CAAGAAGGAGCTGATTAAGGAGGACCTGGTGAATTTCGTGACCAACCAGGAGGACAGACTGC<br>TCATCGATGAGTTCCGGGATTTCACCACCTACTTTACCGGCTTCCACGAAAAATCGGAAGAACAT |

TABLE S9B-continued

Human Codon Optimized Nucleotide Sequences Group 9

| SEQ ID NO | Corresponding AA | Sequence |
|---|---|---|
| | | GTACAGTGCTGAGGCCCAGAGCACCGCCATCGCTTACAGGCTGATCCACGAGAACCTGCCAAA
ATTCATTGACAATATGCTGGTGTTTGACAAGGTGGCCGCTTCCCCCGTGAGCGAGCACTTCGTA
GGCCTGTATAGCAATTTCGAAGAGTACCTGAATGTGATGAATATCGCCGAGATGTTCAGACTG
GACTACTTCAATATCGTGCTGACTCAGAAGCAGATCGATATTTATAATTACATCATCGGTGGCA
GAACCCTTGACGATGGGACCAAGATTAAAGGCCTGAACGAGTATATCAATCTGTACAACCAGC
AGCAGAAGGACAAGAGCGTGAGGCTGCCTAAGCTGAAACCACTGTACAAACAGATCTTGAGC
GATAGAAACGCCATCAGCTGGCTGCCCGAGCAGTTCGAAAGCGACGAGAAGGCCCTGGAAGC
AATCCAGAAGGCCTACCAGGAACTGGACGAGCAGGTGTTTAACAGAAATAAAGAAGGCGAGC
ACTCCCTGAAGGAGCTGCTGCAGACCCTCGCCGAATACGACCTGGACAAAATCTATATCAGGA
ACGATCTGCAGATGACCGATATCTCACAGAAAGTGTTCGGCCATTGGGGCATCATTAGCAAAG
CGCTGCTGGAGCAGCTGAAGAAGGAGCTGCCGAAGAAATCCAAAAAGGAGACTGATGAAGCC
TATGAGGAAAGACTGAACAAGGTGCTGAAGAGCCAGGGGTCAATTTCCATCGCCCAGATCAAC
AATAGTGTGTGGGTTATGGGCATGGAGGAGCAGAATTCCATCCAGGCCTATTTCGCCCGGCTG
GGCGCCGTGAATACAGAAACCGTGCAGCAGGAGAACATCTTCTCTCACATCGAGAATGCTTAC
ACAGAGGTGAAGGATCTGCTGAATACCCCTTACCCCCTGAATAAGAACCTGGCCCAGGACAAG
GTGAATGTGGAGAAAATCAAAAATCTGCTCGACGCCATTAAGTCTCTGCAGCACTACGTGAAG
CCCCTGCTGGGCGATGGCACCGAGTCCGAGAAAGATGAGAAGTTCTACGGAGAGTTTGTGGCC
CTGTGGGAGGATCTGGACAAGATCACACCCCTGTACAACATGGTGAGGAATTACATGACCAGG
AAACCCTATAGTACAGAGAAGATCAAACTGAACTTCGAAAATAGCACACTGATGGACGGCTGG
GACCTGAACAAGGAGCAGGCCAACACCACAGTGATCCTGAGGAAGGACGGGCTGTATTACCT
GGCTATCATGAATAAAAAACATAACAGGGTGTTCGACGTGAAAAACATGCCTGAGAGCGGCG
ACTGCTATGAGAAAATGGAGTACAAACTGCTGCCTGGCGCCAATAAGATGCTGCCTAAAGTGT
TCTTTTCTAAGAGCAGGATTAATGAGTTTGCTCCTAGCGAGCAGCTGATGGCTAATTACCGCAA
TGAGACTCACAAGAAGGGCGCCAGCTTCAACATCCACGACTGCCACGCCCTGATCGACTTTTTT
AAAAGCTCAATCAATAAACATGAAGACTGGTCCAGATTTGGGTTCCACTTTAGCGATACCAACA
CCTACGAGGACCTGTCCGGCTTCTACCGCGAGGTGGAGCAGCAGGGCTATAAGATTTCCTTCA
GGAATGTGAGCGTGGACTACATTCACAGCCTGGTGGAGGAAGGCAAGATCTACTTGTTCCAGA
TCTACAATAAGGACTTCTCCCCCTACAGCAAGGGGACCCCCAATCTGCATACTCTGTACTGGAA
CATGATGTTCGACGAGCGGAACCTGGCAGATGTGGTGTACAAGCTCAACGGCCAGGCCGAGG
TGTTCTTCAGGAAATCCAGCATTACCTGCGAGAGGCCTACTCACCCCGCCAATCAGGCCATTGA
GAATAAGAACGCACTGAACGAGAAGAAGCAGAGCGTGTTTACATACGACCTGATCAAGGATC
GGCGCTATACCGTGGACAAATTTCAGTTCCACGTGCCTATCACCATGAATTTTAAGTCAACCGG
AAACGACAATATCAATCAGTCCGTGAATGAATACATCCAGAAGTGTGACGACCTGCATATCATC
GGGATCGACAGAGGCGAGCGCCACCTGCTGTACCTGACCGTGATTGACATGAAGGGCCAGATT
AAAGAGCAGTACAGCCTGAACGAGATCGTGAACACATACAAGGGCAATGAGTACAGGACCAA
TTACCACGAGCTGCTGAGCAAGAGAGAAGACGAGAGGATGAAGCCCGGCAGTCTTGGCAGA
CCATTGAGAACATCAAGGAGCTTAAGGAGGGCTACCTGAGCCAAGTGATCCATAAGATCTCCG
AGCTGATGGTTAAATACAACGCCATCGTGGTGCTGGAGGATCTGAACATGGGTTTCATGAGGG
GCAGGCAGAAAGTGGAGGCCAGCGTGTATCAGAAGTTCGAAAAAATGCTGATCGACAAGTTG
AACTACCTCCGCCGACAAAAAGAAAAATCCCGAGGAGGAAGGAGGGGATCCTGAACGCTTATCA
GCTGACTAACAAGTTCACCTCTTTCCAGAAAATGGGTAAACAGAGTGGCTTCCTGTTCTATACTC
AGGCCTGGAACACCTCCAAGATTGACCCTGTTACAGGGTTCGTGAACCTGTTCGACACCCGATA
TGAGACAAGGGAGAAGGCCAAAGTGTTCTTCTGCAAGTTCGATTCTATCCGCTACAACCGCGAT
AAGGATTGGTTCGAGTTTGCATTCGACTACAACAAGTTCACCACTAAGGCTGAGGGGACCCAC
ACCCAGTGGATCCTCTGCACCTACGGCAAAAGGATGGAGACCTTCCGGGATGAAAAGCAGAAT
AGCCAGTGGACTTCCCAGGAGTGCGGCCTGACAGACAAATTCAAAGAGTTCTTTGCCAAGTAC
GGCATCGATATTCATACTAACCTGAAGGAGGCTATCGCTCAGCAAGACTCCGCCGACTTCTTCA
AAGGGCTGCTGTATCTGCTGAAACTGACCCTGCAGATGAGAAATAGCAAAACCGGAACTGACA
TAGATTACATGCAGAGCCCTGTGGCCGACGCAAACGGAAATTTCTACAATAGCGAGCTGTGTG
ACAATAGCCTGCCCAAGAATGCCGACGCCAACGGCGCCTATAACATTGCCAGGAAGGGCCTGT
GGATCGTGAGGCAGATCAAGGCCTCAGATGATCTGAGGAACCTGAAGCTGACCATTAGTAATA
AGGAGTGGCTGCAGTTCGCCCAGAATAAGCCATACCTGAATGACTGA |
| 208 | 168 | ATGAGCACCTATAGCGATTTCACTGGGCTGTACACTCTGTCCAAAACGCTACGATTTGAGCTGA
AGCCTATCGGAAAAACCAAGGACAATATAGAACGGAATGGCATATTAGACCGGGATAGCCAG
AGAGCCATTGGATATAAGGCGATCAAGAAGGTGATAGATGAGTACCATAAAGCCTTTATCGAA
TTGATGCTGATAGCTTCGAACTGAAGCTTAAAGACGAAGGTAGAATGGACAGTCTGATGGAG
TTCTATTATCTGTACCATCTGCCTACCATTGATAGCAAAAGGAAGGATGACCTGAAGAAAGTGC
AGGAGGCCTTGCGTAAGCAGATATCCGAGTGCTTTACGAAAAGCGAACAATATAAGCGGCTGT
TTGGGAAGGAACTGATCAGAGAGGACCTGGCGGACTTCATCAAGACACCCAAGTATGAGGGA
GTAATTAGATCCCAGCATGATAACGAGGACCCTTACAGAGGGAGATTCGAAAGATTCAGGAA
GAAGTGGAGAAGACCATAGACCAATTCTATGACTTCACTACCTATTCGTGGGTTTCTATGACA
ACCGTAAGAACATGTATGTGGCCGACGATAAGGCAACCTCAATTGCACATCGGATGATTACCA
AGAACCTCCCAAAGTTTATCGATAATATGGATGTCTTTGCGAAGATCTCTTCCTCAGAGGTTGCC
ACGCACTTCGAAACTCTTTACAAAGAGATGGAGGCTTACTTGAACGTAAACTCCATCGAGGAAA
TGTTCCAGTTAGATTACTTTAGCATGGTCCTTACACAAAAGCAGATTGACGTGTACAATTCAATC
ATCGGAGGAATGGTCCTAGAAAACGGGACGAAAATTCAGGGCTTAAATGAGTATGTTAACCTG
TATAACCAGCAGCAGAAAGATAAAGGCAACCGCTTACCCAAATTGAAACCCCTCTTTAAACAAA
TTCTCAGTGAAAGGAACGCTATAAGTTGGCTGCCAGGAGTTTGAGTCAGACAATGACTGC
TTGATGGTATTGAGAGGTGTTATCAGGACCTGAAGAACAAGTCTTCAATGGAGAGAACAGCA
TGCAGGTGCTCCTGAAAAGCATTGGTGATTATGATCTGGAGCATATCTACCTGCCGAACGATCT
CCAGCTGACCGACATCGCCCAGAAGTATTATGGGTCTTGGTCGGTGATCAAGAAAGCAATGGA
GGAGGACGTGAAAGCCAATAACCCCACAGAAACGGAATGACACCGGCGAAAATACGAAGAGA
GGATCACTAAGTTACTCAAGTCTAAAGAGTCTATCAGCATTGAGGAAATCAATCGCCTGATGAA |

TABLE S9B-continued

Human Codon Optimized Nucleotide Sequences Group 9

| SEQ ID NO | Corresponding AA | Sequence |
|---|---|---|
| | | ATGGCTGTTGGGCGACGATTATAAACCAATGGAGAATTACTTCTCCATGATGGGCGCTGAGGA
TGATGAGAATGGTCAGAAACCTGATCTTTTCATTAGAATTGAGAACGCCTACACTGAGGCAAAA
GCACTCTTGACTTCAGTTTACCCAGAAGATAGGAAATTGAGCCAAGATAAGAAGAATGTGGAG
CGGATTAAAAATCTCCTCGACGCAATTAAAGATCTGCAGCGTTTCGTCAAACCTCTCCTGGGCG
GCGGAACAGAATCAGAAAAAGATCCAAGGTTCTACGGAGAGTTCGTGCCTATGTGGGAGGCA
CTGGACCAGATCACACCGCTTTACAACATGGTCAGGAATCGTATGACACAGAAACCCTACAGTG
AAGAAAAGATTAAACTGAACTTCGACACTCCCACCCTTCTGAAAGGGTGGCCCGATGCCCAAG
CATCCTCCGGTGCCATCCTGAAAGATAATAAGGGGCTATACTACCTGGCTATTTTGGATTCCAT
GCATAGGACATGTCTGAACGAACTCAAGTCCTGCCCCACTGAAAAGAGTGAAATGGCGATTAT
GAAATATCTGCAGGGCGGTGACATGGAAAAAAATGTGCAAATCTGATGCGCATCAATGGCGT
GACTCGCAAGGTGAACGGACGGAAGGAAAAGGAGGGAGCAATGGTTGGCCAGAACATTAGA
CTCGAGAATGCAAAGAACACCTATCTTCCTACAGAGATCAATGATATCCGCCTTAAGCAATCAT
ACCTTACTTCGAGTCAGAGCTTTAATAAGCAGGACCTGGCCCTATACATCGAGTATTACATGCC
ATTGGTAAGGGAATACTACAGCGACTACCAGTTTTCCTTTAGGAATCCCTCGGAGTACAAATCT
TTTGCTGAATTTACCGACCACATCAATCAGCAAGCTTATCAGGTGCAGTTTGGCAGCATCTCCG
ACAAGCAGTTATTCCAGATGGTCGAGGAGGGAAGATATATCTGTTCCAGATTTACAACAAGG
ACTTTTCCCCTTATTCCAAGGGGACGCCCAATATGCACACGCTCTACTGGAAGATGCTGTTCGAT
GAGCGAAATTTGGCTGATGTGGTATATAAGCTCAATGGCGAAGCTGAAGTCTTCTTCAGAAAG
CACTCTATAGAAGTTGGCAGACCGACCCATCCCGCGAATAAGCCTATCGAGAACAAAATAAG
CTGAACGAGAAGAAGATTTCAGTCTTTGCCTACGATTTGTTAAAAGACAGGCGTTACACTGTCG
ATAAGTTCCAGTTCCATGTACCAATAACCATGAACTTTAAGGCCGCAGGGCTAAATAACATCAA
TCCACTGGTGAATGCTTATCTGAAGGAGTCTAAAGCCACACACATCATAGGTATAGACAGAGG
TGAACGGCACCTTCTTTACCTGAGTCTCATCGACTTACAAGGGAACATCGTGGAGCAATACAGT
CTTAACGAAATCGTCAATGAGTACAACGGGAATACATATCGCACTAACTATCACGACCTCTTGG
ATGCCAAGGAAAAGCAACGAGACGAAGCAAGAAAGTCTTGGCAGACCATCGAGAATATAAAA
GAACTTAAGGAGGGCTACATGTCCCACGTGATCCATAAGATCGCAGAACTCATGGTGAAGTAC
AACGCCGTTGTGTTCTGGAAGACCTGAAACCGGGGTTTATGCGCGGCAGACAGAAAGTCGA
GAAGCAGGTGTACCAGAAATTTGAGAAAATGCTGATAGACAAGCTGAACTATCTCGTGGACAA
AAAACTAGAAGCTACCGAAATGGGGGGGGGTTCTCAACGCTTACCAGCTCACAAATAAGTTTGA
AAGTTTTCAGAAGCCTGGGAAGCAAAGCGGGTTTTTATTTTACATACCTGCCTGGAACACATCT
AAAATGGATCCCACTACGGGCTTCGTTAATTTGCTCGATACCCGCTATGAAAATATGGCTAAGG
CTAAGGCTTTCTTCGGCAAGTTCAAATCAATTCGGTACAATGCCACCAAAGACTGGTTCGAGTT
CGCCTTTGACTACAACAACTTCCACAACCGCGCCGAGGGAACCCGAACACAATGGGCTCTGTGC
ACCTATGGTACCCGGATCGAGACTAAGCGGGATCCCAAACAGAACAACAGCTTTGTCTCTGAA
GAGTTTGACCTGACATCTAAGTTCAAGAAGCTGCTAGCCCACTACGCGATTGACCTTAACGGCA
ATCTACTGGAGCAGATTTGTAGCCAGAACGACACTCAGTTTTATAAGGACTTACTCCACCTACTC
CACCTGACACTGCAGATGCGGAATTCTATCACCGGCACAGACGTGGATTATCTGGTGTCGCCAG
TAATGAACGTTTACGGAGAGTTCTATGATTCAAGGACCTGCGGCAACAATCTCCCTAAAAACGC
GGACGCCAACGGAGCCTACAACATTGCTCGAAAAGGATTGTGGATCATCGAACAGATTAAACA
GACAGAAGATTTGAGTAAGCTCAAGTTGGCCATTTCTAACAAAGAGTGGATGAGATACGCACA
AGGACTGCGCTGA |
| 209 | 169 | ATGAAGACCCTGAAAAACCTGACAGGGCTGTACAGCCTGTCCAAGACTCTGCGGTTCGAGCTG
AAACCCATCGGCAAGACTAAAGAGAACATCGAGAAGAACGGAATCCTGGAAAGGGACAATGA
AAGAGCTATCGCCTATAAAGCTGTCAAGAAAGTGATCGACGAGTACCACAAGGCTTTTATTGA
GCTGATGCTGGACGACTTTGAGCTGAACAAGGACACCCTGAACGAATTCTACTATCTGTATCAC
CTGCCTACTTCTGAGGCCAAGCGCAAGACCGATCTGCCAAAGGTGCAGGAGGTGCTGAGAAA
GCAGATCAGTGAAAGGTTCACAAAAAGCGAGCAGTTCAAGAGGCTGTTTGGGAAGGAGCTGA
TCAGGGAAGACCTGGTGGAATTCGTCAAGACCCCTCAGTACGAGAATATCATTAGGAAGATGC
CAGGGAACGAGCAGTTGACCGACAAGGAGGTTAAGCAGATCCAGGAGCGGGTGCAAAAGGA
CATCGCCCAGTTTGATGATTTCACCACCTATTTCTCCGGCTTTTATGATAACAGGAAAAACATGT
ACGTGCCCGAGGACATTGCCACAAGCATTGCCCACAGAATGATCGGGGAGAATCTGCCGAAGT
TCATTGATAACATGGACGTGTTCGCCAGAATAGCCGCTAGCGACGTCGCCACACATTTCGACGA
GCTGAATAAGGCCATGGAGCTGTACCTGAACGTGAACGAGATCCCAGAGATGTTCCAGCTGGA
CTATTTCCACATGGTGCTCACTCAGAAGCAGATCGACGTGTATAATGCCATTATCGGCGGGAAG
GTGCTGGATGATGGCACCGAAGGTGCAGGGGCTGAATGAATACGTGAATCTGTACAATCAGCA
GCAGAAGGATAAGAGCAAGCGGCTGCCCAAGCTGAAGCCACTGTTTAAGCAGATTCTGAGCG
AAAGAAACGCCATCTCTTGGCTGCCCGACGAGTTTGACTCCGACAACGAGATGCTGCAGAGCA
TCGGCAAGTGCTACCACGACCTGAAGAACAGGTGTTTGGCTCCCTGAAGACTCTGCTGGGAT
CCATCAAGGACTATGACCTGGAGCACATCTACCTGCCCAACATCTGCAGCTGACCGATATCGC
TCAGAAGCACTTCGGCGACTGGTCTGTGATTAAGAATGCGTCATCGAGAACCTGCAGGCGT
GAATCCTAAGAAGAAAAGAGAGAATGGAGAAAATTACGATGAACGGATCCTGAAGCTGCAGA
AAGCCAACGATTCCTACAGCATCGGCTTCATCAATGCCCTGCTGAGGAGCAAGACCGATGACTT
TAACCCACTGGAGAATTATTTCGCCGGAATGGGAGCCGAAGCAATGAAAATGGCCAGAAACT
GAATCATTTCGCTAGGATTGAGAACGCTTATACAGAAGTGAAGACCCTGCTGAACGCCGATTAT
CCAGAGGGCAAGTCACTGAGCCAGGACAAAGCCAATGTGGAGAAGATTAAGAACCTGCTGGA
CAGTATCAAGGATCTGCAGCACTACGTGAAGCCCCTGCTGGGCTCAGGCATGGAGTCTGACAA
GGACAATAGATTTTACGGGGAGTTCACCCCACTGTGGGAAGCACTGGATCAGATCACACCACT
GTATAACATGGTGAGGAACAGAATGACCCAGAAGCCATATCCGATGAGAAAATTAAGCTCAA
CTTCGACAATTCCACCCTGCTGGCCGGGTGGGACCTGAATGAGGAAGCAGACAACACTTGCAC
TCTCCTGAGGAAGGACGGGAACTATTACCTGGCCATCATTAACAAGAGGTCCAACAAAGTGCT
GAAGCCAGAGAACCTGATCAGCGATGGCGATTGCTACGAAAAGATGGAGTACAAGCTGCTGC
CAGGGGCCAACAAAATGCTGCCAAAGGTCTTCTTTTCCAAATCTCGGATTGATGAGTTCAAGCC
CAGCGAAAGTGTGCTGAAGAACTACCAGAAGGAGACACATAAGAAGGGGGACAACTTCAACC |

TABLE S9B-continued

Human Codon Optimized Nucleotide Sequences Group 9

| SEQ ID NO | Corresponding AA | Sequence |
|---|---|---|
|  |  | TGGATGACTGCCACGCCCTGATCGATTTTTTAAGGAGAGCATCAATAAGCATGAGGACTGGA<br>GCAAGTTCGGCTTTCACTTCAGCGACACCAATAGCTACGAGGACCTGTCCGGGTTTTACAGAGA<br>GGTGGAACAGCAGGGATACAAGATCAGCTTTAGGAACGTGAGCGTGAACTACATCAATCAGCT<br>GGTGGACGAGGGGAAGATCTACCTGTTCCAGATCTACAACAAAGACTTCTCTCCTTACTCCAAG<br>GGCACCCCTAACATGCATACCCTGTACTGGAGGATGCTCTTCGATGAGAGGAATCTGGCCGAT<br>GTGGTGTATAAGCTGAACGGAGAGGCAGAAGTGTTTTTCCGGAAACACTCAATTAGAGTGGAT<br>AAACCCACTCACCCTGCCAATAAGCCCATCGCCAATAAAAACGCACAGAATGAGAAGAAGGAG<br>AGTATCTTCACCTACGATCTGGTGAAGGACCGGAGATACACCGTGGACAAGTTCCAGTTTCACG<br>TCCCCATCACCATGAATTTCAAGGCCGCCGGGCTGAACAATATCAATCCCCTGGTGAACGCCTA<br>TCTCAAAGAGTCCAATAGCACCCACATTATCGGCATAGACCGCGGCGAAAGACACCTGCTGTAC<br>CTGTCCCTGATCGACATGAAAGGCAACATCGTGGAACAGTACACCCTGAATGAGATCGTGAAT<br>GAGTACAAGGGAAATACCTACCGGACCAACTATCACGACCTGCTGGATGCAAAGGAAAAACAG<br>CGCGACGAAGCCAGACGCTCCTGGCAGACCATTGAGAACATTAAGGAGCTGAAGGAGGGCTA<br>TATGTCCCAGGTGATCCACAAGATCGCCGAGCTGATGGTGAAACACAATGCCATTGTGGTGCTC<br>GAGGACCTTAACATGGGCTTTATGCGAGGGAGACAGAAAGTGGAGAAACAGGTGTACCAGAA<br>GTTTGAGAAGATGCTGATCGATAAGCTGAATTACCTCGTGGATAAGAAACTGGACGCCGAGGA<br>GATGGGGGGCGTGTTGAACGCCTACCAGCTGACAAATAAATTCGAGGGCTTTCAGAAGCTGG<br>GCAAACAGTCCGGCTTTCTGTTCTACATTCCCGCCTGGAACACCTCTAAAATGGACCCGACAAC<br>CGGATTTGTGAACCTGTTCGACACCAGATATGAGAACATGGAGAAGTCAAAGGTGTTCTTCGG<br>CAAGTTTGACAGCATCAGATATAATAGCGCCAAGGGTTGGTTTGAGTTCGCCTTCGACTATGGG<br>AATTTTACAGCTAAGGCCGAAGGCACCCGCACCAACTGGACCCTGTGCACATACGGCACCCGG<br>ATCGAAACCAAGAGAAATCCCGAGAAAAATAACGAGTTCGACTCAGTCGAGATTGACCTGACT<br>GAGCAGTTCAAAGCCCTGTTCGCCAAGCATCAGATCGACCTGAGCGGTAACCTGAAGGAGCAG<br>ATCTGCAATCAGTCCGATGCCAGCTTTCATAAAGAGCTGCTGCACCTGCTGCACCTGACCCTGC<br>AAATGCGGAACAGCGTCACAAACAGCGAAGTGGACTTCCTGCTGTCCCCCGTGATGAACGCCA<br>GCGGCGAGTTCTATGACTCAAGAACCTGCGGGAAGAACCTGCCAGAGAATGCCGACGCCAAC<br>GGCGCTTACAATATCGCCAGAAAGGGACTGTGGATCATTGAGCAGATCAAGAACACCAACGAC<br>AATGACCTGGCCAAGATCAAGCTGGCTATCAGCAATAAGGAGTGGCTTAGGTACGCCCAGGGA<br>CTGGACTGA |
| 210 | 170 | CTGAAAAACAAATATTACGTTTGCATCTTCATTAAGAAGACTATCAACTCCATTATCAATCTGAA<br>GGAGACTAACAAAATGAAGAAGTTCAGCGATTTTACCAACGTGTACCCAGTGTCCAAGACCCT<br>GAGATTTGAGCTCAAGCCAATCGGGAAGACCCAGGAGAACCTGGGCAAAATTATCGATGAAG<br>ACAATCAGAGAGCCAAGGATTATAAGGTGGTGAAGAAAGTGATTGACGAGTACCACAAGGCC<br>GTGATCGAGCAGCTGCTGAACGGGTTCGAGCTGGACAAAGACACCCTGGAGAAGTTTAAAGA<br>TCTGTACCATCTGTCCATCAGCGAGCTAAGAGAAAGGATCTGCCTAAGGTGCAGGAAGTGCT<br>GCGGGAACAGATTTCCAAGCGGTTTATCAAGAGTGAGCAGTATAAGCGGCTGTTCGGAAAGG<br>AGCTGATCCAGGAGGACCTGCCAGAGTTCGTGTATTCTTCAAAATACGGCGACGTCATCAGGA<br>AGCAACACGAGAAGGAACACCTGTCAGACGACGATATCAACCGCGAGAGGAAAAGAATCTGC<br>GATGAGATCGCCCAGTTTGATGACTTTACCTCTTACTTTGGCGGATTTCACGAGAACCGGAAGA<br>ACATGTACGTTGCAGACGATAAAGCCACTAGCATCGCTCACAGACTGATCAATGAGAACCTGCC<br>AAAGTTCGTCGATAACATGGACGTGTTTGCCAAAATCGCCGCATCAGACGTGGCCCAGCACTTT<br>GATAAGCTGTATAAGGAGATGGAGCCTTACCTGAACGTGGGCGCAATCTCTGAAATGTTCGAG<br>ATCGGGTACTTCAGCACCGTCCTGACCCAGAAGCAGATCGATGTTTACAACGCCATCATCGGCG<br>GTAAGGTGGAGGAGGACGGCAGGAAGATCCAGGGTCTGAACGAGTACATCAATCTGTATAAC<br>CAGCAGCAGAAGGATAAGGCAAACAGGCTGCCCAAGCTGAAGCCCCTGTTCAAACAGATCCTG<br>AGCGATCGCAATGCCATTAGCTGGCTGCCCGAAGAATTCGAGTCAGACAACGACATGCTCCAG<br>AGGATCGAGGAGTGCTACCAGAATCTCAAGGAGCAGGTGTTTGACTCCCTGAAGACCCTGCTG<br>GCCAACATCAAGGAGTACGACATTGCCCACATCTACCTCCCTAATGACCTGCAGCTGACCGATA<br>TCTCTCAGAAGCATTTTGGAAGCTGGTCTGTGATCAAGAACGCCGTGATCGAAAGGTGAAAG<br>CCGAGAATCCCCAGAAGAAGAAAGAGTCCGGCGAGAAATACGAGGAGAGGATCGCCAAGGA<br>GCTGAAACACTACGATAGCCTGACAATCGGATTCCTGAACGATCTGCTGAAGAATCAGGTGGG<br>CTTCACCCCTATTGAGATGTATTTCGCTAATATGGGCGCCGAGGACAACGAAAACGGGCAGCA<br>GGTGAACCACTTCGTGCGTATCGAGAATGCTTATACCGACATCTGCCAGCTTCTGAGCACTGAG<br>TATAAAGGGGATTCCCTGGCCCAGGACAAAAGAACGTGGAAAAGATTAAGAACCTGCTGGA<br>TGCAATCAAAAACCTGCAGCACTTCGTGAAGCCCTTGCTGGGGAAGGGCAACGAATCCGAGAA<br>GGATAATCGCTTCTACGGGGAATTCACACCACTGTGGGAAATGCTGGACCAGATCACCCCCCTC<br>TATAATATGGTGAGGAACAGGATGACCAAAAAGCCTTACTCAGAGGAGAAAATCAAGCTGAAC<br>TTCGAGAACTCACAGCTGCTGAAAGGCTGGGACCTGAACAAAGAGGTGGCCAACACCTGTACC<br>ATGCTGAGAAAGGACGGCAATTACTACCTGGTGATCATGAATAAAAAGCACAATACTGTGCTG<br>CAGCCCGGCAAGCTGGTGAGCGACGGGGACTGCTACGAGAAGATGGAATACAAGCTGCTGCC<br>TGGGGCCAACAAGATGCTGCCTAAGGTGTTCTTTAGCAAGAGCAGAATTGGCGAGTTCAATCC<br>CTCCGAGAGGATCATTAATAACTACAACAACAACACTCATAAGAAGGGGATACATTTAACCTG<br>GACGATTGCCACGCCCTCATCGACTTCTTCAAGACCAGCATTAACAAGCATGAAGACTGGTCCA<br>AATTCGACTTTAAATTTAGCGATACTAACACATACTCTGATCTGAGCGGATTTTACCGGGAGGT<br>GGAGCAGCAGGGCTACAAAATCGCCTTCAGAAACGTGAGCGTGCAGTACATCGATCAGCTGGT<br>GGACGAGGGGAAGATTTATCTCTTCCAGATTTACAACAAAGATTTCTCCCCCTACAGCAAGGGC<br>ACCCCAAACATGCATACACTGTACTGGAGGGCCCTGTTCGACGAGAAGAACCTGGCCAATGTG<br>GTGTATAAGCTGAATGGGGAAGCCGAGGTGTTTTTCAGAAAGCATTCTTCTGCCATACAAGCCTA<br>CACACCCTGCCAACCAGCCTATCGCAAATAAGAACTCTCAGAACAAAAAGAAGGAGAGCACAT<br>TCGCCTACGACCTGATTAAGGACCGGCGATACACTCTGGACAAGTTCCAGCTGCACGTGCCCAT<br>CACTATGAACTTTAAGGCCGCCGGCATCAACAATATCAACCTGATGGTCAAGGATTATCTGAAG<br>GAATCTGACGCCACCCACATCATCGGCATCGACAGAGGCGAGCGCCACCTGCTGTACCTGTCTG<br>TGATCAACATGAAGGGGGAGATCGTGGAGCAGTACTCACTGAACGAGATCGTGAACGAGTAT |

TABLE S9B-continued

Human Codon Optimized Nucleotide Sequences Group 9

| SEQ ID NO | Corresponding AA | Sequence |
|---|---|---|
| | | AACGGCAATACCTACAGAACTAATTACCACGACCTGCTGGACGCCAAAGAGAAACAGCGCGAT<br>GAGGCACGCAGGAGCTGGCAGACCATCGAAAACATCAAGGAACTCAAGGAGGGCTATATGTC<br>CCAGGTGGTGCACAAAATCGCCCAGCTGATGGTGAAATATAAGGCTATCGTGGTGCTGGAGAA<br>TCTGAACATGGGCTTCATGCGCGGCCGGCAGAAGGTGGAGAAACAGGTGTACCAGAAATTTG<br>AGAAGATGCTCATCGATAAGCTCAACTACCTGGTCGACAAACAGTGCGCCATCGACGAAGAAG<br>GCGGGATCCTGCACGCCTATCAGTTAACCAACAAGTTTGAGAGCTTCCAGAAAATAGGCACCC<br>AGTCCGGCTTCCTGTTTTACATCCCAGCCTGGAATACATCCAAGATGGACCCTACAACAGGCTTC<br>GTGAACCTGTTTGACACCAGATATGAAAACATGGAGAAAGCCCGCCTGTTCTTCGCCAAGTTCG<br>ATTCCATCCGGTATAATACAAATCAGAACTACATCGAGTTTGCCTTCGACTACGACAATTTCACC<br>TCCAAGGCCGAGGGCACTAAGACAAAATGGACTCTGTGTACCTACGGCACTCGCATCGAGACC<br>AAAAGGAATCCAGACAAGAACAACGAGTTCGACAGCATCGAACTGAATCTGACCGAGCAGTTC<br>AAGGCCCTGTTCACTACATACCATATCGACATCACCGGAAATCTGAAGGAGCAGATCTGCAATC<br>AGAACGACGCAACTTTCTACAAGGGGTTGCTGCACCTGCTGCACCTCACCCTGCAGATGCGAAA<br>CAGTGTGACCGGAACAGCAACAGACTACCTGCTGTCTCCTGTGATGAACAATAAGGGGGAGTT<br>TTTTGACAGCCGGAAATGCGGCAAGAACCTGCCAGAGAATGCAGATGCCAACGGCGCCTACAA<br>CATCGCCAGAAAAGGGCTGTGGGTGATTGAGCAGATTAAACAGGCCGAGGACCTGTCCAACAT<br>CGACCTGGCCATCAAGAACAAGGAGTGGATGCAGTTCGCCCAGAAGAACAGGTGA |

TABLE S9C

Direct Repeat Group 9

| SEQ ID NO | Direct Repeat (Variant #1) | SEQ ID NO | Direct Repeat (Variant #2) |
|---|---|---|---|
| 211 | GGCTACTAAGCCTTTATAATTTCTACTATTGTAGAT | 212 | GCTACTAAGCCTTTATAATTTCTACTATTGTAGAT |
| 213 | ATCTACAATAGTAGAAATTAATTGAGTCAATTAGAC | 214 | ATCTACAATAGTAGAAATTAATTGAGTCAATTAGAC |
| 215 | ATCTACAATAGTAGAAATTAAAATGGCTTTATAGCC | 216 | ATCTACAATAGTAGAAATTAAAATGGCTTTATAGCCA |
| 217 | ATCTACAATAGTAGAAATTCAAATGGCTTTATTGCC | 218 | ATCTACAATAGTAGAAATTCAAATGGCTTTATTGCC |
| 219 | GTCTAAAGGACTCAAATAATTTCTACTATTGTAGAT | 220 | GTCTAAAGGACTCAAATAATTTCTACTATTGTAGAT |
| 221 | GTCTAACAGATTGGAATAATTTCTACTATTGTAGAT | 222 | GTCTAACAGATTGGAATAATTTCTACTATTGTAGAT |
| 223 | ATCTACAATAGTAGAAATTTATAGTCTCTTTTAGAC | 224 | ATCTACAATAGTAGAAATTTATAGTCTCTTTTAGAC |
| 225 | GGCTATAAGCCTTGTATAATTTCTACTATTGTAGAT | 226 | GGCTATAAGCCTTGTATAATTTCTACTATTGTAGAT |
| 227 | GGCTATAAGCCTTATATAATTTCTACTATTGTAGAT | 228 | — |
| 229 | GTCTATAGAGGCTCAATAATTTCTACTATTGTAGAT | 230 | GTCTATAGAGGCTCAATAATTTCTACTATTGTAGAT |
| 231 | GGCTATAAGTCTGTATAATTTCTACTTAGTGTAGAT | 232 | GGCTATAAGTCTGTATAATTTCTACTTAGTGTAGAT |
| 233 | GCCTATAAAGGCACAATAATTTCTACTATTGTAGAT | 234 | GCCTATAAAGGCACAATAATTTCTACTATTGTAGAT |
| 235 | ATCTACGATAGTAGAAATTAACTTGGCTTTATAGCC | 236 | ATCTACGATAGTAGAAATTAACTTGGCTTTATAGCC |
| 237 | GGCTATAAAGCCAATTTAATTTCTACTATTGTAGAT | 238 | GGCTATAAAGCCAATTTAATTTCTACTATTGTAGAT |
| 239 | ATCTACAATAGTAGAAATTTTATTTGTCATTTAGACT | 240 | ATCTACAATAGTAGAAATTTTATTTGTCATTTAGAC |

TABLE S9C-continued

Direct Repeat Group 9

| SEQ ID NO | Direct Repeat (Variant #1) | SEQ ID NO | Direct Repeat (Variant #2) |
|---|---|---|---|
| 241 | ATCTACAACAGTAGAAATTATTGAGGCCTTATAGCC | 242 | ATCTACAACAGTAGAAATTATTGAGGCCTTATAGCC |
| 243 | GTCTATAAGACGATTCTAATTTCTACTATTGTAGAT | 244 | GTCTATAAGACGATTCTAATTTCTACTATTGTAGAT |
| 245 | GTCTATAAGGCCTCAATAATTTCTACTATTGTAGAT | 246 | GTCTATAAGGCCTCAATAATTTCTACTATTGTAGAT |
| 247 | GGCTAATAAGTCGATGTAATTTCTACTATTGTAGAT | 248 | GGCTAATAAGTCGATGTAATTTCTACTATTGTAGAT |
| 249 | GGCTAATAAGTCGATGTAATTTCTACTATTGTAGAT | 250 | GGCTAATAAGTCGATGTAATTTCTACTATTGTAGAT |
| 251 | GGCTAATAAGCCAGTGGAATTTCTACTATTGTAGAT | 252 | GGCTAATAAGCCAGTGGAATTTCTACTATTGTAGAT |
| 253 | ATCTACAATAGTAGAAATTAAATTGGCTTGTTAGCC | 254 | ATCTACAATAGTAGAAATTAAATTGGCTTGTTAGCC |
| 255 | GGCTATAAAGCCATAACAATTTCTACTATTGTAGAT | 256 | GGCTATAAAGCCATAACAATTTCTACTATTGTAGAT |
| 257 | GGCTAGTAAGCTTCAATAATTTCTACTATTGTAGATT | 258 | GGCTAGTAAGCTTCAATAATTTCTACTATTGTAGAT |
| 259 | ATCTACGATAGTAGAAATTATCAAGTCCTTATAGAC | 260 | ATCTACGATAGTAGAAATTATCAAGTCCTTATAGAC |
| 261 | ATCTACGATAGTAGAAATTATCAAGTCCTTATAGAC | 262 | ATCTACGATAGTAGAAATTATCAAGTCCTTATAGAC |
| 263 | ATCTACAATAGTAGAAATTACTTAGGCTTTATAGCC | 264 | ATCTACAATAGTAGAAATTACTTAGGCTTTATAGCC |
| 265 | GTCAAGACAGCATTTAAATTTCTACTATTGTAGAT | 266 | ATTTAAATTTCTACTATTGTAGAT |
| 267 | GGCTATAAGCCTTATTAAATTTCTACTATTGTAGAT | 268 | GGCTATAAGCCTTATTAAATTTCTACTATTGTAGAT |
| 269 | ATCTACAATAGTAGAAATTATAAAAGTCATTTAGAC | 270 | ATCTACAATAGTAGAAATTATAAAAGTCATTTAGAC |
| 271 | ATCTACAATAGTAGAAATTTAATTAGGCGAGTAGCC | 272 | ATCTACAATAGTAGAAATTTAATTAGGCGAGTAGCC |
| 273 | GTCTGAAAGACACATATAATTTCTACTATTGTAGAT | 274 | GTCTGAAAGACACATATAATTTCTACTATTGTAGAT |
| 275 | ATCTACAATAGTAGAAATTATAAAATTACTATAGCC | 276 | ATCTACAATAGTAGAAATTATAAGATTACTATAGCC |
| 277 | ATCTACGATAGTAGAAATTATAAAATTACTATAGCC | 278 | ATCTACGATAGTAGAAATTATAAAATTACTATAGCC |
| 279 | GTCTAATTGACTTTATTAATTTCTACTGTTGTAGAT | 280 | GTCTAATTGACTTTATTAATTTCTACTGTTGTAGAT |
| 281 | ATCTACAATAGTAGAAATTATAATAGTCTTATAGAC | 282 | ATCTACAATAGTAGAAATTATAATAGTCTTATAGAC |
| 283 | ATCTACAATAGTAGAAATTATCCAAGTCCTATAGAC | 284 | ATCTACAATAGTAGAAATTATCCAAGTCCTATAGACT |
| 285 | CTCTATGAGGCACATTTAATTTCTACTATTGTAGAT | 286 | CTCTATGAGGCACATTTAATTTCTACTATTGTAGAT |
| 287 | GTCTATAAGACTTAAGTAATTTCTACTTTTGTAGAT | 288 | GTCTATAAGACTTAAGTAATTTCTACTTTTGTAGAT |

TABLE S9C-continued

Direct Repeat Group 9

| SEQ ID NO | Direct Repeat (Variant #1) | SEQ ID NO | Direct Repeat (Variant #2) |
|---|---|---|---|
| 289 | ATCTACAATAGTAGAAATTTAATCAGCTTTATAGCC | 290 | GTTGTTCGCGACTGCAAATGTATAAAACTTTGAAAGCAATTCACAAC |

TABLE S9D crRNA Sequences Group 9

Figure 9A:
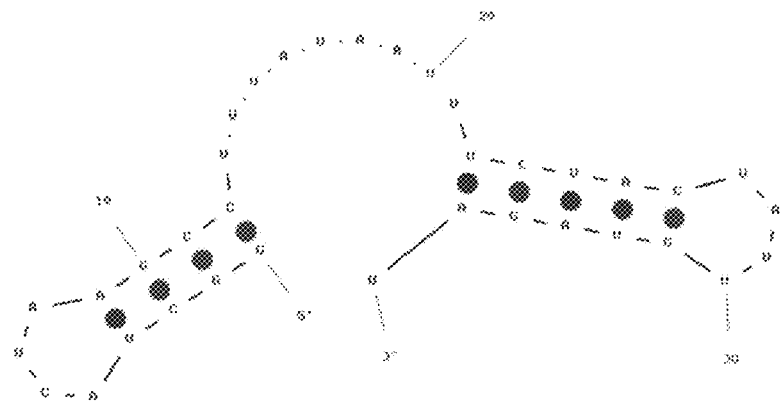
FIG. 9A-9NN (SEQ ID NOs:291-330) are schemes depicting the predicted stem loop structures of crRNA sequences of the present disclosure corresponding to Group 9 sequences.
Figure 9B:
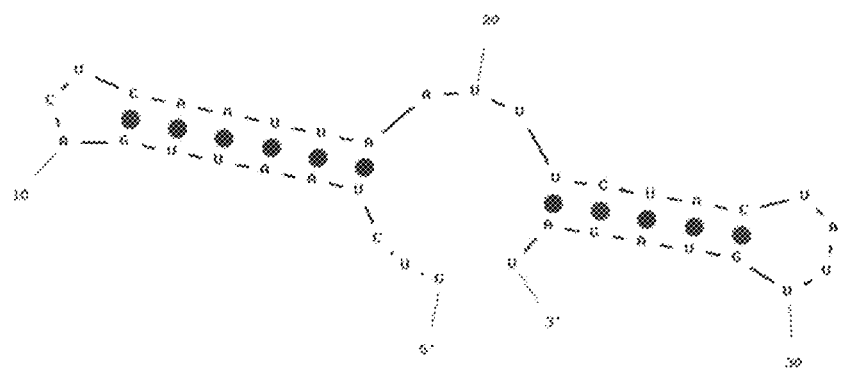
Figure 9C:
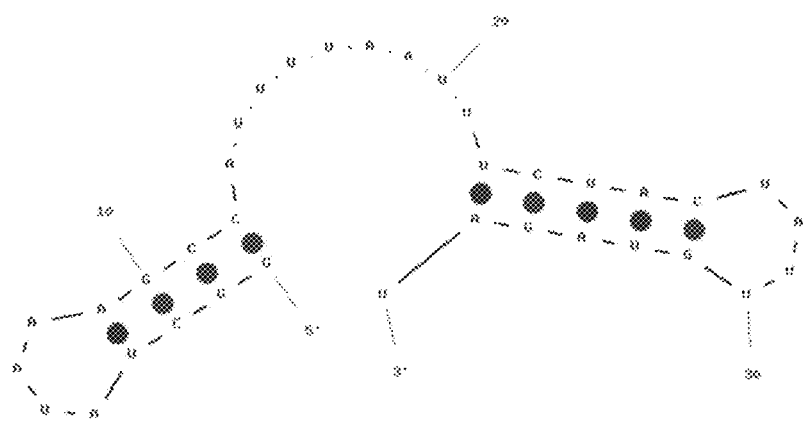
Figure 9D:
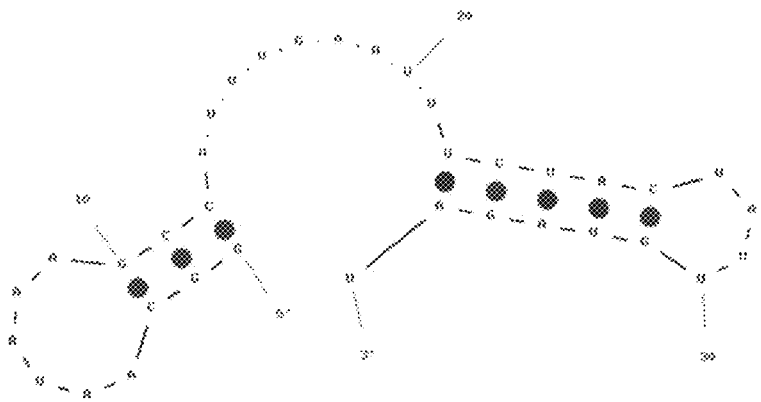
Figure 9E:
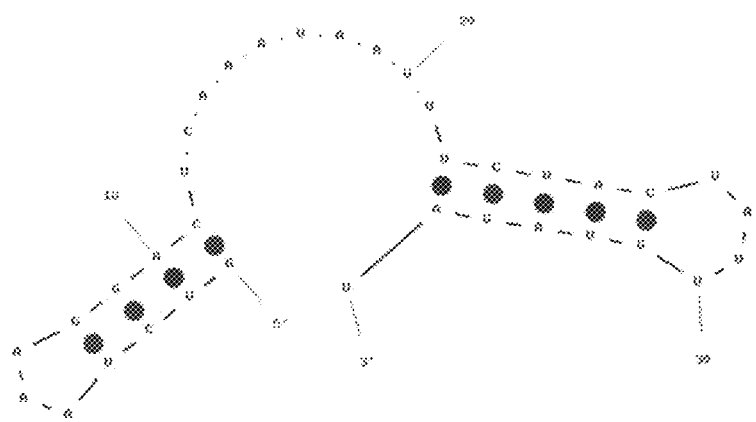
Figure 9F:
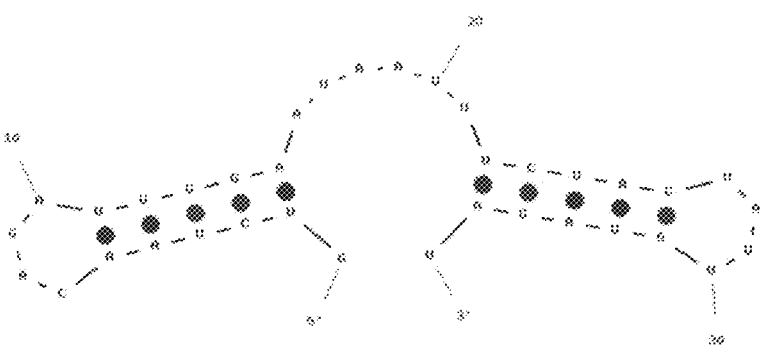
Figure 9G:
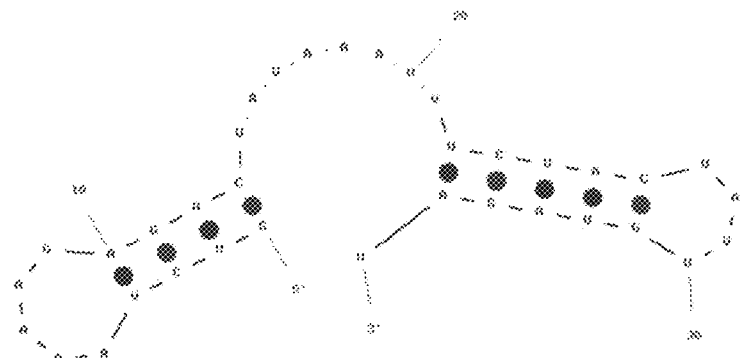
Figure 9H:
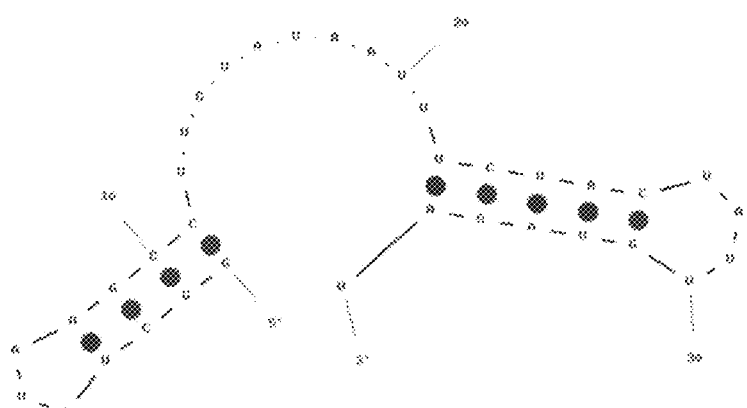
Figure 9I:
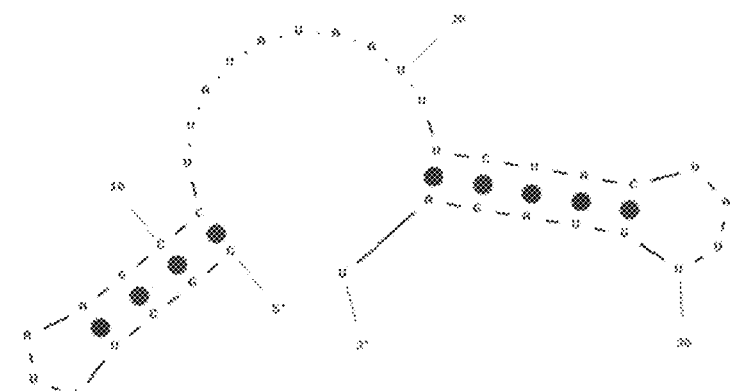
Figure 9J:
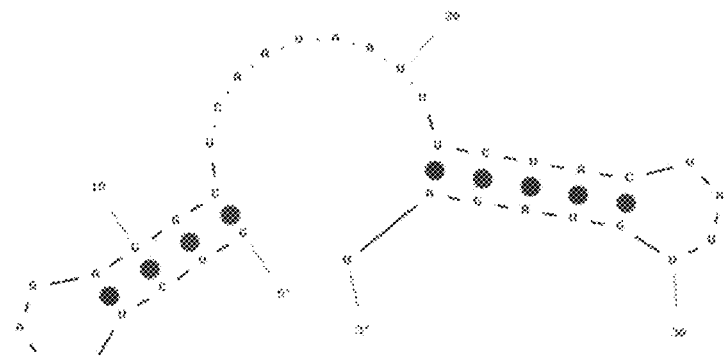
Figure 9K:
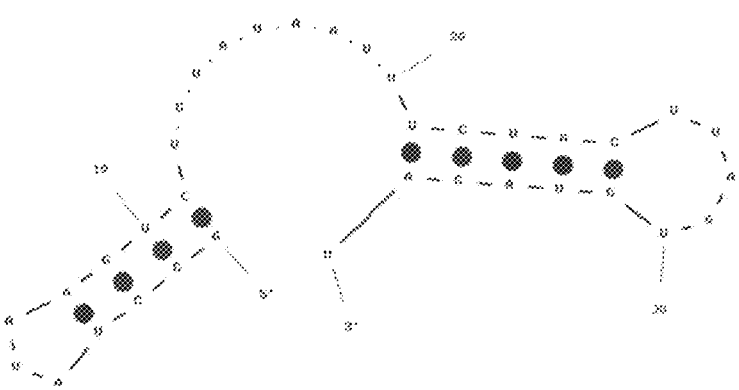
Figure 9L:
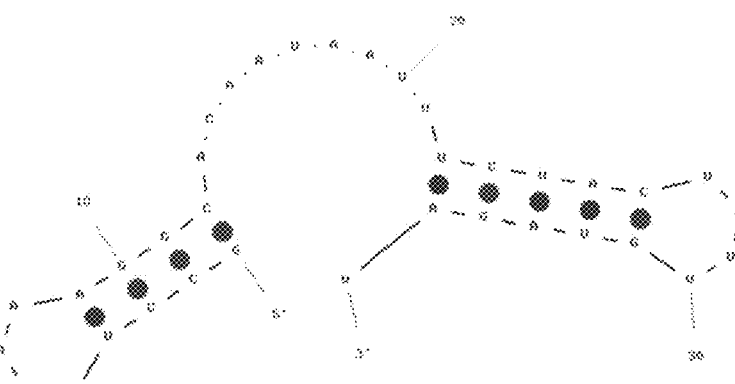
Figure 9M:
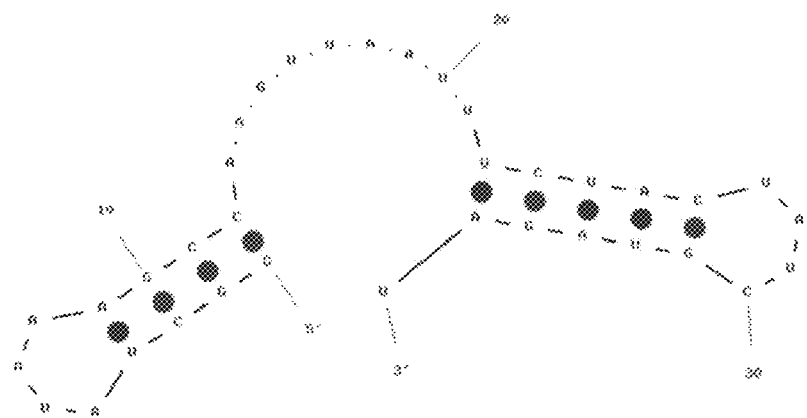
Figure 9N:
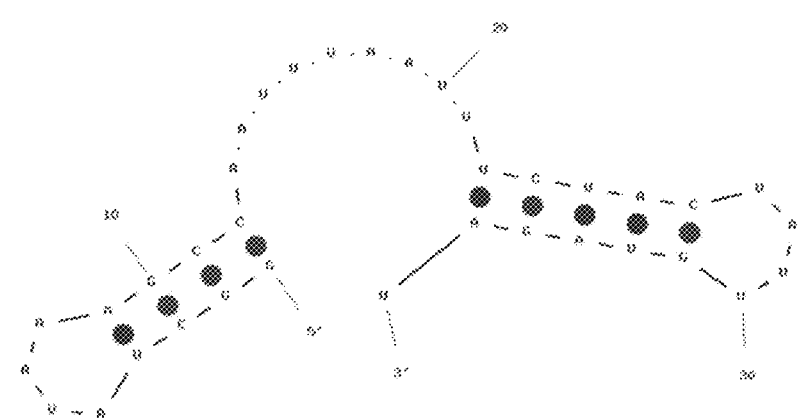
Figure 9O:
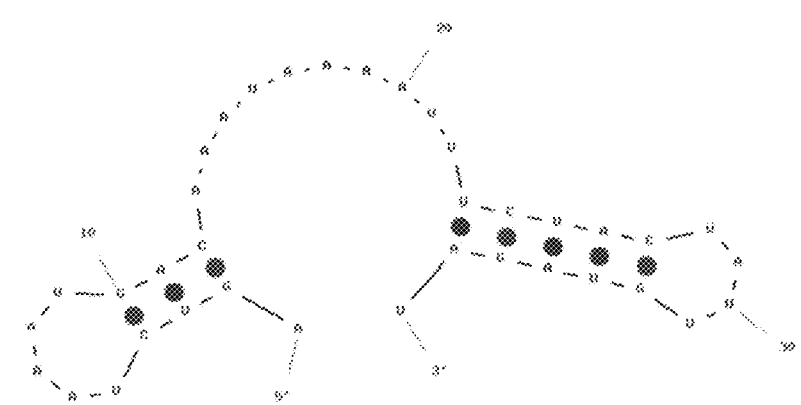
Figure 9P:
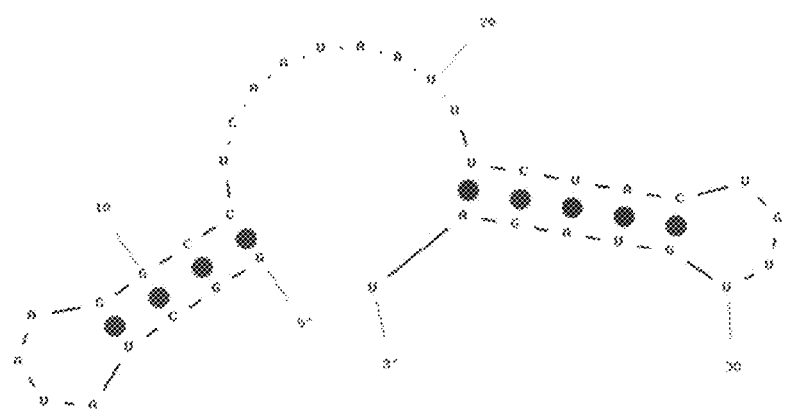
Figure 9Q:
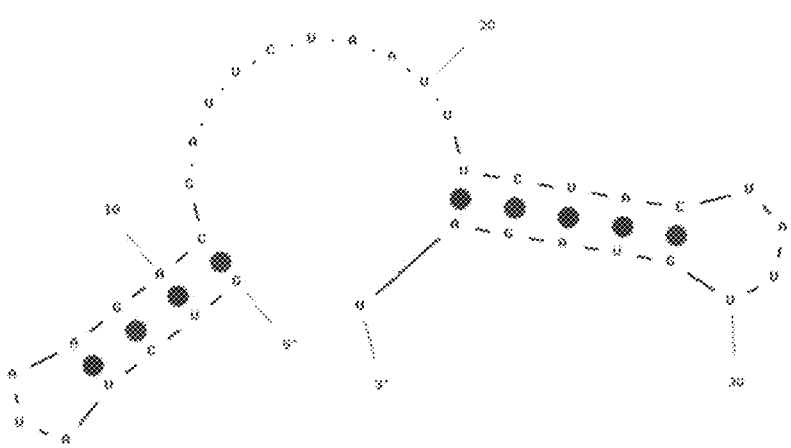
Figure 9R:
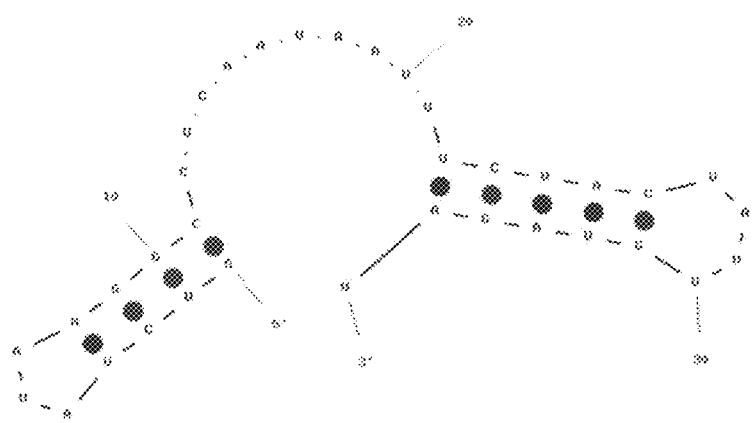
Figure 9S:
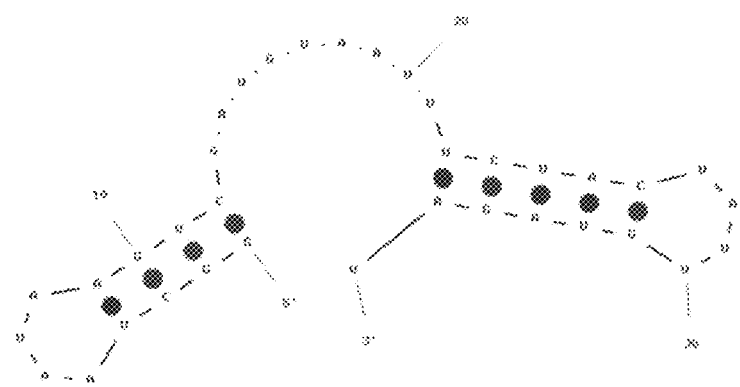
Figure 9T:
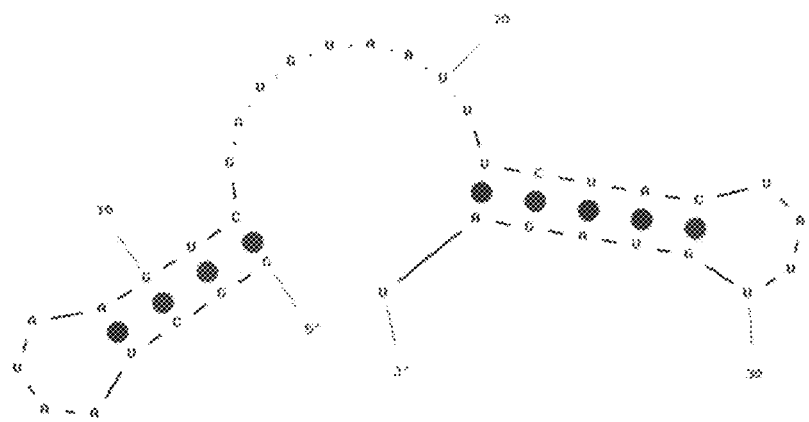
Figure 9U:
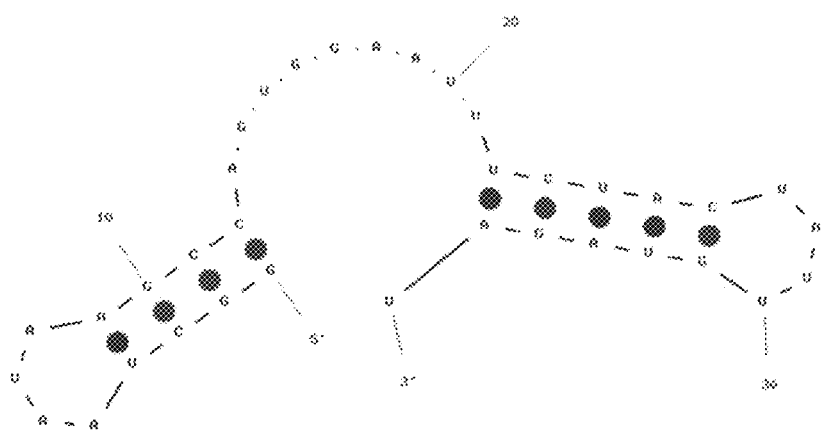
Figure 9V:
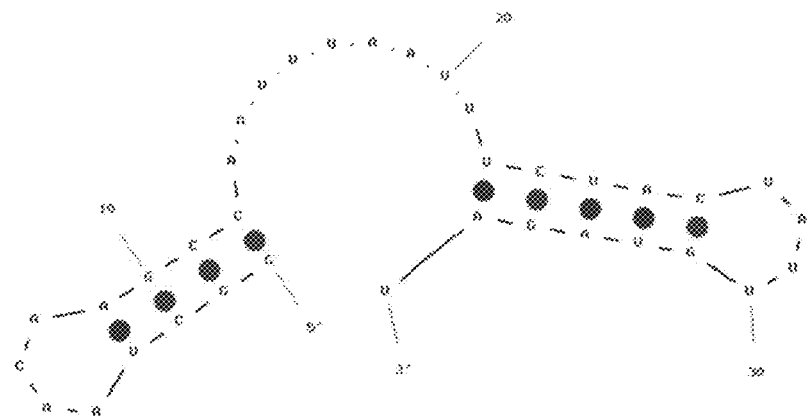
Figure 9W:
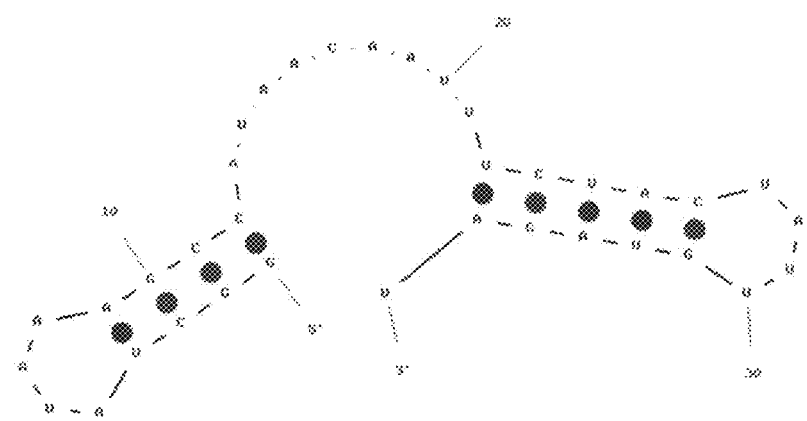
Figure 9X:
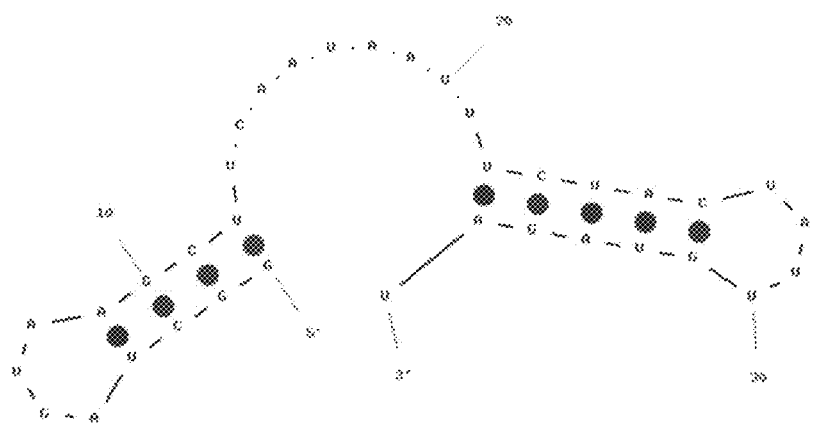
Figure 9Y:
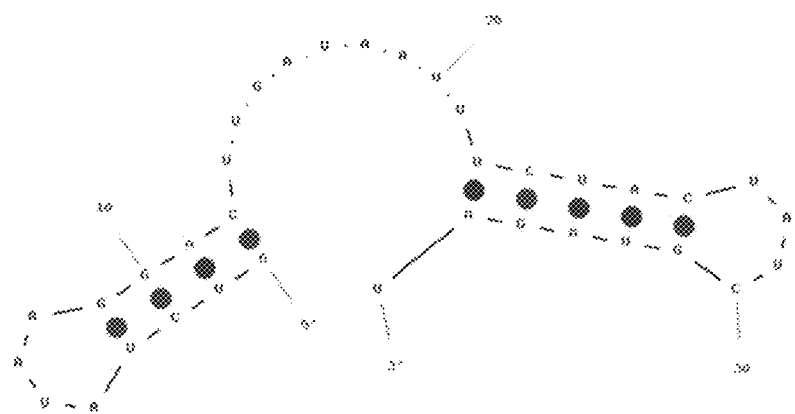
Figure 9Z:
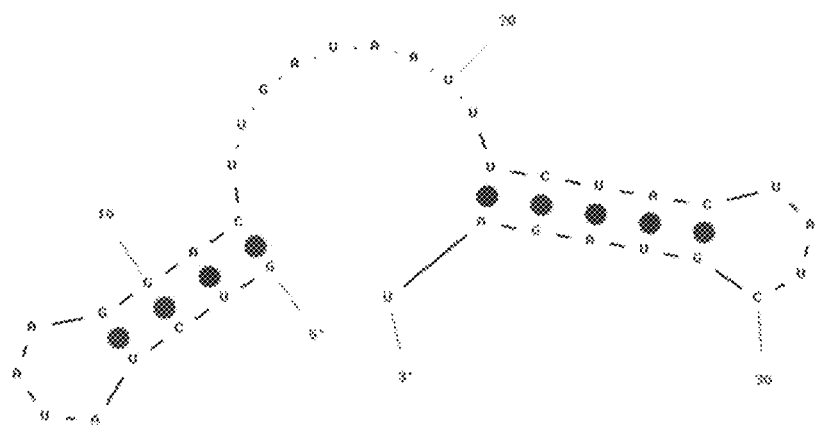
Figure 9A:
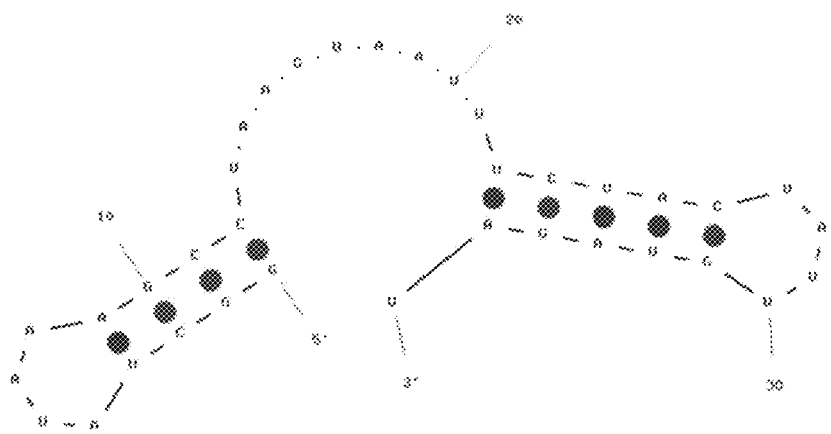
Figure 9B:
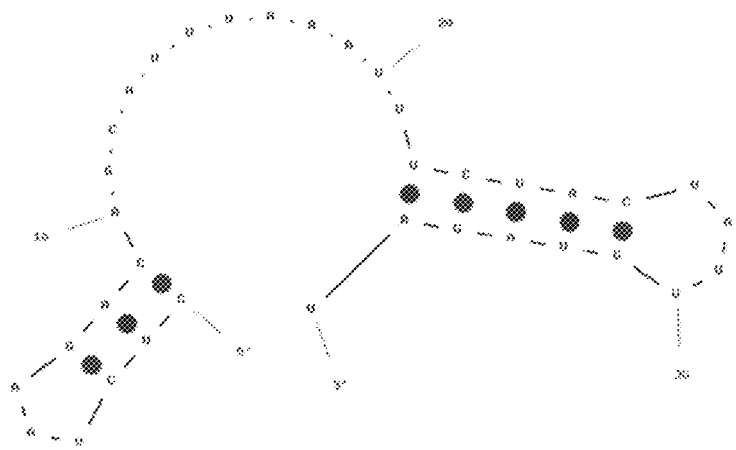
Figure 9C:
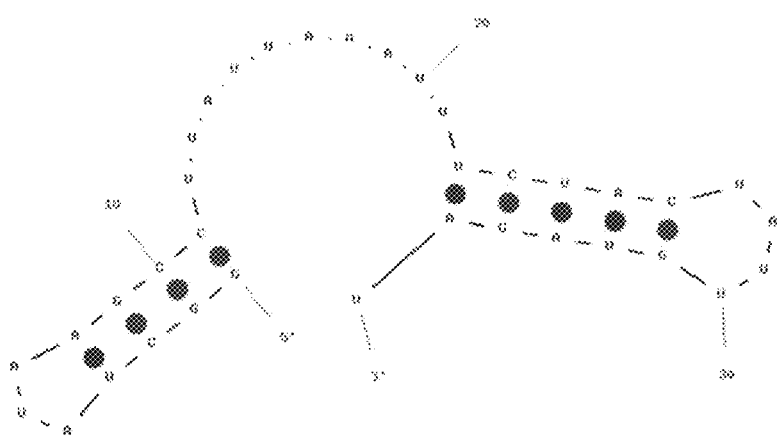
Figure 9D:
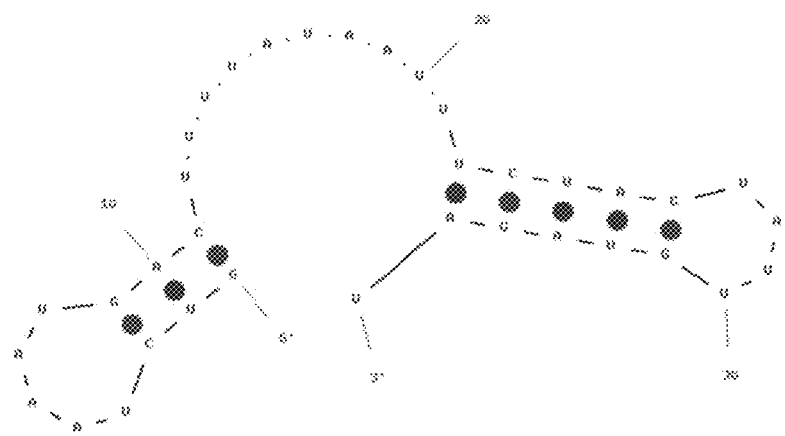
Figure 9E:
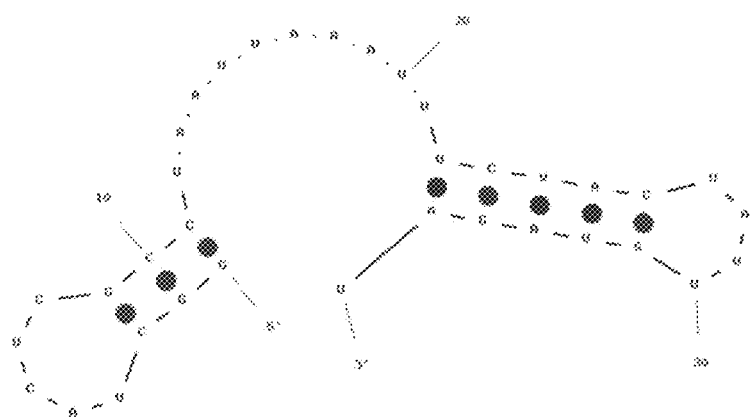
Figure 9F:
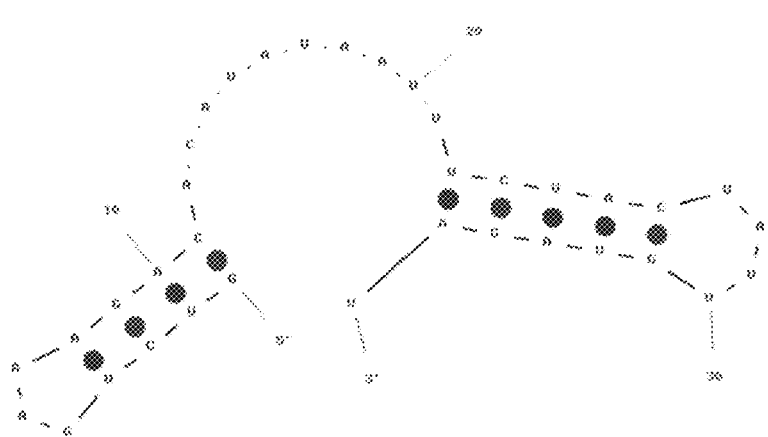
Figure 9G:
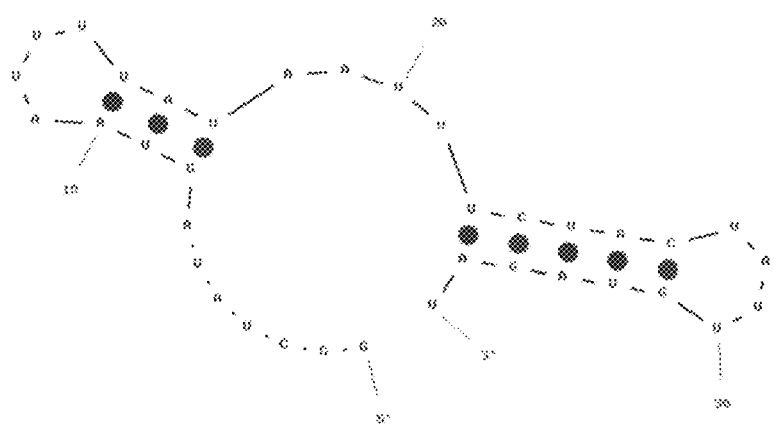
Figure 9H:
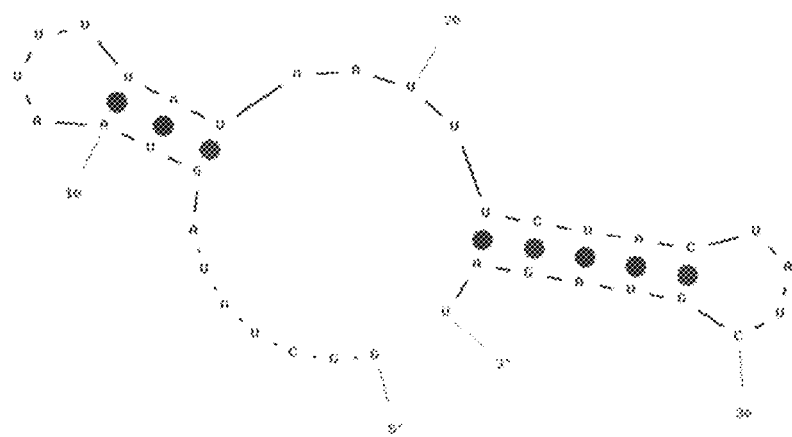
Figure 9I:
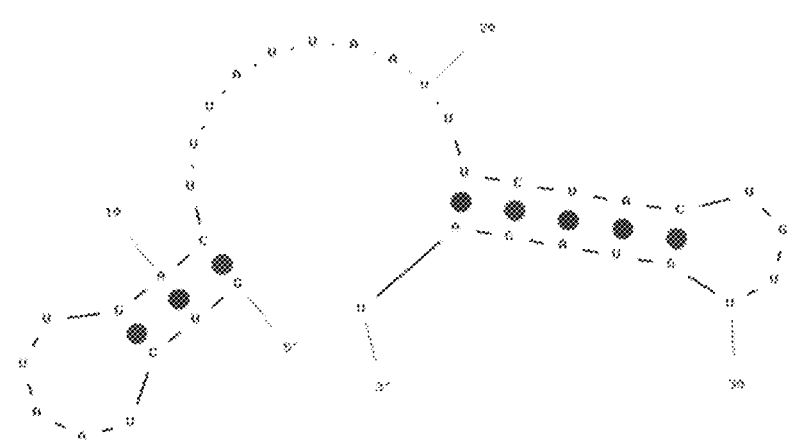
Figure 9J:
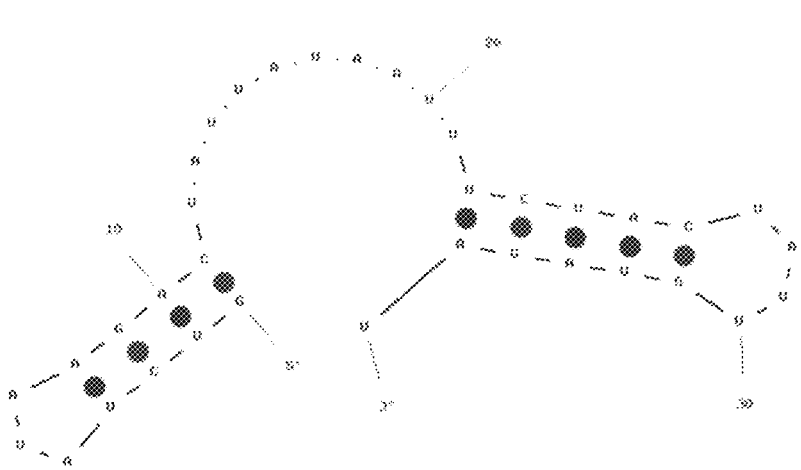
Figure 9K:
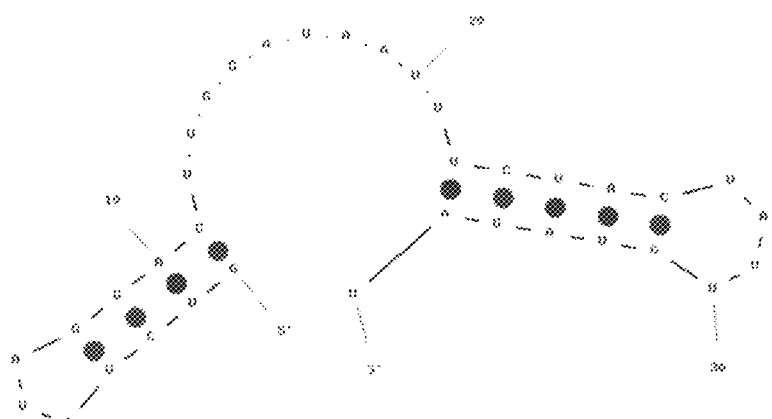
Figure 9L:
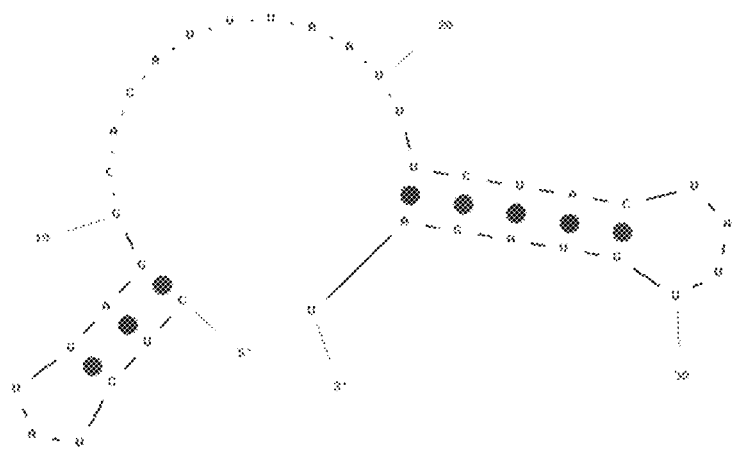
Figure 9M:
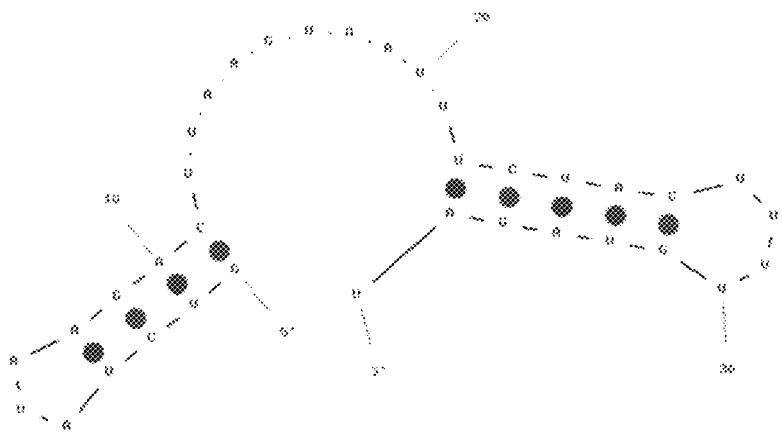
Figure 9N:
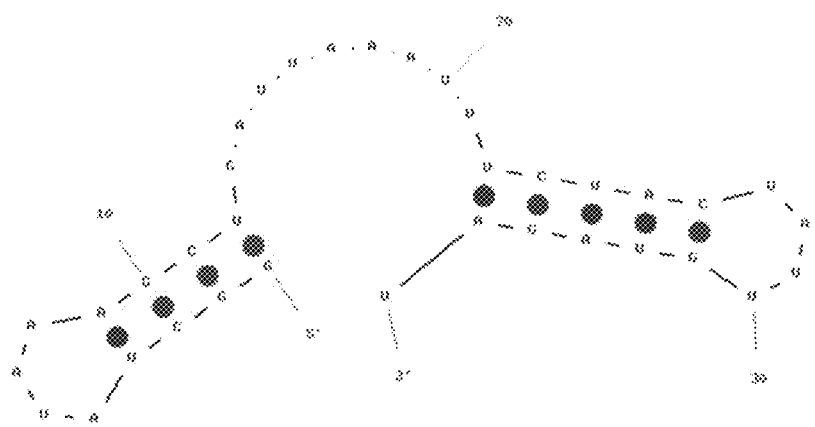

| SEQ ID NO | Sequence | FIG. |
|---|---|---|
| 291 | GGCUACUAAGCCUUUAUAAUUUCUACUAUUGUAGAU | FIG. 9A |
| 292 | GUCUAAUUGACUCAAUUAAUUUCUACUAUUGUAGAU | FIG. 9B |
| 293 | GGCUAUAAAGCCAUUUAAUUUCUACUAUUGUAGAU | FIG. 9C |
| 294 | GGCAAUAAAGCCAUUUGAAUUUCUACUAUUGUAGAU | FIG. 9D |
| 295 | GUCUAAAGGACUCAAAUAAUUUCUACUAUUGUAGAU | FIG. 9E |
| 296 | GUCUAACAGAUUGGAAUAAUUUCUACUAUUGUAGAU | FIG. 9F |
| 297 | GUCUAAAAGAGACUAUAAAUUUCUACUAUUGUAGAU | FIG. 9G |
| 298 | GGCUAUAAGCCUUGUAUAAUUUCUACUAUUGUAGAU | FIG. 9H |
| 299 | GGCUAUAAGCCUUUAUAAUUUCUACUAUUGUAGAU | FIG. 9I |
| 300 | GUCUAUAGAGGCUCAAUAAUUUCUACUAUUGUAGAU | FIG. 9J |
| 301 | GGCUAUAAGUCUGUAUAAUUUCUACUUAGUGUAGAU | FIG. 9K |
| 302 | GCCUAUAAAGGCACAAUAAUUUCUACUAUUGUAGAU | FIG. 9L |
| 303 | GGCUAUAAAGCCAAGUUAAUUUCUACUAUCGUAGAU | FIG. 9M |
| 304 | GGCUAUAAAGCCAAUUUAAUUUCUACUAUUGUAGAU | FIG. 9N |
| 305 | AGUCUAAAUGACAAAUAAAAUUUCUACUAUUGUAGAU | FIG. 9O |
| 306 | GGCUAUAAGGCCUCAAUAAUUUCUACUGUUGUAGAU | FIG. 9P |
| 307 | GUCUAUAAGACGAUUCUAAAUUUCUACUAUUGUAGAU | FIG. 9Q |
| 308 | GUCUAUAAGGCCUCAAUAAUUUCUACUAUUGUAGAU | FIG. 9R |
| 309 | GGCUAAUAAGUCGAUGUAAUUUCUACUAUUGUAGAU | FIG. 9S |
| 310 | GGCUAAUAAGUCGAUGUAAUUUCUACUAUUGUAGAU | FIG. 9T |
| 311 | GGCUAUAAGCCAGUGGAAUUUCUACUAUUGUAGAU | FIG. 9U |
| 312 | GGCUAACAAGCCAAUUUAAUUUCUACUAUUGUAGAU | FIG. 9V |
| 313 | GGCUAUAAAGCCAUAACAAUUUCUACUAUUGUAGAU | FIG. 9W |
| 314 | GGCUAGUAAGCUUCAAUAAUUUCUACUAUUGUAGAU | FIG. 9X |
| 315 | GUCUAUAAGGACUUGAUAAUUUCUACUAUCGUAGAU | FIG. 9Y |
| 316 | GUCUAUAAGGACUUGAUAAUUUCUACUAUCGUAGAU | FIG. 9Z |
| 317 | GGCUAUAAAGCCAAGUAAUUUCUACUAUUGUAGAU | FIG. 9AA |
| 318 | GUCUAAGACAGCAUUUAAAUUUCUACUAUUGUAGAU | FIG. 9BB |
| 319 | GGCUAUAAGCCUUAUUAAUUUCUACUAUUGUAGAU | FIG. 9CC |
| 320 | GUCUAAAUGACUUUUAUAAUUUCUACUAUUGUAGAU | FIG. 9DD |
| 321 | GGCUACUCGCCUAAUUAAUUUCUACUAUUGUAGAU | FIG. 9EE |
| 322 | GUCUGAAAGACACAUAUAAUUUCUACUAUUGUAGAU | FIG. 9FF |
| 323 | GGCUAUAGUAAUUUUAUAAUUUCUACUAUUGUAGAU | FIG. 9GG |
| 324 | GGCUAUAGUAAUUUUAUAAUUUCUACUAUCGUAGAU | FIG. 9HH |
| 325 | GUCUAAUUGACUUUAUAAUUUCUACUGUUGUAGAU | FIG. 9II |
| 326 | GUCUAUAAGACUAUUAUAAUUUCUACUAUUGUAGAU | FIG. 9JJ |
| 327 | GUCUAUAGGACUUGGAUAAUUUCUACUAUUGUAGAU | FIG. 9KK |
| 328 | CUCUAUGAGGCACAUUUAAUUUCUACUAUUGUAGAU | FIG. 9LL |
| 329 | GUCUAUAAGACUUAAGUAAUUUCUACUUUUGUAGAU | FIG. 9MM |
| 330 | GGCUAUAAAGCUGAUUAAAUUUCUACUAUUGUAGAU | FIG. 9NN |

J. Group 10 Type V Nuclease and Associated Sequences (SEQ ID Nos: 331-367)

TABLE S10A

Enzyme Sequences Group 10 (SEQ ID Nos: 331-336)

| SEQ ID NO | Sequence |
|---|---|
| 331 ID411 | LLFIIEFEEKIMKTIENFCGQKNGYSRSITLRNRLIPIGKTEENIEKLQLLDNDIKRSKAYVEVKSMIDDFH<br>RAFIEEVLSKAKLEWGPLYDLFDLFQNEKDKHKKSKIKKELETIQGVMRKQIVKKFKDDDRFDKLFKKEI<br>LTEFVPTVIKADESGTISDKRAALDVFKGFATYFTGFHQNRQNMYSEEAKATAISNRIVNENFPKFYAN<br>VKVFECLQKEYPAIITETEEALSEILNGKKLADIFSADGFNSVLSQSGIDFYNTIIGGIAGEAGTQKLQGIN<br>EKINLARQQLPTEEKNKLKRKMSVLYKQILSDRSTASFIPIGFESSDEVYESVKQFKEQSLDNVISAAKEL<br>FEKSDYDLSQIYVPAKEVTDFSLKLFGNWSILHDGLFLIEKDNSKKTFTEKQIENLRKEIAKTDCSLADLQ<br>NAYERWAKENDVKAEKTVKNYFKIAELRADGKSREKTSVEILNKIESTFEKIDFEKRDNLIKEKETATPIK<br>EFLDEVQNLYHYLKLVDYRGEEQKDTDFYSKYDEILQTLSEIVPLYNKVRNFVTKKPNEVKKVKLNFDN<br>VSLAKGWDVNKESDYTCILLRRSGLYYLGVLNPKDKPKFDSENNGETSINKNDCYEKLVYKYFKDVTT<br>MIPKCSTQLNDVKQHFKNSNEDYILENNNFIKPLVISKRIFDLNNKTFDEKKMFQIDYYRNTGDLKGYT |

TABLE S10A-continued

Enzyme Sequences Group 10 (SEQ ID Nos: 331-336)

| SEQ ID NO | Sequence |
|---|---|
| | EAVKDWISFCMTFVHSYKSTCIYDFSSLGDCSQFKQVDQFYKEINLLLYKIWFVNVTAEKINSLVDSGK
LFLFQIYNKDYSTGKDGGNGSTGKKNLHTMYWENLFSEENLRDVCLKLNGDAELFWRDANPDVKD
VCHKKGSVLVNRTTSDGETIPEEIYQEIYKFKNPNKQEKSFKLSDTAKELLDSGKVGFKEAKFDIIKDRHF
TQKTYLFHCPITMNFKAPEITGRKFNEKVQQVLKNNPDVKVIGLDRGERHLIYLSLINQKGEIELQKTL
NLVEQVRNDKTVSVNYQEKLVQKEGERGKARKNWQTISNIKELKEGYLSNIVHEIAKLMVENNAIVV
MEDLNFGFKRGRFAVERQVYQKFENMLIEKLNYLVFKDKKVAEPGGVLNAYQLTDKVANVSDVGKQ
CGWIFYIPAAYTSKIDPKTGFANLFYTAGLTNIEKKKDFFDKFDSIRYDRKTDSFVFTFDYSDPGDNADF
KKKWELYSRGERLVFSKAEKSVVHVNPTENLKALFDKQGINWSSEDNIIDQIQAVQAERENCAFYDG
LYRSFTAILQMRNSVPNSSKGEDDYLISPVMAEDGSFYDSREEAEKGKTTDGKWISKLPVDADANGA
YHIALKGLYLLQNNFNLNENGYIENISNADWFKFVQEKEYAK |
| 332 | MVISYTFGGKKMKAVEKFCGQKNGYSRSITLRNRLIPIGKTEENIQKLKLLDKDMERAKAYDEVKKLID
EFHRTFIEEVLSKASFEWAPLYDQFDLFQTEKDKLKKNKIKKELEVLQGVMRKKIVESFKKDKRFEKLFK
KELLTEFVPAVIKNDESGTITDKQAALNVFKGFATYFTGFHQNRQNMYSEEAQSTAISNRIVNENFPK
FYANVKVFEYLKNNYPEIINETEKALEEFLNEKKLADIFSPENFNAVMSQSGIDFYNTVIGGIADEAGTK
KLQGLNEKINLASQQLPSEEKYKLKKKMTILYKQILSDRNTASFIPVGFEKSEEVYESVKHFKEEILDKVIT
NTKKLFDSVDYDLGQIYVPAKEVTEFSLKLFGNWSIIHNGMFLLEQDMAKKVLSEKQIEALKKEIAKRD
LSLSDLQNAYERWTKENDVKAEKNVRNYFKLTELRVDEKTKEKDSIEILKNLEVLYSKIDFEKQENLIQE
KTSATPIKDYLDEIQNLYHYLKLVDYRGEEQKDTDFYSKYDEIIQTLSEIIPLYNKVRNFVTKKPNEIKKVK
LNFDCPTLANGWDLNKESSNDAIILRKNGNYYLGIFNPKDKPKFEYNNEDSGYEKMIYKLLPGPNKML
PKVFFSAKGLETFRPPKDLVLGYEEGKHKKGDNFDKVFMHKLIDWFKYAINQHEDWKNFNFKFSPTE
FYEDMSGFYKEVELQGYKITFNKVSDNCINSLVDSGKLFLFQIYNKDYSTGEEGGNGSTGKKNLHTLY
WENLFSEENLRDVCFKLNGEAEFFWRDANPNVKAVCHKKDSVLVNRTTSDGKSIPEEIYQEIYKYKNP
EKQEKEFTLSKDAKELLESGTVVCKKAKFTITKDRHFTQQTYLFHCPITMNFKAPEITGRKFNEHVQEIL
RNNPEVKVIGLDRGERHLIYLSLINQKGEIELQKTLNLVEQVRNDKTVSVNYQEKLVHKEVERDKARKS
WQSISNIKELKEGYLSNIVHEIAKLMVENNAIVVMEDLNFGFKRGRFPVERQVYQKFENMLIEKLNYL
VFKDKNVTEPGGVLNAYQLADKAVNVSDVGKQCGWIFYIPASYTSKIDPKTGFANLFYTAGLTNIEKK
KDFFDKFDSIRYDRKLDSFVFGFDYSNLSDNADYNKKWELYSRGERLVYSKAEKSTISVNPTENLKVLF
DKQGIVWDSKDNFIDQIHAVQAERDNVPFYDGLYRSFTAILQMRNSVPNSSKQEDDYLISPVMADD
GNFYDSRLEAAKGKDEKGNWISKLPVDADANGAYHIALKGLYLLKNDFNLNEKGYIENISNADWFKF
VQNKEYQDC |
| 333 ID401 | MKTIDSFCGQNEGYSRSITLRNKLIPIGETEKNIKEFLEKDVERSEAYPQIKKLIDDIHRGFIEECLSNVSFP
WEPLFDQFELYQNEKEKIKKNAKKKELIVLQVAARKRIVKAFKDNKDFEKLFKEELFKELLPQLIKSAPVT
EIADKEKALSVFTRFSTYFNGFHENRKNMYSEEEISTGIAYRIVNENPPKFFSNIKLFEYLKDNFPEIIKET
EISLKDTLKGKKLCDIFKVEAFNNVLSQSGIDFYNTIISGVAGEGGTQKIKGMNEIINLAKQQLPKEEKD
KLHGKMVVLFKQILSDRETASFIPTGFEKNEEVYASIKEFNNIVRLDSIDKLNEIIVPAK
SITAFSLTIFGNWVIISEGLYLLEKDKITKALSEKQEEQLHKDIDKKDCNLEEIQSAYERWCSENGEIVRTS
VRKYFNLIETQSSSSENTSTKKEVCILDEITKSFSQIDFENEKDLQQEKEAATPIKIYLDEVQNLYHHLKLV
DYRGEEQKDSNFYSKFDEIIEKLSEIISIYNKVRNFVTKKPGEVKKVKLNFDCPTLANGWDENKEKDND
AILLLKDGNYYLGIYNPKNKPKFDFEESKASDCYKKVVYKLLPGPNKMLPKVFFSAKGQKEFLPPKELLL
GYEEGKHKKGENFDKEFMYKLIDWFKDAINRHEDWKKFDFKFSDTRSYEDMSAFYKEVELQGYKISF
KKVSTEIINEFVNSSKLFLFQIYNKDFAVKATGKKNLHTLYWENLFSEENLKDICFKLNGEAELFWRKAS
LIKEKVTVHKKNSILINRTKKDGSTIPENLYQEIYQYKNNMISDISENAKDLLNSGKVICKKATHDITKDK
HFTEDAYLFHCPITMNFKAPEITGRKFNDKVLEALKENPEILRIGLDRGERHLIYLSLINQKGEIELQKTLN
LVDQIRNDKTVQINYQEKLVQNEGDRDKARKNWQTIGNIKELKEGYLSAIIHEIATLMIENNAIVVME
DLNFGFKHGRFAVERQVYQKFENMLIEKLNYLVFKDRSIKEPGGVLNAYQLTDKAANVSDVYKQCG
WLFYIPAGYTSKIDPKTGFANLFVTKGLTNVEKKKDFFSKFDSIYYDEKEACFVFAFDYSKFGDNADFKK
KWEVYTKGERLVYSKQERKSITVSPTEELKKIFNEFSINWNNSESVLDQIKTIPAEKLNAKFFDTLLRAF
NATLQMRNSVPNSSRQEDDYLISPVKARDGTFYDSRIEAEKGIDKNGRWVSKLPVDADANGAYHIAL
KGLYLLENNFNRNEKGVIQNISNVEWFKFAQTK |
| 334 ID405 | MARIIDEFCGQMNGYSRSITLRNRLVPIGKTEENLKQFLEKDLERATAYPDIKNLIDAIHRNVIEDTLSK
VALNWNEIFNILATYQNEKDKKKKAAIKKDLEKLQSGARKKIVEAFKKNPDFEKLFKEGLFKELLPELIKS
APVDEIAVKTKALECFNRFSTYFTGFHDNRKNMYSEEAKSTAISYRIVNENPPKFFANIKLFNYLKEHFP
RIIIDTEESLKDYLKGKKLDSVFSIDGFNSVLAQSGIDFYNTVIGGISGEAGTKKTQGLNEKINLARQQLS
KEEKNKLRGKMVVLFKQILSDRETSSFIPVGFANKEEVYSTVKEFNNSIAEKAVSKVRDLFLHREEFTLN
EIFVPAKSLTDFSQAIFGSWSILSEGLFLLEKDSMKKALSESQEEKINKEIAKKDCSFTELQLAYERYCTEH
NLPVEKFCKDYFDIVDYRGNGAKSEKTKVSILSEILETFPLQLDFDHIQDLQQEKNAAIPIKAYLDEVQNL
YHHLKLVDYRGEEQKDSTFYSKHDEILTDLSQIVPLYNKVRNFVTKKLGESKKIKLNFDCPTLANGWDE
NQESSNDAIILRKDGKYYLGIYNPNNKPKFAKKDSIVGDCYEKMAYKQIALPMGLGAFVRKCFGTAQK
YGWGCPENCLNSEGKIIIKDEEAKGNLEAIIDCYKDFLNKYEKDGFKYKINDQFNSFLDSASYEKLSDFFND
VKPQGYKLSFTSIPLSEIDKMIDEGKLFLFQIYNKDFAKKATGKKNLHTLYWENLFSVENLQDVVLKLN
GEAELFWREASIKKDKVIVHKKGSILVNRTTTDGKSIPEAIYQEIYQLNKMADSISDEAKRLLESGTVV
CKVATHDIVKDKHFTENTYLFHCPITMNFKAKDRTNKEFNNHVLEVLNKNPDIKVIGLDRGERHLLYLS
LINQKGEIECQKTLNLVEQVRNDKTVSVNYHEKLVHKEGSRDAARKNWQTIGNIKELKEGYLSAVVH
EIASLMVKHNAIVVMEDLNFGFKRGRFAVERQIYQKFENMLIEKLNYLVFKDRKVTEPGGVLNAYQL
ANKSAKVTDVYKQCGWLFYIPAAYTSKIDPRTGFANLFITKGLTNVEKKKEFFGKFDSIRYDATESCFVF
SFDYAKICDNADYKKKWDVYTRGTRLVYNKTERKNVSVNPTEELQCVFDEFGIKWNTGEDLIESISLIP
AEKSNAKFFDVLLRMFNATLQMRNSVPNTDTDYLVSPVKAEDGSFFDSREEFKKGGDARLPIDCDAN
GAYHIALKGLYLLLNDFNRDNKGVIQNISNKDWFKFVQEKVYKD |
| 335 ID406 | MATIENFCGQENGYSRSITLRNKLIPIGKTANNLKQFLEKDQERADVYPEIKKLIDEIHRGFIEDTLSKFS
FVWEPLFDDFELYQNEKDKSKKATKKKDLEKFQSGARKKIVEAFKKHPDYDKLFKDGLFKELLPALIKN
SSDSEISNKEEALKVFDRFSTYFVGFHENRKNMYSEEDKSTAISYRIVNENFPKFYANVKLYNYIKENFP |

TABLE S10A-continued

Enzyme Sequences Group 10 (SEQ ID Nos: 331-336)

| SEQ ID NO | Sequence |
|---|---|
|  | KIISETEESLKNHLNGKRLDEIFNAESFNDVLAQSGIDFYNTVIGGISTETEKVQGLNEKINLARQKLPAE<br>EKNKLRGKMVVLFKQILSDRGTSSFIPVGFNNKEEVYSSVKSFNDEFVNISVCETKELFKQVAEFNLSEI<br>YVPAKSLTNFSQNIFGSWSILTEGLFLLEKDKVKKALSENKEEKINKEIAKKDYSLDELQVAYERYCNEH<br>NFSVEKNCKDYFDVVDYRSENEKSDKKKISILSAITESYSKIDFENIHDLQQEKEAATPIKTYLDEVQNLY<br>HHLKLVDYRGEEQKDSNFYSKLDEIITQLSEIIPLYNKVRNFVTKKPGEMKKIKLNFDCPTLANGWDEN<br>KESSNDAIILRKDGKYYLGIFNPNNKPKFSKIENISESYYEKMVYKLLPGPNKMLPKVFFSTKGQETFLPP<br>KDLLLGYDAGKHKKGDAFDKEFMYKLIDWFKDAINRHEDWKKFNFVFSPTKSYEDMSGFYREVELQ<br>GYKVSFQKISDTEINSFVSNGKLFLFQIYNKDFALKASGKKNLHTLYWENLFSEENLKDVCLKLNGEAEL<br>FWRKPSLNKEKVTVHEKGSILVNRTTNDGKSIPEDIYQEIYQFKNKMKDKISDNISIQNDDGKVITITVT<br>LENKQKEKFTENYKVVYKTATHYITKDNRFTEDTYLFHCPITMNFKAPDKSNKEFNNHVLEVLSGNPN<br>VKIIGLDRGERHLIYLSLINQKGEIELQKTLNLVEQVRNDKTVKVNYQEKLVHKEDDRDKARKSWQTIG<br>NIKELKEGYLSNVVHEIAKMMVEHNAIVVMEDLNFGFKRGRFAVERQIYQKFENMLIEKLNYLVFKD<br>KKVTEPGGVLNAYQLTNKSANVSDVYRQCGWLFYIPAAYTSKIDPKTGFANLFITKGLTNVEKKKEFF<br>DKLDSIRYDSKEDCFVFGPDYGKICDNADFKKKWEVYTKGERLVYNKTERKNININPTEELKSIFDDFGI<br>NWNNEENFIDSVHTIQAEKSNAKFFDTLLRMFNATLQMRNSIPNTEIDYLISPVKSEDGTFFDSREELK<br>KGENAKLPIDADANGAYHIALKGLYLLENDFNRNDKGVIQNISNADWFKFVQEKEYRD |
| 336 | MTTINKFCGQGNGYSRAITLRNKLIPIEKTADNLKQFLEKDQERADSYPEIKKLIDEVHRGFIEDTLTKFS<br>FVWEPLFDDFELYQNEKDKSKKAAKKKDLEKFQSGARKKIVEAFKKHPDYDKLFKDGLFKELLPALIKN<br>SSDSEISNKEEALKVFDRFSTYFVGFHENRKNMYSEEEKFTAISYRIVNENFPKFYANVKLYNYLKENFP<br>QIISETEESLKNHLNEKKLDEIFNVESFNDVLAQSGIDFYNTVIGGISTETEKVQGLNEKINLARQKLPAE<br>EKNKLRGKMVVLFKQILSDRGTSSFILVDFNNKEEVYSSVKSFNDEFVNLSVCETKELFKQVAEFNLSEI<br>YVPAKSLTNFSQNIFGSWSILTEGLFLLEKDKMKKALSENQEEKINKEIAKKDYSLDELQVAYERYCNEH<br>NFSVEKNCKDYFDVVDYRSENEKSDKKKVSILSAITESYSKIDFENIHDLQQEKEAATPIKTYLDEVQNL<br>YHHLKLVDYRGEEQKDSNFYSKLDEIITQLSEIIPLYNKVRNFVTKKPGEMKKIKMMFDCSSLLGGWG<br>TDYGTKEAHIFIDSGKYYLGIINEKLSKDDVELLKKSSERMVTKVIYDFQKPDNKNTPRLFIRSKGTNYAP<br>AVSQYNLPIESIIDIYDRGLFKTEYRKINPEVYKESLIKMIDYFKLGFERHESYKHYPFCWKESSKYNDIGE<br>FYKDVINSCYQLHFEKVNYDNLLKLVENNKIFLFQIYNKDFAEKKSGKKNLHTLYWENLFSEENLKDVC<br>LKLNGEAELFWRKPSLNKEKVTVHKKGSILVNRTTNDGKSIPEDIYQEIYQFKNKMIDNLSENAKSLLD<br>SGVVVCKEATHNITKDNRFTEDTYLFHCPITMNFKAPDKSNKEFNNQVLEVLSDNPDVKIIGLDRGER<br>HLIYLSLINQKGEIELQKTLNLVDQVRNDKTVKVNYQEKLVHKEGDRDKARKNWQTIGNIKELKEGYL<br>SNVVHEIAKMMVEHNAIVVMEDLNFGFKRGRFAVERQIYQKFENMLIEKLNYLVFKDKKVTEPGGV<br>LNAYQLTNKSANVSDVYRQCGWLFYIPAAYTSKIDPKTGFANLFITKGLTNVEKKKEFFDKFDSIRYDS<br>KEDCFVFGPDYGKICDNADFKKKWEVYTKGERLVYNKTERKNISINPTEELKSIFDDFGINWNNEDNFI<br>DSVHTIQAEKSNAKFFDTLLRMFNATLQMRNSIPNTEIDYLISPVKSEDGTFFDSREELKKGENAKLPID<br>ADANGAYHIALKGLYLLENDFNRNDKGVIQNISNADWFKFVQGKEYEK |

TABLE S10B

Human Codon Optimized Nucleotide Sequences Group 10

| SEQ ID NO | Corresponding AA | Sequence |
|---|---|---|
| 338 | 332 | ATGGTGATTAGCTACACATTTGGGGGCAAGAAAATGAAGGCTGTGGAGAAATTTTGCGGCCA<br>GAAAAATGGATACAGTCGGTCGATTACTCTGCGTAATAGGCTGTGATCCCTATTGGGAAAACCGA<br>AGAGAACATTCAAAAACTCAAGCTCCTCGATAAAGATATGGAGCGCGCTAAGGCTTATGACG<br>AAGTCAAGAAACTCATAGATGAGTTCCACAGGACATTTATTGAAGAAGTCCTTTCAAAGGCTT<br>CCTTTGAGTGGGCACCACTTTACGACCAGTTTGATCTGTTTCAAACCGAGAAGGATAAGCTGA<br>AGAAGAACAAGATCAAGAAAGAGCTGGAAGTGCTCCAAGGGGTGATGAGGAAGAAAATCGT<br>AGAGTCTTTCAAGAAGGATAAAAGGTTCGAAAAACTGTTCAAGAAGGAGTTGCTGACAGAGT<br>TCGTTCCTGCAGTCATTAAGAATGACGAATCGGTACAATTACGATAAGCAGGCCGCACTAA<br>ATGTCTTCAAAGGGTTTGCGACCTATTTTACAGGGTTTCACCAGAATCGGCAGAACATGTATA<br>GCGAAGAGGCCCAGTCTACCGCGATCTCTAATCGGATTGTAATGAGAACTTCCCTAAGTTTT<br>ACGCCAACGTGAAGGTCTTCGAGTACCTTAAAAATAACTACCCAGAGATCATAAACGAGACAG<br>AAAAGGCACTTGAGGAGTTCCTAAATGAAAAGAAACTGGCTGATATCTTCAGTCCCGAGAACT<br>TTAACGCCGTGATGTCCCAGTCAGGCATAGACTTCTATAACACCGTGATTGGGGGTATTGCGG<br>ATGAAGCTGGCACCAAGAAGCTCCAAGGTTTGAACGAAAAAATTAATCTGGCCTCCCAGCAGT<br>TACCGAGCGAGGAGAAGTACAAGCTAAAGAAGAAATGACGATTCTGTACAAACAGATTCTT<br>TCCGACCGAAATACAGCTTCATTCATACCCGTAGGTTTCGAAAAAAGTGAAGAAGTATATGAG<br>AGCGTCAAACATTTCAAAGAGGAGATTCTGGACAAGGTGATTACCAACACCAAGAAATTGTTC<br>GACTCAGTGGATTATGATCTGGGCCAAATCTATGTTCCTGCAAAGGAAGTAACCGAGTTTTCC<br>CTTAAGCTGTTTGGAAACTGGTCTATCATACATAATGGGATGTTTCTGTTGGAGCAGGATATG<br>GCCAAAAAGTATTGTCAGAAAACAGATCGAGGCACTCAAAAGGAAATTGCCAAACGCGA<br>CCTTAGCTTATCAGATTTGCAGAATGCTTACGAAAGGTGGACTAAGGAAAACGATGTTAAAGC<br>TGAAAAGAACGTGCGGAATTATTTTAAGCTGACTGAGCTGCGCGTGGACGAGAAAACAAAGG<br>AAAAAGATAGCATCGAGATCTTGAAGAATCTGGAAGTACTTTACAGTAAGATCGATTTTGAGA<br>AGCAGGAGAATCTAATACAGGAGAAGACTTCAGCCACTCCTATTAAGACTATCTGGACGAG<br>ATCCAGAACTTATACCACTATCTGAAGTTAGTTGACTATAGGGAGAAGAGCAGAAAGACAC<br>AGACTTCTATAGCAAGTACGACGAAATAATCCAAACACTGAGTGAGATTATCCCGCTCTATAA<br>TAAGGTGAGAAACTTCGTGACAAAGAAGCCCAACGAAATCAAAAAGGTTAAGCTGAACTTCG |

TABLE S10B-continued

Human Codon Optimized Nucleotide Sequences Group 10

| SEQ ID NO | Corresponding AA | Sequence |
|---|---|---|
| | | ACTGCCCAACTCTTGCCAATGGATGGGATCTCAACAAAGAGTCATCTAACGACGCCATTATCTT GCGCAAGAATGGTAACTACTACCTGGGCATTTTCAATCCAAAGGACAAACCAAAGTTTGAGTA CAATAATGAAGACTCTGGATATGAGAAGATGATCTACAAGCTGCTGCCCGGCCCCAATAAGAT GCTGCCAAAGGTGTTTTTTAGCGCGAAAGGGCTGGAGACGTTTCGGCCCCCCAAGGATCTGG TCCTAGGCTACGAGGAAGGAAAACATAAAAAGGGTGACAATTTCGACAAGGTCTTTATGCAT AAACTGATAGACTGGTTTAAGTACGCAATAAATCAGCACGAGGACTGGAAAAACTTTAACTTC AAATTCAGCCCTACTGAGTTCTACGAGGATATGTCGGGCTTTTACAAAGAAGTGGAGTTGCAG GGCTACAAAATCACGTTCAACAAGGTGAGTGATAATTGCATCAATTCCCTCGTCGACAGTGGA AAACTGTTTCTGTTTCAGATCTACAACAAGGATTATTCCACGGGGGAAGAAGGCGGCAACGG ATCCACTGGCAAGAAGAATCTGCATACCCTTTACTGGGAAAATCTCTTTTCCGAAGAAAATTTG CGAGATGTGTGCTTTAAACTGAATGGTGAGGCCGAATTCTTTTGGAGAGACGCTAATCCTAAT GTCAAAGCGGTGTGTCACAAAAAAGACTCTGTGCTCGTCAACAGGACCACCTCCGACGGGAA GTCTATTCCAGAGGAAATTTACCAGGAGATCTACAAGTACAAGAACCCAGAGAAGCAAGAGA AGGAGTTCACCCTTTCCAAAGATGCTAAAGAGCTCCTGGAGTCTGGGACAGTGGTGTGTAAG AAAGCTAAATTCACCATTACGAAAGATCGGCATTTTACCCAGCAAACCTATTTATTCCATTGCC CTATCACAATGAACTTCAAGGCCCCCGAGATCACTGGACGCAAATTTAATGAGCACGTCCAGG AGATCCTCCGCAATAATCCAGAAGTAAAGGTGATTGGACTAGACAGAGGCGAAAGACATCTG ATCTATTTGTCGCTCATCAATCAGAAAGGGGAAATCGAGCTTCAAAAGACCCTCAATCTGGTG GAGCAGGTGCGAAACGATAAGACTGTGAGTGTTAACTACCAGGAGAAGCTGGTGCACAAAG AAGTGGAGCGAGATAAAGCCCGGAAGTCCTGGCAGTCAATCTCGAACATCAAGGAACTTAAA GAGGGGTACTTGAGCAATATTGTGCACGAGATCGCCAAGTTGATGGTGGAAAACAATGCAAT TGTTGTAATGGAAGATCTCAACTTCGGTTTTAAGCGTGGCCGATTTCCCGTCGAAAGGCAGGT TTACCAAAAATTCGAGAACATGCTAATAGAAAAAGCTAAACTACTTGGTATTCAAGGACAAAAA CGTGACGGAACCGGGTGGCGTTTTAAACGCCTATCAGCTCGCTGACAAAGCCGTTAACGTCA GCGACGTGGGAAAGCAATGTGGCTGGATTTTTTATATACCTGCCAGCTATACTAGTAAGATCG ATCCAAAGACTGGATTCGCAAATCTGTTCTATACCGCGGGGCTGACTAATATCGAAAAGAAGA AGGATTTCTTCGACAAATTTGACAGTATCAGGTACGACAGAAAATTAGATAGCTTTGTTTTCG GATTCGATTACTCTAACTTATCCGACAACGCCGACTACAATAAGAAATGGGAGCTCTACAGTC GGGGAGAGCGCCTTGTCTATTCCAAAGCTGAGAAAAGCACAATCTCCGTTAACCCGACCGAG AATCTGAAGGTGCTGTTCGATAAACAGGGCATTGTGTGGGACTCTAAGGACAACTTTATCGAT CAGATTCACGCAGTTCAGGCTGAGAGAGATAACGTCCCCTTCTGATGACGGACTTTATAGGTCC TTCACTGCCATACTGCAAATGAGAAACTCTGTCCCTAACTCATCTAAACAGGAAGACGATTACC TCATCTCACCCGTGATGGCCGATGACGGGAATTTTATGATAGCCGTCTGGAGGCCGCAAAGG GCAAAGACGAGAAGGGCAACTGGATAAGCAAGCTGCCCGTTGACGCTGACGCCAACGGTGC ATACCACATCGCCTTAAAGGGCCTCTATTTGCTCAAGAATGATTTCAACCTGAACGAAAAAGG GTATATCGAAAACATAAGCAATGCAGATTGGTTCAAATTCGTCCAAAACAAAGAGTATCAGGA CTGTTGA |

TABLE S10C

Direct Repeat Group 10

| SEQ ID NO | Direct Repeat (Variant #1) | SEQ ID NO | Direct Repeat (Variant #2) |
|---|---|---|---|
| 343 | ATCTACAACAGTAGAAATTTAGTATGAAGTTCAAAC | 344 | CTACAACAGTAGAAATTTAGTATGAAGTTCAAAC |
| 345 | ATCTACAACAGTAGAAATTCTATATTAGTTTGAAAC | 346 | TCTACAACAGTAGAAATTCTATATTAGTTTGAAAC |
| 347 | GTTTCAAACTAATTAAGAATTTCTACTGTTGTAGAT | 348 | TTTCAAACTAATTAAGAATTTCTACTGTTGTAGAT |
| 349 | GTTTCAGTCTGATATTGAATTTCTACTGTTGTAGAT | 350 | TTTCAGTCTGATATTGAATTTCTACTGTTGTAGAT |
| 351 | GTTTGAACTTCTTATTAAATTTCTACTGTTGTAGAT | 352 | TTTGAACTTCTTATTAAATTTCTACTGTTGTAGAT |
| 353 | GTTTAAACGAACTATTAAATTTCTACTGTTGTAGAT | 354 | TTTAAACGAACTATTAAATTTCTACTGTTGTAGAT |

TABLE S10D crRNA Sequences Group 10

Figure 10A:
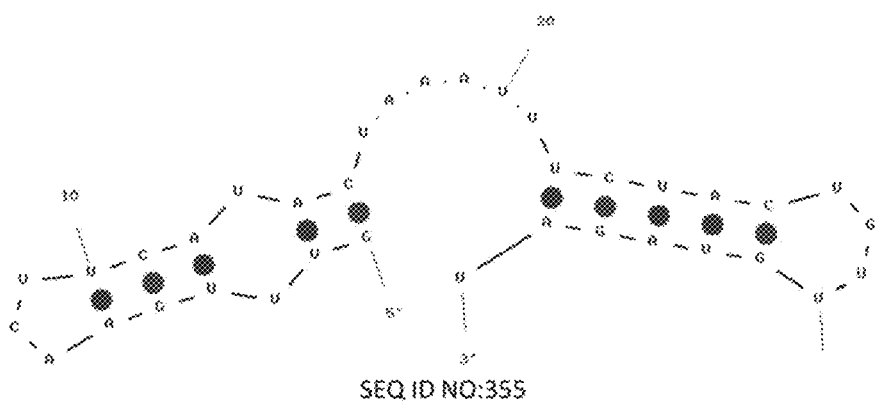
FIG. 10A-10F (SEQ ID NOs:355-360) are schemes depicting the predicted stem loop structures of crRNA sequences of the present disclosure corresponding to Group 10 sequences.
Figure 10B:
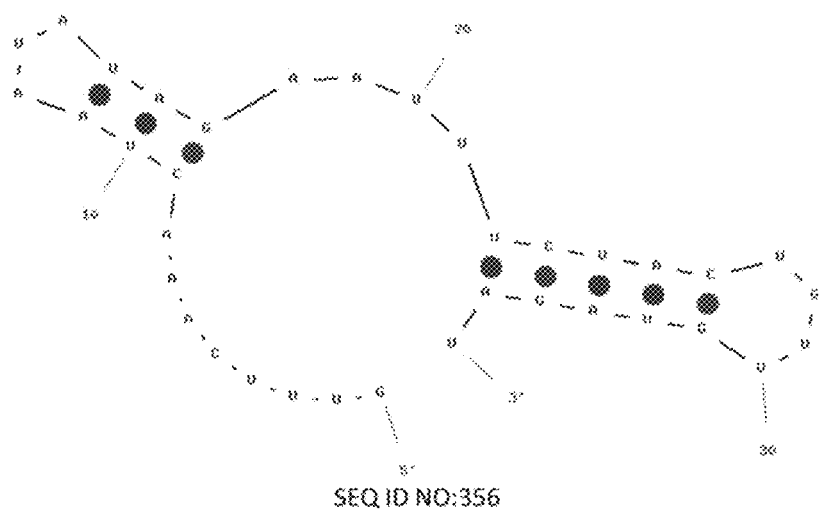
Figure 10C:
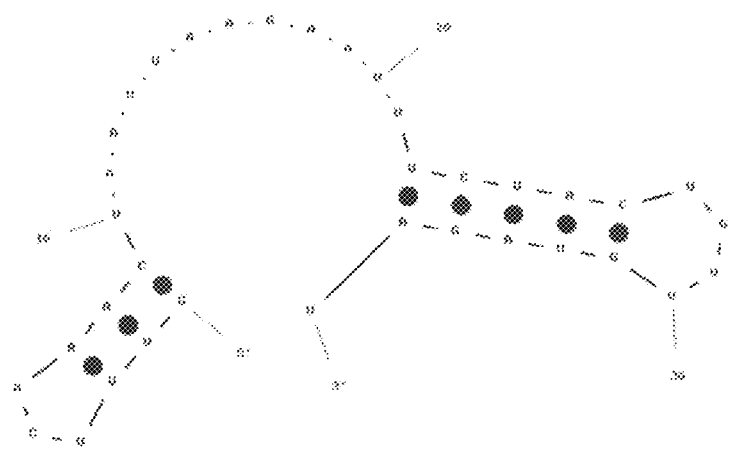
Figure 10D:
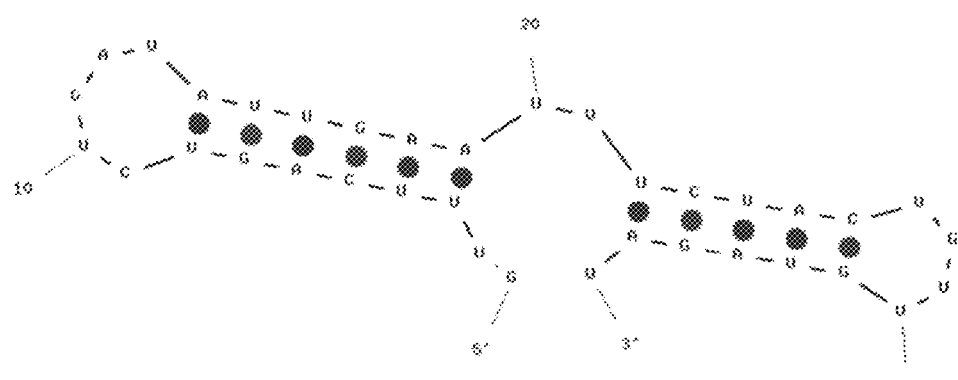
Figure 10E:
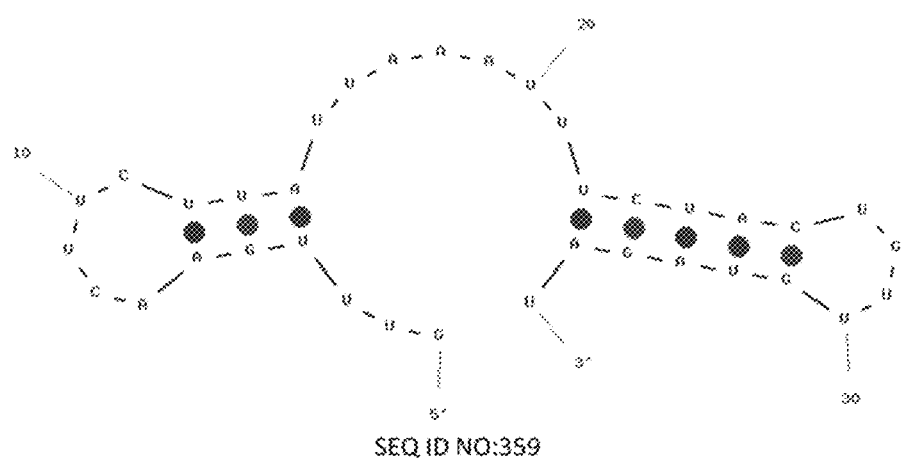
Figure 10F:
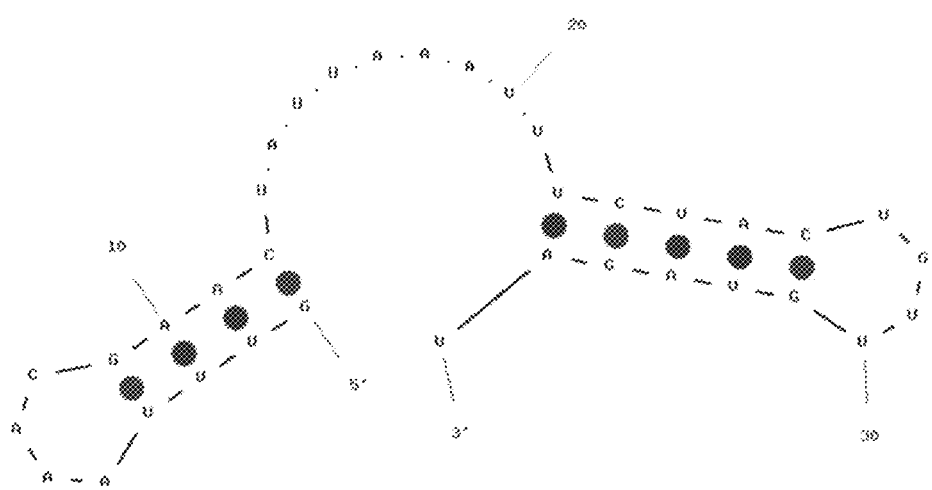

| SEQ ID NO | Sequence | FIG. |
|---|---|---|
| 355 | GUUUGAACUUCAUACUAAAUUUCUACUGUUGUAGAU | FIG. 10A |
| 356 | GUUUCAAACUAAUAUAGAAUUUCUACUGUUGUAGAU | FIG. 10B |
| 357 | GUUUCAAACUAAUUAAGAAUUUCUACUGUUGUAGAU | FIG. 10C |
| 358 | GUUUCAGUCUGAUAUUGAAUUUCUACUGUUGUAGAU | FIG. 10D |
| 359 | GUUUGAACUUCUUAUUAAAUUUCUACUGUUGUAGAU | FIG. 10E |
| 360 | GUUUAAACGAACUAUUAAAUUUCUACUGUUGUAGAU | FIG. 10F |

TABLE S10E

Consensus Sequence Group 10

| SEQ ID NO | Consensus Sequence |
|---|---|
| 361 | XXXXXXFXXKXMKTIEXFCGQKNGYSRSITLRNXLIPIGKTEENJKZZQFLEKDQERAXAYPEIKKLIDEIHRGFIEXTLS KXSFXWEPLFDXFELYQNEKDKSKKAAXKKXLEKLQSGARKKIVEAFKKXPDFXKLFKXXLFKELLPALIKNXXXXEIS DKEXALKVFXRFSTYFTGFHENRKNMYSEEAKSTAISYRIVNENFPKFYANVKLFXYLKENFPEIISETEESLKXHLNG KKLDDIFSXEXFNXVLXQSGIDFYNTVIGGIXGEAGTXKXQGLNEKINLARQQLPXEEKNKLRGKMVVLFKQILSDR XTXSFIPVGFENKEEVYSSVKXFNXEIVBKSVXETKELFXQVXXFBLSEIYVPAKSLTBFSXXIFGXWSILXEGLFLLEKD KMKKALSEKQEEKJNKEIAKKDCSLDELQXAYERXCXEXNXXVEKNXKDYFDXVXYRZZSXXXKSEKKKVSILSXITES XSKIDFENIHDLQQEKEAATPIKTYLDEVQNLYHHLKLVDYRGEEQKDSNFYSKXDEIITXLSEIIPLYNKVRNFVTKK PGEXKKXKLNFDCPTLANGWDENKESSNDAIILRKDGKYYLGIXNPKZNKPKFXKEXXZZZZZISXDCYEKMVYKLLP ZZZGPNKMLPKVZZZZZZZZZZFFSAKGQEXFZZZZZZZZLPPKDLJZZZZZZZZZZZZZZZLGYDEGKHKKZZZZZGDXFDK EFMXKLIDWFKDAINRHEZZZZDKKZZZXNFZXFSDTSSYEDMSGFYKEVELQGYKISFXKVSDEEINSLVDSGKLF LFQIYNKDFATZZZZZZZKATGKKNLHTLYWENLFSEENLKDVCLKLNGEAELFWRKASLNKEKVTVHKKGSILVNRT TXDGKSIPEXIYQEIYQFKNKMKDEZZZZZJSDNAKELLDSGZZZZZZZZZZZZZZZZZZKVVCKXATHDITKDXHFT EDTYLFHCPITMNFKAPXITXXXFNNHVLEVLXNNPDVKXIGLDRGERHLIYLSLINQKGEIELQKTLNLVEQVRNDK TVSVNYQEKLVHKEGDRDKARKNWQTIGNIKELKEGYLSNXVHEIAKLMVEXNAIVVMEDLNFGFKRGRFAVER QXYQKFENMLIEKLNYLVFKDKKVTEPGGVLNAYQLTBKSANVSDVYKQCGWLFYIPAAYTSKIDPKTGFANLFITK GLTNVEKKKXFFDKFDSIRYDXKEDCFVFGFDYSKICDNADFKKKWEVYTXGERLVYXKTERKNISVNPTEELKSIFD XFGINWNNEXNFIDXIHTIQAEKSNAKFFDTLLRMFNATLQMRNSVPNXXZZEDDYLISPVKAEDGTFXDSREEAK KGXDZZXZXZXKLPXDADANGAYHIALKGLYLLENDFNRNEKGVIQNISNADWFKFVQEKEYXDC |

Wherein:
  each X is independently selected from any naturally occurring amino acid; and
  each Z is independently selected from absent and any naturally occurring amino acid.

TABLE S10F

Native Nucleotide Sequences Group 10

| SEQ ID NO | Corresponding AA | Sequence |
|---|---|---|
| 362 | 331 | TTGTTGTTTATAATTGAGTTTGAGGAGAAAATTATGAAAACAATTGAAAATTTTTGTGGCCAAA AAAATGGTTATTCTCGCTCTATTACCTTGCGAAACAGGTTGATTCCAATCGGAAAAACAGAAGA AAATATTGAAAACTACAACTTCTTGATAATGACATTAAGCGTTCAAAGGCTTATGTTGAAGTC AAGTCGATGATAGATGATTTTCACCGCGCATTCATAGAAGAAGTTCTTTCTAAGGCAAAACTTG AATGGGGGCCATTATATGACCTGTTTGATTTGTTCCAGAATGAAAAAGACAAGCATAAGAAAA GTAAAATAAAAAAAGAGTTAGAAACCATTCAAGGTGTGATGCGAAAACAGATTGTAAAAAAGT TTAAGGATGATGATAGGTTTGACAAGCTTTTCAAGAAAGAAATTTTAACTGAATTTGTTCCAACT GTAATAAAGGCTGATGAATCAGGAACTATATCCGACAAGCGGGCAGCTCTTGATGTGTTTAAG GGATTTGCGACATATTTTACAGGTTTTCACCAAAACAGACAAAATATGTATAGCGAAGAGGCTA AGGCTACCGCTATCAGCAATAGAATAGTTAATGAAAATTTTCCAAAGTTCTATGCAAATGTAAA GGTTTTTGAATGCTTGCAGAAAGAGTATCCTGCAATTATCACTGAAACGGAAGAGGCTCTTTCT GAAATCCTTAATGGCAAAAAACTGGCTGATATTTTTAGCGCGGACGGATTTAATTCAGTTTTGA GCCAGAGCGGCATTGATTTTATAATACGATAATTGGCGGCATTGCAGGAGAGGCAGGAACTC AAAAGTTGCAAGGCATAAACGAAAAAATAAATCTTGCCCGCCAGCAGCTTCCTACAGAAGAAA AAAACAAGCTCAAGCGGAAGATGAGTGTATTATACAAGCAGATTIAAGCGACAGAAGTACGG CTTCTTTTATTCCGATTGGATTTGAATCAAGCGATGAAGTTTACGAATCTGTAAAACAGTTTAAG GAACAGTCATTAGATAATGTCATTTCCGCTGCAAAAGAATTGTTTGAAAAATCTGATTATGATTT GAGTCAGATTTATGTTCCTGCAAAAGAAGTCACCGACTTTTCATTGAAGCTTTTGGCAATTGGT CGATTTGCATGACGGGCTTTTCTTAATTGAGAAGATAATTCAAAGAAGACTTTCACGGAAAA GCAGATTGAAACCTAAGAAAAGAAATCGCAAAAACAGATTGTTCTCTTGCGGATTTGCAGAA CGCCTATGAGCGATGGGCAAAAGAAAATGATGTTAAAGCTGAAAAGACTGTAAAGAACTATTT CAAAATTGCAGAGCTTCGCGCTGATGGAAAATCAAGAGAAAAAACTTCTGTGGAGATTCTGAA |

TABLE S10F-continued

Native Nucleotide Sequences Group 10

| SEQ ID NO | Corresponding AA | Sequence |
|---|---|---|
| | | TAAAATTGAATCGACCTTTGAGAAAATTGATTTTGAAAAGCGAGATAATCTTATAAAGGAAAAG GAGACGGCAACTCCGATAAAAGAATTCCTCGACGAAGTTCAGAACCTTTATCATTATCTGAAAT TGGTTGACTATCGTGGTGAAGAACAGAAGGACACCGATTTTTATTCAAAATATGATGAAATACT GCAGACGCTTTCTGAAATTGTTCCGCTTTATAATAAGGTGAGAAATTTTGTCACAAAAAAGCCT AATGAGGTGAAGAAAGTAAAGCTGAATTTTGATAATGTTTCATTAGCAAAAGGTTGGGATGTA AACAAAGAATCTGATTATACATGTATTTTACTCCGCAGAAGTGGACTGTATTATTTAGGAGTACT AAATCCAAAAGATAAGCCAAAGTTTGACTCTGAGAACAATGGTGAAACAAGTATAAATAAGAA TGATTGTTACGAAAAGCTTGTTTATAAGTATTTTAAGGATGTAACAACCATGATTCCAAATGTT CGACACAGTTAAATGATGTTAAACAGCATTTTAAAAACTCTAATGAAGATTATATTTTGGAAAA CAATAATTTTATTAAGCCACTTGTAATTTCAAAGAGAATTTTTGATCTGAATAATAAAACTTTTG ATGAAAAGAAAATGTTTCAAATTGACTATTATAGGAATACTGGCGATTTAAAAGGTTATACAGA AGCTGTAAAAGATTGGATTTCATTTTGTATGACCTTTGTTCATTCCTATAAAAGTACCTGTATAT ATGATTTTTCTTCCTTAGGCGATTGCAGCCAATTTAAGCAGGTTGATCAGTTTTACAAAGAGATT AATCTTTTACTTTATAAAATTTGGTTTGTGAATGTAACTGCTGAAAAATCAATTCCCTTGTAGAT TCCGGTAAACTTTTCCTTTTCCAAATCTACAACAAAGACTATTCAACTGGTAAAGACGGCGGAA ACGGTTCAACAGGCAAAAGAATCTTCATACGATGTATTGGGAAAATTTGTTCAGCGAAGAAA ATCTTCGGGATGTCTGCCTTAAATTGAATGGAGATGCAGAACTTTTCTGGCGGGATGCAAATCC TGATGTGAAAGATGTATGCCATAAAAAGGTTCAGTTCTTGTAAACAGAACGACCTCTGACGGT GAGACAATCCCAGAAGAAATATATCAAGAAATTTACAAGTTCAAAAATCCTAATAAACAGGAA AAAAGCTTTAAACTTTCTGATACCGCAAAAGAACTTCTGGATAGTGGAAAAGTCGGTTTCAAAG AGGCCAAATTTGACATTATCAAAGACCGTCATTTTACACAGAAAACATATCTGTTCCATTGTCCG ATTACCATGAATTTTAAGGCTCCTGAAATTACAGGAAGAAAATTCAATGAAAAAGTCCAGCAGG TGTTGAAAAATAATCCTGATGTAAAGGTTATTGGTCTTGACCGTGGCGAGCGTCATTTGATTTA TCTTTCGCTTATCAATCAAAAGGGCGAAATCGAGCTTCAGAAAACGCTCAACCTTGTGGAACAG GTTCGCAATGATAAAACTGTTTCTGTAAATTATCAGGAGAAACTAGTCCAGAAGGAGGGAGAG CGTGGCAAGGCTCGCAAGAACTGGCAAACAATCAGCAATATCAAAGAATTAAAAGAAGGATAT CTTTCAAACATTGTTCACGAGATTGCAAAATTAATGGTAGAAAATAATGCAATTGTCGTAATGG AAGATTTGAATTTTGGATTTAAACGAGGACGATTTGCGGTTGAGCGTCAAGTTTACCAGAAGTT TGAAAACATGCTCATTGAAAAGCTTAATTATCTTGTGTTCAAGGATAAGAAAGTCGCTGAGCCT GGTGGCGTTTTGAATGCATATCAGCTAACTGACAAAGTTGCAAATGTAAGCGATGTTGGCAAA CAGTGCGGATGGATTTTCTATATTCCGGCTGCGTATACTTCAAAAATTGATCCAAAGACTGGTTT TGCAAATCTTTTTTATACTGCAGGGCTTACAAATATCGAAAAGAAAAAAGATTTCTTTGATAAGT TTGATTCTATTCGCTATGACAGAAAAACAGATTCGTTTGTGTTCACTTTTGATTACAGCGACTTT GGAGATAATGCGGACTTTAAGAAAAAATGGGAACTCTATTCTAGGGGAGAGCGACTTGTTTTC AGCAAGGCAGAGAAATCTGTTGTTCATGTAAATCCAACAGAAAACTTAAAGGCATTGTTCGAC AAGCAAGGGATAAACTGGAGTTCAGAAGATAATATTATAGACACAGATACAGGCAGTGCAGGC TGAAAGAGAAAATTGCGCTTTTTATGACGGCCTATACCGTTCGTTTACTGCAATTCTCCAGATGC GAAATTCCGTTCCTAATTCTTCAAAAGGGGAAGATGATTATCTGATTTCACCAGTCATGGCAGA AGATGGAAGTTTCTATGACAGCCGAGAGGAAGCTGAAAAAGGAAAAACGACTGACGGAAAAT GGATTTCAAAGCTTCCTGTTGATGCTGATGCCAACGGCGCGTACCATATTGCGCTAAAGGGACT TTATCTTTTGCAGAATAATTTCAATTTAAATGAAAATGGCTATATTGAAAACATTTCAAACGCCG ACTGGTTTAAGTTTGTTCAGGAGAAGGAATATGCAAAATAA |
| 364 | 333 | ATGAAAACTATTGATTCTTTTTGTGGACAAAACGAGGGTTATTCACGTTCAATAACATTACGAA ATAAAATTGATTCCAATTGGAGAAACTGAAAAAAATATTAAAGAGTTTTTAGAAAAAGATGTTGA ACGATCAGAAGCTTATCCTCAAATAAAGAAATTAATAGATGATATACATAGAGGATTTATAGAA GAGTGTCTTTCTAATGTTTCTTTTCCATGGGAACCATTATTTGATCAGTTTGAGTTATATCAAAT GAAAAAGAAAAGATAAAAAAAGAATGCGAAGAAAAAGAACTTATTGTTCTTCAAGTGGCAGC ACGAAAACGAATTGTAAAAGCATTTAAAGATAATAAGGATTTTGAAAAGCTTTTTAAGGAAGA ATTATTTAAGGAATTATTGCCTCAATTAATAAAAATCTGCTCCTGTTACAGAATTGCAGATAAAG AAAAAGCACTTTCTGTTTTTACAAGATTCAGTACATATTTTAATGGTTTTCATGAAAATAGGAAA AATATGTATAGTGAAGAGGAAATATCAACAGGAATTGCATATAGAATAGTAAACGAAAATTT CCAAAGTTTTTTTCGAACATAAAACTTTTTGAATATTTAAAAGACAACTTTCCAGAAATTTATAAA AGAAACAGAGATTTCATTAAAAGACACATTAAAAGGCAAAAGCTTTGTGATATTTTTAAAGTT GAAGCTTTTAATAATGTTTTATCTCAGAGTGGAATAGATTTTTATAATACGATAATTAGTGGTGT TGCTGGTGAAGGTGGCACACAGAAAATTAAGGGAATGAATGAAATAATCAATCTTGCAGAACA ACAACTTCCAAAGGAAGAAAAAGATAAGTTACATGGCAAGATGGTTGTATTATTCAAACAGATT TTGAGTGATAGAGAGACTGCATCATTTATACCGACTGGATTTGAAAAAAATGAAGAAGTATAT GCTTCTATAAAAGAGTTTAACAATATATTGTAAAAGATTCTGTTACAGAAACAAGGAATTTGTT TGCTCTAAATAGTGATATTAAGCTCAATGAAATAATTGTGCCAGCAAAATCTATTACAGCATTTT CTCTAACAATATTTGGAAATTGGGTAATTATTTCTGAAGGTTTGTACCTATTGGAAAAAGATAA AATAACTAAAGCTTTATCAGAAAAGCAAGAGGAACAGCTTCATAAAGACATTGATAAAAGGA CTGTAATCTTGAAGAAATTCAAAGTGCATACGAACGATGGTGAGCGAGAATGGGGAAATTGT TCGTACATCTGTAAGAAAATATTTTAATCTTATTGAGACACAATCAAGTTCATCTGAAAACACAT CAACCAAGAAAGAAGTGTGCATTCTTGACGAAATAACAAAGTCTTTTTCTCAAATAGATTTTGA AAATGAAAAAGATTTACAGCAGGAAAAAGAAGCGGCAACTCCAATAAAAATATATTTAGATGA AGTACAGAATCTTTATCATCATCTTAAGCTGTTGATTATCGTGGAAGAACAAAAAGATTCC AATTTCTATTCTAAATTTGATGAAATAATAGAAAGCTTTCAGAATTATTTCTATATATAATAA GGTTCGCAATTTTGTCACAAAGAAACCAGGAGAAGTAAAAAGGTAAAGCTTAATTTTGATTGT CCAACTCTTGCTAATGGCTGGGATGAAAATAAAGAGAAGGATAATGATGCGATTCTTCTTTTAA AAGATGGAAACTATTATTTAGGAATTTATAATCCAAAAAATAAACCAAAATTTGATTTTGAAGA AAGCAAAGCTTCTGATTGTTATAAAAAAGTTGTATATAAACTTTTACCAGGACCGAATAAAATG CTTCCAAAAGTATTTTTCTCAGCGAAAGGACAGAAAGAGTTTCTTCCACCAAAAGAATTGCTTTT AGGATACGAAGAAGGTAAGCATAAGAAAGGAGAGAATTTTGATAAGGAATTCATGTATAAACT |

TABLE S10F-continued

Native Nucleotide Sequences Group 10

| SEQ ID NO | Corresponding AA | Sequence |
|---|---|---|
| | | GATTGATTGGTTTAAGGATGCAATTAACAGACATGAAGACTGGAAAAAATTTGATTTTAAATTT TCAGATACAAGAAGTTATGAAGATATGAGCGCATTTTATAAAGAAGTCGAATTACAGGGATAT AAGATTTCTTTTAAAAAGGTATCTACAGAAATCATAAATGAATTTGTAAATAGCAGTAAACTTTT TCTTTTTCAAATTTATAATAAAGATTTTGCAGTAAAAGCCACTGGAAAAAAGAATCTTCATACTC TTTATTGGGAAAATTTATTTAGTGAAGAAAACCTTAAAGATATTTGCTTCAAACTTAATGGAGA AGCAGAACTTTTCTGGCGAAAGGCAAGTTTAATCAAAGAAAAAGTTACGGTTCATAAAAAGAA TTCAATTCTTATAAATCGAACAAAAAAAGATGGCTCAACAATTCCAGAAAATCTTTATCAGGAA ATCTATCAATATAAGAATAATATGATTAGTGATATTCTGAGAATGCGAAAGATTTACTAAATTC TGGAAAAGTAATTTGTAAAAAAGCAACACACGATATTACAAAAGATAAACATTTTACAGAAGAT GCATATCTTTTTCATTGTCCAATTACAATGAATTTTAAAGCTCCTGAGATTACAGGTAGAAAGTT TAATGATAAAGTGCTTGAAGCACTTAAAGAAAATCCTGAAATAAAGATTATTGGATTGGATCGT GGTGAAAGGCATTTGATTTATTTATCTCTAATTAATCAAAAAGGAGAAATTGAATTACAAAAAA CTCTGAATCTTGTAGACCAAATTAGAAATGATAAAACTGTACAAATTAATTATCAAGAAAAATT AGTTCAAAATGAGGGAGATCGAGATAAAGCTAGAAAGAATTGGCAGACTATAGGAAATATAA AAGAACTTAAAGAAGGCTATCTTTCAGCTATAATACATGAAATTGCTACATTGATGATAGAAAA CAATGCCATTGTTGTTATGGAAGATTTGAACTTTGGTTTTAAGCATGGAAGATTTGCTGTTGAA CGACAAGTATATCAAAAGTTTGAAAATATGCTTATTGAAAAATTGAACTATCTTGTATTTAAAGA TCGTTCTATAAAAGAACCGGGTGGAGTTCTTAATGCATATCAGCTCACAGATAAAGCTGCTAAT GTTTCTGATGTTTATAAACAATGTGGTTGGCTTTTCTATATTCCTGCAGGATATACTTCAAAAT AGATCCAAAACAGGTTTTGCTAATCTATTTGTAACTAAAGGATTAACAAATGTAGAAAAGAAG AAGGATTTCTTTTCAAAGTTTGATTCAATTTATTATGATGAAAAAGAAGCTTGTTTTGTTTTGCT TTTGATTATAGCAAATTTGGTGACAATGCAGACTTTAAGAAAAAATGGGAAGTTTATACGAAAG GTGAAAGACTTGTTTATAGTAAACAAGAAAGAAAGTCTATTACTGTAAGTCCAACTGAAGAACT TAAAAAAATATTTAATGAGTTTAGTATAAACTGGAATAATAGTGAAAGTGTTCTTGACCAAATA AAAACTATTCCTGCTGAAAAATTGAATGCTAAGTTTTTTGATACATTATTACGTGCATTTAATGC TACTTTGCAAATGCGTAATTCTGTACCAAATTCTTCACGACAGGAAGATGATTATTTAATATCTC CTGTAAAAGCAAGAGATGGAACTTTCTACGATAGTCGCATTGACGCTGAAGCTGAAAAGGGAATAGATA AAAATGGCAGGTGGGTTTCTAAATTACCAGTTGATGCCGATGCAAATGGAGCTTATCATATTGC ACTTAAAGGATTATATCTTTTGGAAAACAATTTTAATCGAAACGAAAAAGGAGTTATCCAAAAT ATTTCTAATGTAGAATGGTTCAAGTTTGCACAGACAAAATAA |
| 365 | 334 | ATGGCTAGAATAATTGATGAGTTTTGTGGACAGATGAATGGGTATTCTCGTTCAATTACTTTGA GGAATAGGTTAGTTCCTATTGGGAAAACTGAAGAAAATTTAAAGCAGTTTTTAGAAAAAGATTT GGAAAGAGCAACTGCTTATCCGGACATAAAAAATCTTATAGATGCTATTCATCGTAATGTAATT GAGGATACTTTATCCAAAGTTGCTTTGAATTGGAATGAAATATTCAATATACTTGCTACTTACCA AATGAAAAAGATAAAAAAACAGAAAGCAGCAATAAAAAAGGATTTAGAGAAATTACAAAGTG GTGCAAGAAAAAAAATAGTTGAGGCTTTTAAAAAGAATCCTGATTTTGAAAAATTGTTTAAGGA AGGATTGTTCAAAGAACTTTTACCCGAATTAATCAAATCTGCTCCCGTTGACGAAATAGCAGTC AAAACAAAAGCTTTGGAGTGTTTTAATAGATTTAGTACATATTTTACAGGCTTTCATGACAACAG AAAAAATATGTATAGTGAAGAGGCAAAGTCTACGGCAATAAGTTATCGTATCGTAAATGAAAA TTTCCCAAAATTTTTTGCAAATATAAAACTGTTCAATTATTTAAAAGAGCATTTTCCAAGAATAAT TATTGATACAGAGGAATCTTTAAAAGATTACCTCAAAGGTAAAAAACTTGACTCTGTGTTCAGT ATTGATGGTTTTAACAGTGTACTGGCTCAAAGTGGAATTGATTTTTATAACACAGTAATTGGTG GAATTTCTGGTGAAGCAGGAACAAAAAAAACTCAGGGATTGAATGAAAAAATCAATCTTGCAA GACAACAATTGTCGAAAGAAGAAAAAAATAAACTTCGTGGTAAAATGGTTGTCTTGTTTAAACA GATTTTAAGTGATAGAGAAACCTCTTCTTTTATTCCAGTTGGTTTTGCAAATAAAGAGGAGGTTT ATTCAACTGTTAAGGAATTTAATAACTCAATTGCTGAAAAGGCTGTTTCAAAAGTAAGAGACTT ATTCTTACACAGAAGAATTTACTCTTAATGAAATCTTCGTTCTGCAAAGTCATTGACAAGATT TTTCTCAAGCGATTTTGGGTCTTGGTCAATACTTTCTGAAGGTCTGTTCTTGCTGGAAAAAGAT AGCATGAAAAAGGCTTTATCTGAGAGTCAAGAAGAAAAAATCAATAAGGAAATTGCGAAAAA AGATTGTTCTTTTACGAATTGCAGTTGGCTTATGAAAGATATTGTACTGAACATAATCTACCTG TAGAGAAATTTTGCAAGGATTATTTTGACATTGTAGATTATCGTGGAAATGGTGCAAAATCAGA AAAGACAAAAGTTTCTATTCTTTCTGAAATTTTGGAGACATTTTTGCAACTTGATTTTGACCATAT TCAGGATTTACAACAAGAAAAATGCGGCAATTCCTATAAAAGCCTATTTAGATGAAGTACAG AATCTATATCACCATTTGAAATTGGTAGATTATCGTGGTGAGGAACAAAAGGATTCAACTTTTT ATTCTAAACATGATGAGATTTTGACTGATCTTTCGCAAATCGTTCCCCTTTATAATAAAGTTAGA AACTTTGTTACCAAGAAACTTGGAGAAAGTAAAAAGATAAAACTTAATTTTGATTGTCCAAATTT AGCAAATGGCTGGGATGAAAACCAAGAGTCTTCTAATGATGCCATTATCTTGAGAAAAGATGG GAAATATTATCTTGGAATTTATAATCCAAATAACAAGCCAAAATTTGCTAAGAAAGATAGCATT GTTGGTGATTGTTATGAAAAAATGGCTTATAAACAAATAGCACTTCCAATGGGATTAGGTGCAT TCGTAAGGAAATGTTTTGGTACCGCTCAAAAGTATGGCTGGGGTTGTCCAGAAATTGCTTAAA TTCTGAAGGAAAAATTATAATCAAAGATGAGGAAGCAAAAGGAAATTTAGAGGCAATTATCGA TTGTTATAAAGACTTCTTAAATAAATATGAAAAAGATGGTTTAAATACAAAGATTACAATTTCA GCTTTTTAGATTCTGCTTCTTATGAAAAATTATCTGACTTTTTTAACGATGTAAAACCTCAAGGTT ATAAACTCTCCTTCACAAGTATTCCATTATCAGAAATTGATAAAATGATAGATGAAGGCAAGCT CTTCCTTTTCCAGATTTACAACAAGGACTTTGCGAAGAAAGCGACAGGGAAGAAAAATCTTCAT ACCTTGTACTGGGAGATCTTTTTAGTGTTGAGACTTGCAGGATGGTCTTGAAATTGAATG GCGAGGCGGAACTCTTTTGGAGGGAGGCAAGCATCAAAAAGGATAAGGTCATTGTCCACAAG AAAGGTTCTATTCTGGTGAATAGGACGACTACAGACGGAAATCTATTCCAGAGGCCATCTATC AGGAAATTTATCAACTTAAGAACAAGATGGCTGACTCCATTTCTGATGAAGCCAAAAGGTTGTT GGAGTCAGGAACTGTCGTTTGTAAGGTTGCCACCCATGATATCGTGAAGGACAAGCACTTCAC AGAGAATACCTATCTGTTCCACTGTCCTATTACCATGAATTTCAAGGCGAAGGATAGAACAAAT AAGGAATTTAATAATCATGTCTTGGAGGTTCTCAATAAGAATCCAGACATAAAGTCATTGGCT TGGATCGTGGAGAGCGTCATTTGCTCTATCTTTCTTTGATCAACCAAAAAGGTGAGATTGAATG |

TABLE S10F-continued

Native Nucleotide Sequences Group 10

| SEQ ID NO | Corresponding AA | Sequence |
|---|---|---|
| | | CCAGAAAACACTGAATTTGGTGGAGCAAGTGAGGAATGACAAGACTGTCTCTGTAAACTACCA<br>TGAAAAGCTGGTCCACAAAGAGGGTAGTCGTGATGCAGCACGAAAAGAATTGGCAAACGATTG<br>GGAATATAAAGGAATTGAAGGAGGGGTATCTTTCCGCTGTAGTCCATGAGATTGCCAGCTTGA<br>TGGTGAAGCATAATGCAATCGTTGTTATGGAGGATTTAAACTTCGGGTTCAAGCGGGGACGTT<br>TTGCAGTTGAGCGTCAGATTTATCAGAAGTTTGAGAATATGCTGATAGAAAAGCTGAATTATCT<br>TGTTTTCAAAGATAGGAAGGTCACTGAGCCGGGCGGAGTATTGAATGCCTATCAATTGGCGAA<br>TAAGTCTGCAAAGGTGACGGACGTTTACAAGCAATGTGGATGGCTTTTCTACATCCCCGCAGCC<br>TACACCTCCAAGATTGACCCTCGGACTGGATTTGCCAATCTTTTTATCACAAAGGGGCTGACAA<br>ATGTGGAAAAGAAGAAGGAATTCTTTGGAAAGTTTGATTCAATCAGATATGATGCCACGGAGT<br>CATGCTTTGTCTTTAGCTTTGATTACGCAAAAATCTGTGACAATGCAGACTACAAGAAAAAATG<br>GGATGTGTACACGAGGGGAACCCGGCTTGTGTACAATAAAACTGAACGGAAGAATGTTTCTGT<br>CAATCCCACAGAAGAGTTGCAGTGTGTATTTGATGAATTTGGAATCAAGTGGAATACTGGAGA<br>GGACTTGATTGAATCCATCAGTTTGATTCCGGCAGAAAGTCGAATGCAAATTCTTTGACGTT<br>CTGTTGAGGATGTTCAATGCCACACTGCAAATGAGGAATTCTGTGCCGAATACGGACACTGACT<br>ACTTGGTTTCTCCTGTGAAAGCGGAGGACGGTTCTTTCTTTGATTCTCGTGAGGAGTTTAAGAA<br>AGGTGGAGATGCAAGGCTTCCCATTGACTGTGATGCCAATGGAGCGTATCACATTGCGTTGAA<br>GGGTCTGTATTTGCTGTTGAATGACTTCAATCGGGATAACAAGGGAGTGATTCAGAATATCTCC<br>AACAAGGATTGGTTCAAGTTTGTACAGGAGAAAGTATACAAGGACTGA |
| 366 | 335 | ATGGCAACGATTGAGAATTTTTGTGGACAAGAGAATGGGTATTCTCGGTCAATTACTTTAAGAA<br>ATAAGTTGATTCCTATTGGAAAAACAGCGAACAACTTAAAACAATTTTTGGAAAAGGATCAAGA<br>AAGAGCTGATGTTTATCCTGAAATTAAAAAGTTAATTGATGAAATACATAGAGGCTTTATTGAA<br>GATACTCTTTCTAAGTTTTTCATTTGTATGGGAACCTTTATTTGATGATTTTGAATTATATCAAAT<br>GAAAAGGATAAATCTAAAAAAGCCACAAAGAAAAAAGATTTAGAGAAATTTCAAAGTGGAGC<br>AAGAAAAAAAATTGTGGAAGCGTTTAAGAAGCATCCAGACTATGACAAACTTTTTAAAGATGG<br>ATTATTTAAGGAATTATTACCAGCTTTGATAAAAAATTCTTCTGATTCTGAAATATCAAATAAAG<br>AAGAAGCATTAAAAGTTTTTGATAGATTTAGTACATATTTTGTTGGTTTTCACGAAAATAGAAAA<br>AATATGTATAGCGAAGAAGACAAATCTACTGCAATAAGCTATAGAATAGTTAATGAAAACTTTC<br>CAAAAATTCTATGCCAATGTAAAATTGTACAATTATATAAAGAAAATTTCCCAAAAATTATTTCT<br>GAGACAGAGGAATCTTTAAAGAATCATTTGAACGGAAAAAGACTTGATGAGATTTTTAATGCA<br>GAATCTTTTAATGATGTATTAGCACAAAGTGGAATTGACTTCTATAACACTGTTATTGGTGGTAT<br>TTCTACAGAAACAGAAAAAGTTCAAGGTTTGAATGAAAAAATAAATCTTGCAAGACAAAAACTT<br>CCCGCAGAAGAAAAAATAAACTACGGGGTAAAATGGTAGTTTTGTTTAAGCAGATTTTAAGT<br>GATAGAGGAACATCATCTTTTATTCCTGTTGGTTTTAACAACAAGGAAGAAGTCTATTCTTCTGT<br>AAAATCATTCAATGATGAATTTGTAAATATTTCTGTTTGTGAAACAAAAGAATTATTCAAACAAG<br>TTGCAGAGTTTAATCTTAGTGAAATTTATGTTCCAGCAAAATCTTTAACAAACTTTTCGCAAAAT<br>ATTTTTGGTTCTTGGTCAATTCTAACAGAAGGACTTTTCTTATTAGAAAAGATAAAGTGAAAAA<br>AGCATTATCAGAAATAAAGAAGAAAAAATCAACAAAGAGATTGCAAAAAAGATTATTCTTT<br>GGATGAGTTACAAGTTGCTTATGAAAGATATTGTAATGAACATAATTTTTCAGTAGAGAAAAAT<br>TGCAAAGATTATTTTGATGTTGTTGATTATCGATCAGAAAATGAAAAATCTGATAAGAAAAAA<br>TTTCTATACTTTCAGCTATTACAGAATCTTATTCAAAAATAGATTTTGAAAATATTCATGATTTAC<br>AACAAGAAAAGAAGCCGCTACACCAATTAAAACATATTTGGATGAAGTTCAGAATTTATATCA<br>TCATCTAAAACTTGTTGATTATCGTGGGGAAGAACAAAAAGATTCAAACTTTTATTCAAAATTG<br>GATGAAATCATTACTCAGCTTTCAGAAATTATTCCTTTATACAATAAAGTTAGAAACTTTGTTAC<br>AAAGAAACCTGGTGAAATGAAGAAGATAAAATTGAATTTTGATTGTCCTACTCTAGCTAATGGA<br>TGGGATGAAAATAAAGAATCTTCAAATGATGCAATAATTTTAAGAAAGGATGGTAAATATTATT<br>TAGGAATTTTTAATCCAAATAATAAACCAAAATTTTCTAAAATCGAAAACATTTCTGAATCATAC<br>TACGAAAAAATGGTGTATAAACTTTTACCAGGCCCAAACAAGATGTTACCAAAAGTCTTTTTTC<br>AACAAAAGGACAAGAAACATTTTTGCCACCAAAAGATTTGCTCTTAGGATATGATGCAGGTAAA<br>CATAAAAAAGGTGATGCTTTTGATAAAGAATTTATGTATAAATTAATTGATTGGTTTAAAGATG<br>CAATTAATCGTCATGAAGATTGGAAAAAATTTAATTTTGTATTCTCTCCTACAAAATCTTACGAA<br>GATATGAGTGGTTTTTATAGGGAAGTTGAATTACAAGGGTATAAAGTTTCTTTTCAAAAAATAT<br>CTGACACAGAAATAAATTCTTTTGTAAGCAACGGAAAACTTTTCCTTTTCCAAATATACAATAAA<br>GACTTTGCTTTAAAAGCTTCTGGAAAGAAAAATCTTCATACACTTTATTGGGAAAATCTTTTTAG<br>TGAAGAAACTTAAAAGATGTTTGTCTAAAATTAAATGGAGAAGCAGAATTATTCTGGAGAAA<br>ACCAAGTTTGAACAAAGAAAAAGTTACTGTTCACGAAAAAGGTTCAATTCTTGTAAATAGGACA<br>ACAAATGACGGAAAGTCAATTCCAGAAGACATTTATCAAGAAATTTATCAATTCAAAAATAAAA<br>TGAAAGATAAAATTTCTGACAATATTTCTATACAGAATGATGATGGTAAAGTCATTACGATTAC<br>AGTAACTTTGGAAAATAAGCAAAAAGAAAAATTCACAGAAATTATAAAGTTGTATATAAAACT<br>GCAACTCACTATATTACAAAGGATAATCGTTTTACAGAAGACACTTATCTTTTCCATTGTCCTATT<br>ACAATGAACTTTAAGGCACCTGATAAATCAAATAAAGAATTTAATAATCATGTTCTTGAAGTATT<br>GAGTGGTAATCCTAATGTAAAAATTATTGGATTGGATCGAGGCGAAAGCACCTTATTTATCTT<br>TCATTGATAAATCAAAAGGTGAAATTGAACTTCAAAAAACATTAAATCTTGTTGAACAAGTTA<br>GAAATGATAAAACTGTAAAAGTAAATTATCAAGAAAACTTGTACACAAAGAAGATGATAGAG<br>ATAAGGCTCGTAAAAGCTGGCAAACAATTGGAAATATCAAAGAATTAAAAGAAGGCTATCTTT<br>CAAATGTTGTTCATGAAATTGCAAAAATGATGGTTGAACATAACGCAATTGTTGTTATGGAAGA<br>TTTGAATTTTGGATTAAGCGGGGGCGTTTTGCTGTAGAAAGACAGATTTATCAAAAATTTGAA<br>AATATGTTAATTGAAAACTAAATTATCTTGTTTTCAAAGATAAAAAGGTAACAGAGCCTGGTG<br>GTGTTCTTAATGCTTATCAATTAACAAATAAATCTGCAAATGTATCTGATGTCTACAGACAATGT<br>GGATGGCTTTTCTATATTCCTGCTGCTTATACTTCAAAGATTGATCCAAAAACTGGTTTTGCAAA<br>TCTTTTTATTACAAAAGGCTTAACAAACGTAGAAAAGAAAAAAGAATTTTTTGATAAGTTAGAT<br>TCTATTCGTTATGACTCAAAAGAAGATTGTTTTGTTTTTGGATTTGATTATGGAAAAATCTGTGA<br>TAATGCTGATTITAAGAAAAAGTGGGAAGTTTATACAAAAGGGGAACGACTTGTTTACAATAA<br>AACTGAACGCAAGAATATTAACATAAATCCAACAGAAGAATTGAAGTCAATCTTTGATGACTTT |

TABLE S10F-continued

Native Nucleotide Sequences Group 10

| SEQ ID NO | Corresponding AA | Sequence |
|---|---|---|
| | | GGAATAAATTGGAATAATGAAGAAAATTTTATTGATTCTGTCCATACAATCCAAGCTGAAAAAT CAAATGCAAAATTCTTTGATACACTTTTAAGAATGTTTAATGCAACTTTGCAAATGAGAAATTCT ATTCCAAACACGGAAATTGACTACTTAATTTCTCCTGTAAAATCAGAAGATGGAACTTTCTTTGA TTCTAGAGAAGAATTGAAAAAAGGTGAAAACGCAAAATTACCAATTGATGCAGATGCAAACGG AGCTTATCACATTGCATTAAAAGGTTTGTATTTGTTGGAAAATGACTTTAACCGTAATGATAAAG GTGTAATTCAAAACATCTCCAACGCCGATTGGTTTAAGTTTGTTCAGGAGAAAGAATATAGGGA TTAA |
| 367 | 336 | ATGACAACTATTAACAAATTTTGCGGACAGGGGAATGGGTATTCTCGAGCAATTACTTTAAGAA ATAAGTTGATTCCTATTGAAAAAACAGCGGACAACTTAAAACAATTTTTGGAAAAGGATCAAGA AAGAGCTGATTCTTATCCTGAAATTAAAAAGTTGATTGATGAAGTGCATCGGGGATTTATCGAG GATACTCTTACAAAATTCTCATTTGTATGGGAACCTTTATTTGATGATTTTGAATTATATCAAAT GAAAAGGATAAATCTAAAAAAGCTGCGAAGAAAAAAGATTTAGAGAAATTTCAAAGTGGAGC AAGAAAAAAAATTGTTGAAGCTTTTAAGAAGCATCCTGATTATGACAAACTTTTCAAAGATGGA TTGTTTAAGGAATTATTACCAGCTTTGATAAAAAATTCTTCTGACTCTGAAATATCAAATAAAGA AGAAGCATTAAAAGTTTTTGATAGATTTAGTACATATTTTGTTGGGTTTCACGAAAATAGAAAA AATATGTATAGCGAAGAAGAAAAATTTACTGCAATAAGCTATAGAATAGTTAATGAAAACTTTC CAAAATTCTATGCCAATGTAAAATTGTACAATTATTTAAAAGAAAATTTCCCACAAATTATTTCT GAGACAGAGGAATCTTTAAAGAATCATTTGAATGAAAAAAAACTTGATGAGATTTTTAATGTAG AATCTTTTAATGATGTATTAGCACAAAGTGGAATTGACTTCTATAACACTGTTATTGGTGGAATT TCTACAGAAACAGAAAAAGTTCAAGGTTTGAATGAAAAAATAAATCTTGCAAGACAAAAACTTC CCGCAGAAGAAAAAATAAACTACGGGGGAAAATGGTAGTTTTGTTTAAGCAGATTTTAAGTG ATAGAGGAACATCATCTTTTATTCTTGTTGATTTTAACAACAAGGAAGAAGTTTATTCTTCTGTA AAATCATTCAATGATGAATTTGTAAATCTTTCTGTCTGTGAAACAAAAGAATTATTCAAACAAGT TGCAGAGTTTAATCTTAGTGAAATTTATGTTCCGGCAAAATCTTTAACAAACTTTTCGCAAAACA TTTTTGGTTCTTGGTCAATTTTAACAGAAGGACTTTTCTTATTAGAAAAAGATAAAATGAAAAAA GCATTATCAGAAAATCAAGAAGAAAAATAAATAAAGAGATTGCAAAAAAAGATTATTCTTTG GATGAGTTACAGGTGCTTATGAAAGATATTGTAATGAACATAATTTTTCAGTAGAGAAAAATT GCAAAGATTATTTTGATGTTGTTGATTATCGATCAGAAAATGAAAATCTGATAAGAAAAAAGT TTCTATACTTTCAGCTATTACAGAATCTTATTCAAAAATCGATTTTGAAAATATTCACGATTTACA ACAAGAAAAAGAAGCCGCTACACCAATTAAAACATATTTGGATGAAGTTCAGAATTTATATCAT CATCTAAAACTTGTTGATTATCGTGGTGAAGAACAAAAAGATTCAAACTTCTATTCAAAGTTGG ATGAAATCATTACTCAGCTTTCAGAGATTATTCCTTTATACATAAAGTTAGAAACTTTGTTACA AAGAAACCTGGTGAAATGAAGAAGATAAAAATGATGTTTGATTGTAGTTCTTTATTAGGAGGA TGGGGAACTGATTATGGAACAAAAGAAGCTCATATTTTTATTGATTCTGGAAAATATTATTTGG GAATTATAAACGAAAAATTATCAAAGATGATGTAGAGTTATTAAAAAAATCAAGTGAAAGAA TGGTAACAAAAGTTATTTATGATTTTCAGAAACCTGATAATAAAAATACACCTCGGTTATTTATT CGTTCAAAAGGAACAAATTATGCCCCTGCTGTTTCTCAATATAATTTGCCAATAGAATCTATTAT TGATATTTATGATAGAGGATTGTTTAAAACCGAATATAGAAAAATCAATCCAGAAGTTTACAAA GAATCATTAATAAAAATGATTGACTATTTCAAGTTAGGATTTGAAAGACATGAATCATATAAGC ATTATCCATTCTGTTGGAAGGAATCTTCAAAATATAATGATATTGGAGAATTTTATAAGGATGTA ATAAAATTCATGCTATCAATTACATTTTGAAAAAGTGAATTATGATAATTTATTAAAATTGGTTGA AATAATAAAATATTTCTTTTCCAAATCTATAACAAAGATTTTGCAGAAAAAAAATCTGGAAAG AAAAATCTTCATACACTTTATTGGGAAAATCTTTTTAGTGAAGAAAACTTAAAAGATGTTTGTCT AAAATTAAATGGAGAAGCAGAACTATTCTGGCGAAAACCAAGTTTAAACAAAGAAAAAGTTAC TGTTCACAAAAAAGGTTCAATCCTTGTAAATAGAACAACAAATGATGGAAAATCAATTCCAGAA GATATTTATCAAGAAATTTATCAATTCAAAAATAAAATGATTGATAATCTTTCAGAGAACGCAAA ATCATTGTTAGATTCTGGAGTTGTTGTTTGTAAAGAAGCAACTCATAATATTACAAAGGATAATC GCTTTACAGAAGATACTTATCTTTTCCATTGTCCTATTACAATGAACTTTAAGGCTCCTGATAAAT CAAATAAAGAATTTAATAATCAAGTTCTTGAAGTATTGAGTGATAATCCTGATGTAAAAATTATT GGATTAGATCGTGGAGAACGACACCTTATTTATCTTTCATTGATAAATCAAAAAGGTGAAATTG AACTTCAAAAAACATTGAATCTTGTTGATCAAGTTAGAAATGATAAAACTGTAAAAGTTAATTA TCAAGAAAAACTTGTACACAAAGAAGGTGACAGAGACAAGGCTCGTAAAAACTGGCAAACAAT TGGAAATATCAAAGAATTAAAAGAAGGATATCTTTCAAATGTTGTTCATGAAATTGCAAAAATG ATGGTTGAACATAACGCAATTGTTGTTATGGAAGATTTGAATTTTGGATTTAAGCGGGGCGTT TTGCTGTAGAAAGACAGATTTATCAAAAATTTGAAAATATGTTAATTGAAAACTAAATTATCTT GTTTTCAAAGATAAAAAGGTAACAGAGCCTGGTGGGGTTCTTAATGCTTATCAATTAACAAATA AATCTGCAAATGTATCTGATGTCTACAGACAATGTGGATGGCTTTTCTATATTCCTGCAGCTTAT ACTTCAAAGATTGACCCAAAAACTGGTTTTGCAAATCTTTTTATTACAAAAGGCTTAACAAACGT AGAAAAGAAAAAGAATTCTTTGACAAGTTTGATTCTATTCGTTATGACTCAAAAGAAGATTGT TTCGTCTTTGGATTGATTATGGAAAAATCTGTGATAATGCTGATTAAGAAAAAGTGGGAAG TTTATACAAAAGGTGAACGACTTGTTTACAATAAAACAGAACGCAAGAATATTAGCATAAATCC AACAGAAGAATTGAAGTCAATCTTTGATGACTTTGGAATAAATTGGAATAATGAAGATAATTTT ATTGATTCTGTCCATACAATCCAAGCTGAAAAATCAAATGCAAAATTTTTTGATACACTTTTAAG AATGTTTAATGCAACTTTACAAATGAGAAATTCTATTCCAAACACGAAATTTGACTACTTAATTT CACCAGTAAAATCAGAAGACGGGACTTTCTTTGATTCTAGAGAAGAATTGAAAAAGGTGAAA ATGCAAAATTGCCAATTGATGCAGATGCAAACGGAGCTTATCACATTGCATTAAAAGGCTTGTA TTTGTTGGAAAATGACTTTAACCGTAATGATAAAGGTGTAATTCAAAACATTTCTAACGCCGATT GGTTTAAGTTTGTTCAGGGGAAAGAATATGAAAAATGA |

K. Group 11 Type V Nuclease and Associated Sequences
(SEQ ID Nos: 368-385)

TABLE S11A

Enzyme Sequences Group 11

| SEQ ID NO | Sequence |
|---|---|
| 368 | MKMSEQFCGQGNGYSISKTLRFELKPQGATLENIKKLKLIESDLQKSQDYKDVKIIIDNYHKYFIDEVLQNVNLDW<br>TKLADALIEYSKTKEDDSNVIKEQDALRNEIVKLISKDERFKPLTAPTPKDLFNSLLPEWFEKNASSALNEKAVETFK<br>KFCAYFKGFQENRKNMYKEEAIPTAVPYRIVHDNFPKFLQNVASFAEIQKKCPEIIEQTETELSAYLENEKLSDIFNV<br>KNYNKYLCQTGAEKQRGIDFYNQVIGGIVQNENDKKLRGLNEFLNLYWQKHADFAKTNRKVKFIPLYKQILSDRT<br>SLSFKIQTIGSDQELKEAILSFAEKMNSKNNDGKTVFDVATELCETITQFDLSQIYVNQKDINNVSRILTGDWAYLQ<br>KRMNIFAEEETLNKKEQKRWKKELDDDTSKTKGIFSFEELNAVLEYSSENCSPTTIRMQDYFGTTSRWYFDKQTEIF<br>TKSGEIIEPSIKDLCAEIENNFIAMDKIFETVPSEKTLREKPADVEKIKNYLDSVQNLLHRIKPLKVNGLGDANFYTAY<br>DEVYXALGEVXSLYNKTRNYIAKKVGAPEKFKLNFDNPTLADGWDQNKESSNTSIIILIKDDKYFLGIMNAHDKPQF<br>QEKXESNGEKCYQKMIYKLLXGPXKMLPKVFXXKKGISNFNPPKNILAGYDEXKHIKGDKFDIXXCHQLIDWXKDA<br>ISRHDDWKKFGFSFXATDSYKDXSDFYREVSXQGYKINXVXIPESXIDEMVXXXKLYLFQIYNXDFAEGASGTLNM<br>HTLYWKNLFSKENLQDTVLKLNXEXELXYREKGINDPIVHKKGSKLVNKVTQDXFSIXTEIYTEIYKFENGKQDKLSD<br>EARKYFDEHKVIVKTAGXDITKDRRFTEPXFLFHVPITINFKAQGNTFAMNEXVRKFLKNNPDVNIIGLDRGERHLI<br>YLSLVNQNGEILKQFXFXEVGRXKNGQLVKVNYHEKLDNREKERDAARKNWNXIGKIAELKEGYLSAVIHELAKL<br>MIQYNAVIVMEDLNFGFKXGRFHVEKQVYQKFEHMLIDXLNYXXFXDKXFSEXGGVLNGYQLAGQFESXQKXG<br>KQSXFLFXVXAAXTXKIDPKTGFADLLNLRDLXNVHKKRDFFSKFDXXXYXAETXSFAFXFDYKXFDGKGXSEMSA<br>TKWTVYSREKRIVYSPKSKSHSDVYPTXELKKIFXXXSIDFESGNNXIDSIMEXGAXLKQNEKPTXDVANFWDAML<br>RNFKLILQMRNXXXASGEDYXISPXKNXDGXFFDSRKEKXLGDKAKLXXDADANGAYHIALKGLLLLKRFXKTEES<br>NXXKXXXXISXAXWFEFAQNRNN |
| 369 | LESDKKKSEDYKDAKKIIDNYHCYFIDDVLKTLSLNWENLAKEINEYRKSKSDDVNLLSAQQKQRDEILKVFNSDKR<br>FKALIASTPKDLFNKLLPEWFKKDNSVELNKEATETFKRFYSYFKGFQENRENVYSSKEIPTAVPYRIVNDNFPKFLS<br>NISVFETIQKKCPDVITDVENELKEYLGNEKLSDIFSIQSFNKYLCQSGAENQRGIDFYNQIIGGIVEKDKEQNLRGI<br>NQFLNLYWQQHPEFAKNNKRIKMVPLFKQILSDRTSLSFKIEAIDSDDELIQAIEDCANKLEEKSKDDGKSIFEKCC<br>ELFDSINEQDLNEIYINRKDINNFSRILTGDWAWLQARMNYYAEEKFTTKAEKSRWVKSLEDEGENKSKGFYTLA<br>ELNDVLKYSSDNIPETNIRIADYFGRRYRYFYEKETGNYIPSEELVALSIEEMCDDILVKRKNMDKAFETSEKEKLQE<br>DSETVSKIKDYLDSLQELLHRVKPLKVNGVGESSFYANFDTVYNKLEIVSVYNKTRNYLTKKVASPEKYKLNFDNP<br>TLADGWDLNKEQANTSVLFRKNGMFYIGIMNPKDKPKFAEKYEVKDEDPFYEKMVYKLLPGPNKMLPKVFFSTK<br>GKETFNPPKEILNDYEKGKHKKGDSFDIDFCHKLIDWFKNAINQHEDWKKFDFKFSDTKNYKDISDFYREVTEQG<br>YKLSFTNIPVSEIEKMVEDGKLYLFQIYNKDFSSESKGTPNMHTLYWKNLFSEENLKDVCLKLNGEAELFYRPVGIK<br>NPIVHKKDSYLVNKLTKDGKSIPENIYEEIYKNANGKLDKLSKDAEEYKRTHDVVIKVAKHDIIKDKHYTVPKFLFHV<br>PITINFKASGNSYSLNENVRFKLKNNPDVNIIGLDRGERHLIYLSLINQKGEILEQFSFNTVEQSRNDAEPRIIDYHEK<br>LNQREKERDEARKSWQTIGKIAELKEGYLSAVIHKLAQLMIKHNAIVVMEDLNFGFKRGRFHVEKQVYQKFEHM<br>LIDKLNYLVFKDKGLTEAGGVLNGYQLASQFESFQKLGKQSGMLFYVPAGYTSKIDPKTGFVNMFNFKDLTNVHK<br>KRDFFSNFKSISFDNDTDSFVFTFDYKDFNGKAKEEMFISKWSVYSREKRIVYYSKTKSYEDVLITEKLKSAFQKVNI<br>DYTNGNDLLDSIMGIGADLKNGEKPSKEVADFWDTLLYNFKLILQMRNSNARTEEDYIISPVKAPDGTFFDSREE<br>GKKEHNATLPKDADANGAYHIALKGLSLLKRFDVADEKSLKKFDMKISNADWFKFVQEKEYKD |
| 370 | MEKTMDDFTNLYSLSKTLRFELKPIAETKENIEKGKFLESDKKKAADYKAVKKIIDNYHKYFIDDVLKNASFTWTKLE<br>EAIKEYNKNRNDDSVVENEQKKLREEILKLFTSDKRYKALTAATPKDLFDTILPEWFGENSNPDLNKTALKTFQKFT<br>SYFTGFQENRKNVYSAEPIPTAVPYRIVNDNFPKFLQNISIFKTIQEKCPQVIDDVEKELSSYLGKEKLADIFTLESFN<br>KYLGQGGKENQRGIDFYNQIIGGIAEKEGEQNLRGINQFLNLYWQQNPEFAKENRRIKMVPLYKQILSDRSSLSFK<br>IESIENDEELKIALLECADKLEGKNEEKKSVFEDTCDLFESLNKQNLQELYINRKDIKTVSRILTGDWSWLQTRMNVY<br>AEEEKFTTKAEKARWQKSLDDEGENKSKGFYSLAELNKVLEYSSENVTETDIRITDYFEHRCRYYIEKESERFVQGSEL<br>IALSIKEMCDDIQTKRKGMDRVLENLSDEKLLLKEKTEDIAVIKNYLVAVQNLLHRIKPLKVNGVGDSSFYAIYDSIYS<br>ALSEVISVYNKTRNYITKKAASPEKYKLNFDNPTLADGWDLNKEQANTSVLLRKDGMYYLGIMNPKNKPKFAEKY<br>EVADGQSCYEKMIYKQFDATKQIPKCSTQKKEVQKYFLSGATEPYILNDKKSFKSELIITKDIWFMNNHVWNGEK<br>FVPKRDNETRPKKFQIGYFKQTGDFDGYKNALSKWISFCKEFLQSYISSTVYDYNFKKSDEYEGLDDFYNYLNATCY<br>KLTFINIPESEIEKMVSEGKLYLFQIYNKDFAPGANGRPNMHTLYWKNLFSDENLKNVCLKLNGEAELFYRPAGIK<br>DPVVHKEGSYLVNRTTEDGESIPEKIYLEIYKNANGKLDSLSDEAKSYKENHKIVIKKASHEIIKDRHYTEAKFLFHVPI<br>TINFKASGNSFSINENVRRFLKNNPDVNIIGLDRGERHLIYLSLINQKGEILKQFTFNEVERDKNGQTVKVNYHEKL<br>DQREKERDSARKSWQTVGKIAELKEGYLSAVIHQLTKLMVEYNAIVVMEDLNFGFKRGRFHVEKQVYQKFEHM<br>LIDKLNYLVFKDRGLNEPSGVLNGYQLTGQFESFQKLGKQSGMLFYVPAGYTSKIDPKTGFVSMMNFKDLTNVH<br>KKRNFFSNFNDIHFDDATGSFVFTFDYKNYDGKAKEEMKQTKWSVYSRDKRIVYFPKVKSYEDIQPTEKLKALFET<br>AGIDYKSGNPILDSIMTIGADLKEGAKPSKEIAEFWDGLLYNFKLILQMRNSNARTGEDYIISPVMADTGTFFDSRE<br>ELKKGEDAKLPLDADANGAYHIALKGLELINKINLTDENELKKMKISISNADWFQFAQEKNYAKG |

TABLE S11B

Human Codon Optimized Nucleotide Sequences Group 11

| SEQ ID NO | Corresponding AA | Sequence |
|---|---|---|
| 373 | 370 | ATGGAGAAGACCATGGATGATTTCACTAACTTATACAGCCTCAGCAAAACTCTCCGCTTCGAAT<br>TGAAGCCTATTGCTGAAACCAAGGAAAATATCGAGAAGGAAAGTTTCTCGAGTCTGATAAAA<br>AAAAGGCCGCCGACTATAAAGCCGTCAAGAAAATCATAGACAACTACCATAAGTACTTCATTGA<br>TGATGTTCTCAAGAATGCCTCCTTTACTTGGACCAAGCTGGAGGAAGCTATCAAGGAGTACAAC<br>AAAAATCGCAACGACGACTCCGTGGTTGAAAATGAGCAGAAAAAACTGAGAGAGGAGATACT |

TABLE S11B-continued

Human Codon Optimized Nucleotide Sequences Group 11

| SEQ ID NO | Corresponding AA | Sequence |
|---|---|---|
| | | TAAGCTCTTCACCTCCGACAAGAGATATAAGGCGTTAACAGCTGCAACTCCCAAGGATCTGTTT<br>GACACCATTTTGCCGGAATGGTTCGGCGAGAACTCTAATCCTGACCTGAACAAAACTGCCCTGA<br>AGACGTTCCAAAAATTCACGAGTTATTTTACAGGGTTTCAAGAAAACCGCAAAAACGTGTATAG<br>CGCAGAGCCCATTCCAACTGCGGTGCCGTATAGGATTGTGAACGACAATTTTCCTAAGTTCCTG<br>CAGAACATCAGTATTTTTAAAACCATCCAGGAGAAATGCCCACAGGTGATCGACGATGTAGAA<br>AAAGAGCTCTCAAGCTATCTCGGTAAAGAAAAGCTTGCCGATATCTTCACTCTGGAAAGCTTTA<br>ATAAGTACCTGGGCCAGGGCGGAAAGGAGAACCAGCGTGGGATCGATTTCTACAATCAGATC<br>ATCGGTGGAATCGCGGAGAAGGAAGGAGAACAAAATCTTCGCGGCATTAATCAGTTCCTTAAT<br>CTGTATTGGCAGCAGAATCCTGAGTTCGCCAAAGAGAATAGGCGTATTAAATGGTGCCCCTG<br>TACAAGCAAATATTGTCTGACCGGTCAAGCCTCTCTTTCAAGATAGAGAGCATAGAAAACGATG<br>AAGAGCTGAAGATTGCTCTGCTAGAGTGTGCTGACAAACTAGAAGGAAAGAACGAGGAAAAG<br>AAGTCAGTTTTTGAAGACACCTGCGACTTATTCGAGAGCCTCAAGAATCAAAATCTACAGGAGA<br>TCTACATCAATCGGAAAGATATCAAAACCGTCAGTCGCATTCTGACAGGGGATTGGTCTTGGTT<br>GCAGACCCGAATGAACGTTTACGCAGAAGAGAAGTTTACAACTAAAGCCGAAAAAGCCCGCTG<br>GCAGAAAAGCCTTGATGACGAAGGAGAGAATAAGTCTAAAGGATTCTACTCACTCGCTGAATT<br>AAACAAGGTCTTGGAATATAGCTCAGAAAATGTGACGGAAACCGATATTCGCATCACTGACTA<br>CTTCGAGCATAGGTGTAGATATTACATTGAGAAAGAGTCAGAACGGTTCGTCCAGGGCTCGGA<br>ACTGATCGCTCTGTCCATTAAGGAGATGTGTGATGATATCCAGACGAAGAGAAAGGGAATGGA<br>TAGAGTGCTGGAGAACCTAAGTGATGAGAAACTGTTGAAAGAAAAGACCGAAGACATTGCCG<br>TCATTAAGAACTATCTGGTAGCAGTGCAAAATCTCCTGCATCGGATCAAGCCACTTAAAGTGAA<br>CGGTGTCGGAGATTCTTCCTTCTATGCAATATATGACTCGATCTATTCTGCCCTCTCAGAAGTGA<br>TCTCTGTCTACAATAAGACGAGGAACTACATTACCAAAAAAGCCGCCTCCCCTGAGAAGTACAA<br>GCTAAATTTTGACAACCCTACACTCGCTGATGGATGGGACCTCAATAAGGAACAGGCAAACAC<br>CTCCGTGTTGCTGCGCAAAGACGGGATGTATTACCTGGGGATAATGAACCCAAAAAACAAGCC<br>TAAGTTTGCAGAGAAGTATGAGGTCGCCGATGGGCAGTCCTGTTACGAGAAGATGATATATAA<br>GCAGTTTGACGCCACAAAACAAATTCCCAAGTGCAGCACCCAGAAAAAAGAGGTGCAGAAATA<br>TTTCCTCTCTGGCGCGACCGAACCATATATTCTGAACGACAAGAAAAGCTTCAAAAGCGAGCTA<br>ATCATCACCAAAGATATCTGGTTCATGAATAACCATGTGTGGAATGGCGAAAAATTTGTTCCTA<br>AGAGGGACAACGAGACTCGGCCCAAGAAGTTTCAGATTGGCTATTTCAAGCAGACAGGCGATT<br>TTGACGGCTACAAAAATGCTCTGTCTAAGTGGATTAGCTTTTGCAAGGAGTTCCTACAATCCTA<br>CATCTCTAGTACTGTGTACGACTACAATTTCAAGAAAAGCGACGAGTACGAAGGACTTGACGA<br>CTTTTACAACTACCTTAATGCTACGTGTTATAAGCTGACCTTTTAACATTCCCGAGTCCGAGA<br>TCGAGAAAATGGTGTCAGAGGGGAAATTGTACTTGTTCCAGATCTACAACAAGGATTTTGCAC<br>CTGGAGCAAACGGTAGGCCTAATATGCACACACTGTATTGGAAAAATCTGTTTTCAGACGAGA<br>ATCTGAAGAATGTGTGCCTCAAGCTGAATGGAGAAGCCGAGTTGTTCTATAGACCCGCCGGCA<br>TCAAGGACCCAGTGGTACATAAAGAGGGCTCTTATCTGGTCAACGAACTACAGAGGATGGGG<br>AGTCAATCCCAGAAAAATCTACCTGGAGATATACAAGAACGCTAACGGTAAGCTGGACAGTC<br>TCAGTGATGAGGCCAAGTCTTACAAGGAGAACCATAAGATCGTGATAAAAAAGGCATCACACG<br>AGATCATAAAGGATAGGCACTACACTGAAGCAAAGTTTCTCTTTCACGTTCCTATTACCATTAAC<br>TTCAAAGCATCGGGCAACTCCTTCTCTATAAACGAGAATGTTCGAAGGTTCTTAAAAACAACC<br>CCGATGTGAATATCATTGGGCTCGACCGTGGCGAACGGCATCTTATATACCTCAGTCTCATTAA<br>CCAGAAGGGGAGATCCTGAAACAATTTACGTTTAATGAGGTAGAGAGAGATAAGAATGGTC<br>AGACAGTGAAGGTGAATTACCACGAGAAGCTGGATCAGAGAGAGAAAGAACGTGACTCTGCC<br>CGCAAATCATGGCAAACAGTAGGGAAGATTGCTGAGCTTAAGGAGGGGTACCTGTCCGCCGTT<br>ATCCACCAGCTGACCAAGTTAATGGTTGAGTATAATGCCATCGTTGTGATGGAGGATCTGAACT<br>TCGGATTTAAGAGGGGCAGATTTCATGTCGAAAAGCAAGTGTATCAGAAATTCGAACACATGC<br>TGATCGATAAGCTGAACTATCTGGTCTTTAAAGATCGGGGCCTTAATGAACCAAGTGGGGTGC<br>TAAACGGGTACCAACTGACCGGTCAATTCGAAAGTTTCCAGAAACTGGGCAAACAGTCGGGTA<br>TGTTATTCTATGTCCCCGCCGGCTATACAAGCAAAATTGACCCAAAAACCGGGTTCGTATCCAT<br>GATGAATTTTAAAGACCTGACAAATGTGCACAAGAAGCGGAATTTCTTCAGTAACTTCAATGAC<br>ATTCACTTTGATGATGCTACAGGATCCTTTGTGTTCACATTCGACTACAAGAACTACGACGGGA<br>AAGCCAAGGAGGAGATGAAGCAGACCAAGTGGAGCGTATATTCCAGGGATAAACGAATCGTC<br>TACTTCCCCAAAGTCAAGTCCTATGAGGATATTCAGCCGACCGAGAAGTTGAAAGCGCTTTTTG<br>AAACTGCTGGCATAGACTACAAATCAGGAAACCCCATATTGGATAGCATTATGACTATCGGCGC<br>CGACCTCAAAGAAGGCGCTAAGCCGTCCAAGGAAATCGCTGAATTCTGGGACGGTCTTTTATA<br>TAACTTTAAGCTGATCCTGCAGATGCGGAATAGTAACGCTAGAACAGGTGAGGACTACATCAT<br>AAGTCCAGTTATGGCTGACACCGGTACATTTTTTGATAGCCGAGGAGGAATTAAAGAAAGGCGA<br>AGACGCCAAATTGCCCCTGGATCAGACGCGAACGGAGCATACCACATTGCGCTGAAAGGCTT<br>AGAACTCATCAACAAGATCAACTTGACTGACGAGAATGAGCTTAAGAAGATGAAGATCTCCAT<br>TAGCAACGCCGACTGGTTCCAGTTTGCCCAGGAAAAGAATTATGCAAAAGGGTGA |

TABLE S11C

Direct Repeat Group 11

| SEQ ID NO | Direct Repeat (Variant #1) | SEQ ID NO | Direct Repeat (Variant #2) |
|---|---|---|---|
| 374 | ATCTACAACAGTAGAAATTTTGTATTGGTTTCAAAC | 375 | TCTACAACAGTAGAAATTTTGTATTGGTTTCAAAC |

TABLE S11C-continued

Direct Repeat Group 11

| SEQ ID NO | Direct Repeat (Variant #1) | SEQ ID NO | Direct Repeat (Variant #2) |
|---|---|---|---|
| 376 | GTTTAAACGAACTATTAAATTTCTACTGTTGTAGAT | 377 | TTTAAACGAACTATTAAATTTCTACTGTTGTAGAT |
| 378 | ATCTACAACAGTAGAAATTTAATATGAAGTTCAAAC | 379 | TCTACAACAGTAGAAATTTAATATGAAGTTCAAAC |

TABLE S11D crRNA Sequences Group 11

Figure 11A:
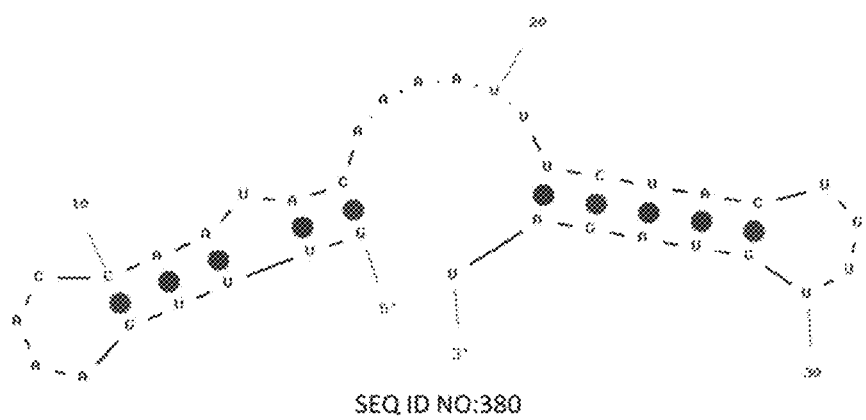
FIG. 11A-11C (SEQ ID NOs:380-382) are schemes depicting the predicted stem loop structures of crRNA sequences of the present disclosure corresponding to Group 11 sequences.
Figure 11B:
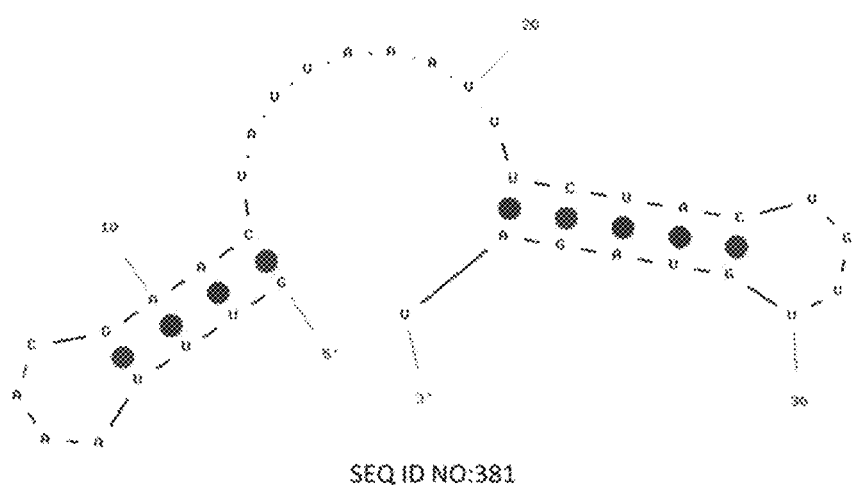
Figure 11C:
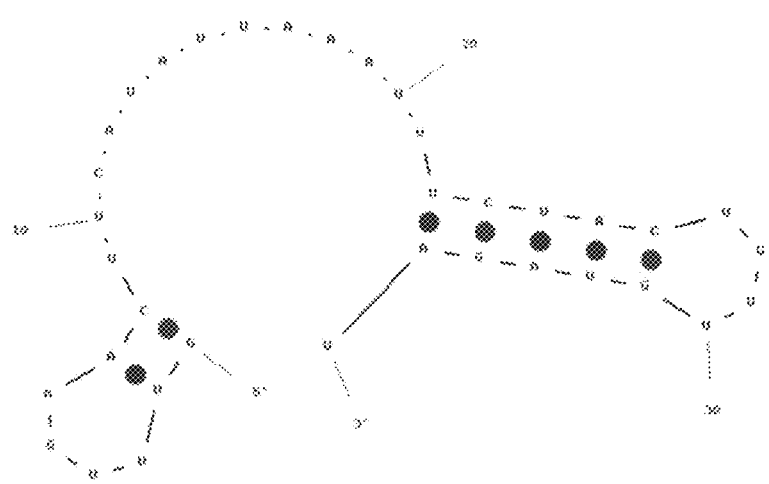

| SEQ ID NO | Sequence | FIG. |
|---|---|---|
| 380 | GUUUGAAACCAAUACAAAAUUUCUACUGUUGUAGAU | FIG. 11A |
| 381 | GUUUAAACGAACUAUUAAAUUUCUACUGUUGUAGAU | FIG. 11B |
| 382 | GUUUGAACUUCAUAUUAAAUUUCUACUGUUGUAGAU | FIG. 11C |

L. Group 12 Type V Nuclease and Associated Sequences (SEQ ID Nos: 386-398)

TABLE S12A

Enzyme Sequences Group 12

| SEQ ID NO | Sequence |
|---|---|
| 386 ID402 | LRSKMAKNTIFSKFTELYPVSKTLRFELKPIGKTLEKIKENGIIDHDKNKADNYVDAKKIIDEYHKYFISEALK GINLDWSPLRDAFIDSLTNRTQDSKKKLEDLQKTFRKKIAEKLAAHPHFKELTATTPKDLFKNILPDHFGN DESIESFKGFSTYFKGFQENRQNIYSAEAISTGVPYRIVHDNFPKFLSNIETFQNIQKHCLSVLTDAETELKK LLNGQKLVEIFNIDFFNNVVTQEGIDFFNQIIGGYTIENNTKIRGINEFANLYRQQNPEFAKLRIATRMIPL YKQILSDRDSMSFILEPFKDASQVQSAVKDFFEDHILYTTDGSQINVLDKIANLVASLNNFDSEKIFIARE SLSQISQKIFGNWNSINDAFFEYCEKQFGSAQKTANKKKIDAKLKEDCYSIKEINCVIKKIDSSKQILDYWK EFDSLKNNIESGDIYKKYVDFISLKFEPDEKLEKDDNIQGLKAFLDAINEFLHYVKPLIVNHENGDTAFYNE LMPLYDQLSNIIPLYNKTRDFATQKPSDSAKFKLNFENPTLADGWDQNNEAKNTSIILKKEGNYYLGIM NAKDKPKIDTYKVNSNEPHYDKMVYKLIPSPHMSLPKAFFSKKGLALYKPSMQILDGYNANKHKKGSSF DKKYCHQLIDFFKEAISAHPDWKNFKFNFSETASYDDTSAFYNEISNQGYMLSFTSIPDSQIDTWIDEGK LPLFQIYNKDFAPGAKGKPNLHTLYWKATFSPENLKDVVFKLNGEAELFYRPCSIKKPYSHKIGEKMVNRI TKDGRPIPDAIFGELFHYFNNSTKPSLSDDAKKYLDFVIVKDVKHEITKDKRYTEDKFEFHVPLTMNFKSS DGSRYINDRVKDFLKNNPDVNIIGIDRGERNLIYMTLINQKGEILIQKSFNLVGNTNYHEKLSIREQERDA ARRSWRSIGKIKELKEGYLSLVIHEIAKTMIENNAIIVLEDLNFGFKRGRFCVEKQVYQKFEKMLIDKLNYL VFKDCSDSEYGGILKGYQLTQKFTSFKDIRKQNGFLFYIPAAYTSKIDPTTGFVNLFNFTDLTNAEKKKDFL TNFDDITFDSKTNSFAFTFDYSKFKVFQTDFQKTWTVFTNGKRIVYDRESKKYNTIEPTTIIQEALEKQGV QCVDQLNVLAEIEKIETKNASFFNSICYAFEKSLQMRNSNSETDDDYILSPVKNKNGVFFNSNEADDKLP KDADANGAFHIALKGLYLLQHISETDEKLKIPHEKWFEFVQSRNK |
| 387 ID404 | LSLFVAKKGYIKKNTILRSKMAKNTIFSKFTGLYPVSKTLRFELKPIGQTLEKIKENGIIDHDKNKADNYVNA KKIIDEYHKYFISEALKGVKLDWSPLRDAFIDSLTNRTQDSKKKLEDLQKTFRKKIAEKLAAHPHFKELTAS TPKELFEKILPNHFGKEESVEAFKRFSTYFKGFQENRKNIYSADAISTGVPYRIVHDNFPKFLSNIETFQNI QKHCPSVLTNAETELKELLNGQKLAEIFNIVFFNSIITQEGIDFFNQIIGGYTIENNKKIRGINEFTNLYRQQ NPEFAKQRIATRMIPLYKQILSDRESMSFILEPPKDASQVQSAVKDFFEDHILHYSTDGSQINVLDKISNLI TSLNNFEPDKIFIARESLSQISQKFFGSWNSINDAFFEYCEKQFGSAQKAANKKKIDAKLKEDCYSINEINH VIKQIDPSKQISDYWKELESFKNNIESGDLYKKYEDFISLKFEPDAKLEKDDNIQGLKDFLDAINEFLHYVK PLTANHENGDTAFYNELMPLFDQLSNVIPLYNKTRDFATQKPSDSAKFKLNFENPTLADGWDQNKED ANTSIILKKGENYYLGIMNAKDKPKIDTYKVTPDEPHYDKMVYKLLPGPNKMLPKVFFSAKGKEIYNPSK EIQDGYAAEKHKKGPSFDKRFCHQLIDFFKEGISNHPDWKNFNPNFSETSSYEDISAFYNEVSDQGYKLS FTPIPDSQIDTWIDEGKLFLFQIYNKDFAPGAKGKPNLHTLYWKATFSPDNLQDIVFKLNGEAELFYRPC SIKKPYSHKIGEKMVNRITKDGRPIPDAIFGEIFHYFNNSTKPSLSDDAKKYLDFVIVKDVKHEIIKDKRYTE DKFEFHVPLTINFKADDGSKRLNDQIKDFLKNNPDVNIIGIDRGERNLIYMTLINQKGEILIQKSFNLVGN TNYHEKLSIREQERDAARKSWRSIGKIKELKEGYLSLVIHEIAKTMIENNAIIVLEDLNFGFKRGRFCVEKQ VYQKFEKMLIDKLNYLVFKDCSDSECGGILKGFQLTQKFESFQKMGKONGFLFYVPAAYTSKIDPTTGFV NLFNFTDLTNAEKKKAFLTNFDDITYDSKTSTFALTFDYSKFKVFQTDYQKTWTIFTNGKRIVYDRESKTH NTIEPTTIIQEALEKQGIQCVDQLNVLTEIEKIEPTRENARFFDSICYAFEKTLOLRNSNSETGDDYILSPVK NKNGIFFNSNEADDKLPKDADANGAFHIALKGLYLLQHISETDEKLKIPHEKWFEFVQSRNK |

TABLE S12B

Human Codon Optimized Nucleotide Sequences Group 12

| SEQ ID NO | Corresponding AA | Sequence |
|---|---|---|
| 388 | 386 | CTTCGTTCAAAAATGGCCAAGAATACCATCTTCAGTAAGTTTACTGAGTTGTATCCTGTGTCAAA<br>AACCTTGCGATTCGAATTAAAACCAATAGGGAAGACACTGGAAAAAATCAAGGAGAACGGAAT<br>TATCGATCACGACAAGAATAAAGCAGACAATTACGTGGATGCTAAGAAGATCATCGACGAGTA<br>CCACAAATACTTTATAAGCGAGGCCCTTAAAGGGATCAATCTGGATTGGTCGCCATTGCGGAT<br>GCCTTTATTGATTCCCTGACTAACAGAACTCAAGATTCGAAGAAAAAGTTAGAGGATCTACAAA<br>AGACCTTTCGCAAAAAGATCGCTGAAAAGTTGGCAGCACACCCACATTTCAAGGAACTGACTG<br>CCACAACACCCAAGGACCTGTTTAAGAACATTCTGCCTGACCATTTCGGCAACGACGAATCAAT<br>CGAAAGCTTTAAAGGCTTTTCCACGTATTTTAAGGGTTTCCAAGAGAATAGGCAGAATATATAC<br>AGCGCTGAGGCAATATCCACCGGTGTGCCTTACAGAATCGTGCATGACAACTTCCCAAAATTTC<br>TCAGCAATATTGAGACATTCCAGAACATCCAAAAGCATTGTCTGTCCGTGCTGACTGACGCCGA<br>GACTGAGTTGAAGAAGCTGTTAAATGGCCAAAAGCTGGTGGAGATATTCAACATCGATTTCTTC<br>AACAATGTCGTCACGCAGGAAGGTATTGATTTCTTCAATCAAATCATCGGGGGTTACACGATTG<br>AAAACACACCAAAATTAGGGGAATCAACGAGTTCGCCAATCTGTACCGGCAGCAAAACCCAG<br>AGTTTGCCAAGTTGCGCATTGCCACCAGAATGATCCCCCTGTATAAGCAAATTCTTTCGGATCGC<br>GATTCTATGAGTTTTATACTCGAGCCTTTCAAAGACGCAAGCCAGGTGCAGTCTGCCGTCAAAG<br>ACTTTTTCGAAGATCATATCCTTCACTATACAACAGATGGCTCTCAGATCAATGTGCTAGACAAG<br>ATTGCTAACCTCGTGGCTAGTTTGAACAATTTCGACTCAGAAAAGATCTTCATAGCTAGGGAGT<br>CACTGAGCCAGATCTCTCAGAAGATCTTTGGCAATTGGAATTCAATTAACGATGCGTTTTTCGA<br>GTATTGCGAAAAGCAGTTTGGATCTGCCCAAAAAACTGCAAACAAGAAAAAGATCGACGCCAA<br>GCTCAAGGAGGATTGCTACAGTATCAAGGAGATCAATTGCGTGATTAAGAAGATCGACAGCTC<br>AAAACAGATTTTAGACTACTGGAAAGAGTTTGACTCTTTAAAGAACAACATCGAGTCCGGGGA<br>CATTTACAAGAAGTATGTCGACTTCATTTCACTGAAGTTTGAGCCCGATGAGAAATTGGAGAAA<br>GACGACAATATTCAGGGGCTCAAGGCTTTCCTGGATGCCATTAATGAGTTTCTTCACTATGTGA<br>AACCGCTCATTGTCAACCATGAAAATGGCGATACTGCATTCTATAACGAGCTAATGCCTCTGTA<br>CGACCAGCTGTCTAATATCATTCCGTTGTACAACAAAACACGCGATTTCGCGACCCAGAAGCCT<br>TCTGATTCCGCGAAGTTCAAACTGAATTTCGAAAATCCAACCCTAGCCGACGGCTGGGATCAGA<br>ACAATGAAGCGAAGAACACTAGCATCATTTTGAAGAAGGAGGGCAACTATTATCTCGGCATCA<br>TGAACGCTAAAGACAAACCCAAGATTGACACATATAAAGTAAACAGCAACGAACCACACTATG<br>ACAAGATGGTATACAAACTGATTCCCAGCCCCCACATGTCCTTGCCCAAGGCCTTCTTTAGTAAG<br>AAAGGACTTGCCCTCTATAAACCTAGTATGCAGATCTTAGACGGTTATAATGCCAATAAACATA<br>AGAAGGGATCTAGCTTCGACAAAAAATACTGCCACCAGCTCATCGATTTCTTTAAAGAGGCCAT<br>CTCCGCTCACCCCGACTGGAAGAACTTTAAATTTAACTTCAGCGAGACTGCATCGTACGATGAT<br>ACCTCTGCATTTTACAACGAGATTAGCAATCAGGGGTACATGCTGAGTTTCACATCTATTCCTGA<br>CTCCCAGATAGATACCTGGATCGACGAAGGGAAGTTATTCCTGTTTCAGATCTACAACAAAGAT<br>TTTGCACCAGGCGCTAAAGGGAAACCGAATCTGCACACCCTGTATTGGAAGGCGACGTTTAGT<br>CCTGAGAACCTGAAAGACGTCGTTTTTAAACTGAACGGCGAAGCTGAGCTCTTCTATCGGCCCT<br>GCAGTATAAAAAAGCCGTACTCCCACAAAATCGGTGAAAAGATGGTCAATAGGATAACAAAGG<br>ATGGACGGCCAATTCCGGACGCGATCTTTGGGGAACTGTTTCATTACTTCAACAATTCAACGAA<br>GCCCTCTCTGAGCGACGATGCCAAGAAATACCTTGACTTCGTAATTGTTAAGGATGTGAAGCAT<br>GAGATTACGAAAGACAAGCGCTATACCGAAGATAAGTTTGAGTTTCACGTCCCTCTAACAATGA<br>ATTTTAAAAGCAGCGATGGGTCAAGATACATCAATGACCGTGTGAAAGACTTTCTTAAGAATAA<br>CCCTGACGTGAATATCATTGGCATCGATCGAGGCGAGCGCAATCTTATCTATATGACCCTCATC<br>AATCAGAAAGGGGAGATTCTTATCCAGAAGTCCTTCAACCTCGTTGGCAACACTAATTACCACG<br>AAAAATTAAGCATCAGGGAGCAGGAAAGGGATGCTGCCCGACGGAGCTGGCGAAGTATCGGC<br>AAAATTAAAGAATTGAAGGAAGGGTATCTGTCACTCGTCATCCACGAAATAGCTAAAACAATG<br>ATAGAGAACAACGCCATAATTGTTCTCGAGGATCTGAATTTCGGATTTAAACGGGGAAGGTTTT<br>GTGTTGAAAACAGGTGTATCAGAAGTTCGAAAAAATGCTCATCGACAAGCTGAATTACCTAG<br>TGTTCAAAGACTGTTCAGACTCTGAATATGGTGGTATTCTGAAAGGCTATCAGCTGACCCAGAA<br>GTTTACCTCCTTTAAGGACATTAGAAAGCAAAATGGATTCCTCTTCTACATCCCAGCTGCCTATA<br>CGTCCAAAATTGATCCCACCACTGGATTTGTCAACCTCTTCAATTTCACCGATCTGACTAATGCA<br>GAGAAGAAGAAGGATTTTCTGACCAATTTTGACGATATCACCTTTGACTCTAAGACAAATTCTTT<br>TGCTTTCACTTTCGATTACTCCAAGTTCAAGGTGTTCCAAACCGACTTCCAGAAGACATGGACAG<br>TTTTCACCAATGGAAAGAGAATAGTGTATGACCGTGAGTCTAAAAAGTACAACACTATAGAACC<br>CACCACAATCATACAGGAAGCGCTCGAGAAGCAGGGGTGCAATGTGTAGACCAGCTCAATGT<br>TCTTGCCGAGATTGAGAAAATCGAGACAAAAAACGCAAGTTTCTTTAACTCCATTTGTTACGCA<br>TTCGAAAAGTCCCTTCAGATGAGAAACTCCAACAGCGAAACCGACGACGATTACATATTGAGTC<br>CCGTTAAAAACAAGAACGGCGTATTCTTTAACTCCAACGAGGCCGATGATAAACTGCCAAAAG<br>ATGCCGACGCTAACGGCGCCTTTCACATTGCACTAAAAGGACTGTACCTGCTGCAGCATATATC<br>AGAAACTGACGAAAAACTGAAGATTCCTCATGAGAAGTGGTTCGAGTTCGTGCAGAGCCGGAA<br>CAAGTGA |

TABLE S12C

Direct Repeat Group 12

| SEQ ID NO | Direct Repeat (Variant #1) | SEQ ID NO | Direct Repeat (Variant #2) |
|---|---|---|---|
| 390 | GCCTAGAAACTTCAAAAAATTTCTACTCTTGTAGAT | 391 | CCTAGAAACTTCAAAAAATTTCTACTCTTGTAGAT |

TABLE S12C-continued

Direct Repeat Group 12

| SEQ ID NO | Direct Repeat (Variant #1) | SEQ ID NO | Direct Repeat (Variant #2) |
|---|---|---|---|
| 392 | GCCTAGAAGCTTCAAAAAATTTCTACTCTTGTAGAT | 393 | GCCTAGAAGCTTCAAAAAATTTCTACTCTTGTAGAT |

TABLE S12D crRNA Sequences Group 12

Figure 12A:
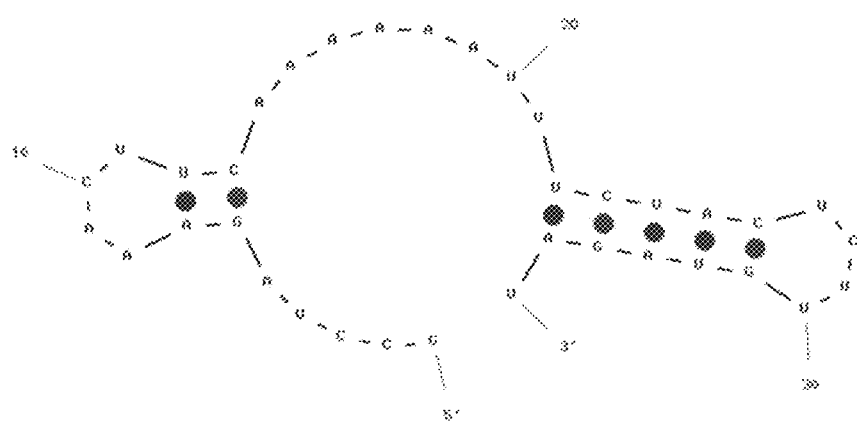
FIG. 12A-12B (SEQ ID NOs:394-395) are schemes depicting the predicted stem loop structures of crRNA sequences of the present disclosure corresponding to Group 12 sequences.
Figure 12B:
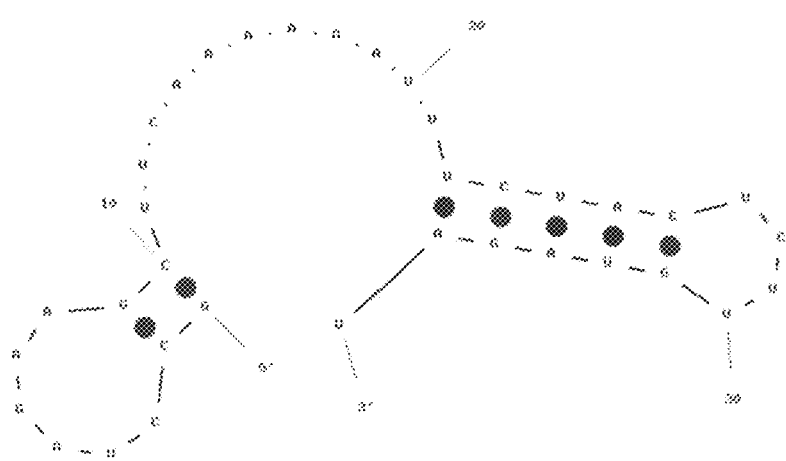

| SEQ ID NO | Sequence | FIG |
|---|---|---|
| 394 | GCCUAGAAACUUCAAAAAAUUUCUACUCUUGUAGAU | FIG. 12A |
| 395 | GCCUAGAAGCUUCAAAAAAUUUCUACUCUUGUAGAU | FIG. 12B |

TABLE S12E

Consensus Sequence Group 12

| SEQ ID NO | Consensus Sequence |
|---|---|
| 396 | LSLFVAKKGYIKKNTILRSKMAKNTIFSKFTXLYPVSKTLRFELKPIGXTLEKIKENGIIDHDKNKADNYVBAKKIIDEY HKYFISEALKGXXLDWSPLRDAFIDSLTNRTQDSKKKLEDLQKTFRKKIAEKLAAHPHFKELTAXTPKXLFXXILPBHF GXXESXEXPFKXFSTYFKGFQENRXNIYSAXAISTGVPYRIVHDNPPKFLSNIETFQNIQKHCXSVLTBAETELKXLLN GQKLXEIFNIXFFNXXXTQEGIDFFNQIIGGYTIENNXKIRGINEFXNLYRQQNPEFAKXRIATRMIPLYKQILSDRXS MSFILEPFKDASQVQSAVKDFFEDHILHYXTDGSQINVLDKIXNLXXSLNNFXXXKIFIARESLSQISQKXFGXWNSI NDAFFEYCEKQFGSAQKXANKKKIDAKLKEDCYSIXEINXVIKXIDXSKQIXDYWKEXXSXKNNIESGDJYKKYXDFI SLKFEPDXKLEKDDNIQGLKXFLDAINEFLHYVKPLXXNHENGDTAFYNELMPLXDQLSNXIPLYNKTRDFATQKP SDSAKFKLNFENPTLADGWDQNXEXXNTSIILKXXXNYYLGIMNAKDKPKIDTYKVXXBEPHYDKMVYKLJPXPXX XLPKXFFSXKGXXJYXPSXZIXDGYXAXKHKKGXSFDKXXCHQLIDFFKEXISXHPDWKNFXFNFSETXSYXDXSAFY NEXSBQGYXLSFTXIPDSQIDTWIDEGKLFLFQIYNKDFAPGAKGKPNLHTLYWKATFSPXNLXDXVFKLNGEAEL FYRPCSIKKPYSHKIGEKMVNRITKDGRPIPDAIFGEJFHYFNNSTKPSLSDDAKKYLDFVIVKDVKHEIXKDKRYTE DKFEFHVPLTXNFKXXDGSXXJNDXXKDFLKNNPDVNIIGIDRGERNLIYMTLINQKGEILIQKSFNLVGNTNYHEK LSIREQERDAARXSWRSIGKIKELKEGYLSLVIHEIAKTMIENNAIIVLEDLNFGFKRGRFCVEKQVYQKFEKMLIDKL NYLVFKDCSDSEXGGILKGXQLTQKFXSFXXXXKQNGFLFYXPAAYTSKIDPTTGFVNLFNFTDLTNAEKKKXFLTN FDDITXDSKTXXFAXTFDYSKFKVFQTDXQKTWTXFTNGKRIVYDRESKXXNTIEPTTIIQEALEKQGXQCVDQLN VLXEIEKIEXXXXNAXFFBSICYAFEKXLQXRNSNSETXDDYILSPVKNKNGXFFNSNEADDKLPKDADANGAFHIA LKGLYLLQHISETDEKLKIPHEKWFEFVQSRNK |

Wherein:
each X is independently selected from any naturally occurring amino acid.

TABLE S12F

Native Nucleotide Sequences Group 12

| SEQ ID NO | Corresponding AA | Sequence |
|---|---|---|
| 397 | 386 | TTGAGGTCAAAAATGGCTAAAAATACCATATTCTCCAAGTTCACCGAACTTTACCCGGTTTCTAA AACCCTGCGCTTTGAATTGAAGCCCATTGGCAAAACCCTTGAAAAAATCAAGGAAAATGGAATT ATCGACCATGATAAAAACAAAGCCGATAATTATGTTGATGCGAAGAAAATTATAGATGAGTAC CATAAATATTTCATCAGCGAAGCATTAAAAGGAATCAACTTAGACTGGTCACCACTCCGTGACG CATTTATAGATTCATTGACCAACAGAACTCAAGATAGCAAGAAAAAACTCGAGGATTTGCAGAA GACTTTCAGAAAAAAAATTGCCGAAAAACTTGCTGCACATCCACACTTTAAGGAACTAACAGCC ACAACGCCTAAAGATTTGTTTAAAAATATTCTTCCGGATCATTTTGGGAACGACGAATCTATTGA ATCTTTTAAAGGATTTTCTACTTACTTTAAGGGTTTCAAGAAAACAGGCAGAACATCTATTCTG CAGAAGCAATAAGCACTGGAGTGCCATACCGAATTGTTCATGACAATTTTCCTAAATTTTTATCC AACATTGAAACTTTCCAGAACATTCAAAAGCATTGTCTTTCTGTTCTTACCGACGCCGAAACAGA ATTAAAAAAACTACTAAACGGCCAAAAACTTGTTGAAATATTCAATATTGATTTTTTCAACAATG TTGTCACACAAGAAGGTATCGATTTCTTCAATCAGATAATCGGCGGCTACACAATTGAAAACA TACTAAAATTCGCGGAATCAACGAATTTGCAAATCTCTACCGTCAACAAAATCCTGAGTTCGCA AAACTGCGCATCGCAACTAGAATGATTCCCTTGTACAAGCAAATCTTAAGCGATCGGGATTCAA TGTCGTTCATTCTAGAACCTTTCAAAGACGCTTCTCAAGTGCAATCGGCTGTAAAGGACTTTTTT |

TABLE S12F-continued

Native Nucleotide Sequences Group 12

| SEQ ID NO | Corresponding AA | Sequence |
|---|---|---|
| | | GAGGACCACATTTTGCATTATACTACCGATGGCTCTCAAATTAACGTTCTGGACAAAATTGCCA<br>ATTTGGTCGCCAGTTTAAACAATTTTGATTCAGAAAAATTTTCATTGCTAGAGAATCTCTTTCA<br>CAAATATCTCAAAAAATCTTTGGAAATTGGAATTCGATAAATGACGCCTTCTTTGAATATTGCGA<br>GAAACAATTTGGCTCAGCACAAAAAACTGCTAATAAGAAAAAAATTGATGCAAAATTAAAGGA<br>AGATTGCTATTCAATCAAAGAAATAAACTGTGTCATCAAAAAAATAGACTCTTCCAAACAAATA<br>TTGGACTATTGGAAAGAGTTTGATAGTTTGAAAAATAATATTGAATCGGGTGACATTTATAAGA<br>AATACGTGGATTTTATATCTCTCAAATTTGAACCGGATGAGAAACTGGAAAAAGATGACAATAT<br>ACAGGGCTTGAAGGCATTTCTCGATGCCATTAACGAATTCCTTCATTATGTCAAACCTTTGATTG<br>TTAATCACGAAAACGGAGATACGGCTTTTTACAACGAACTAATGCCGTTATATGATCAGTTATCT<br>AATATTATTCCTCTATATAACAAAACCCGTGATTTCGCAACGCAGAAGCCATCAGATTCGGCAA<br>AATTTAAACTCAATTTTGAAAACCCCACTCTTGCAGATGGCTGGGATCAAAACAACGAAGCCAA<br>AAATACGTCCATAATTCTTAAGAAAGAGGGCAATTATTATTTGGGAATAATGAATGCCAAGGAC<br>AAACCTAAAATTGACACATATAAGGTTAACTCTAATGAGCCTCATTATGACAAAATGGTTTACA<br>AACTCATTCCCTCTCCACACATGTCTCTTCCCAAGGCATTTTTCTCAAAAAAGGGGCTGGCGTTA<br>TACAAACCCTCTATGCAAATATTAGATGGTTATAACGCAAATAAGCATAAAAAAGGGTCGTCTT<br>TTGATAAGAAATATTGCCATCAATTAATTGATTTCTTCAAGGAAGCTATTTCTGCACATCCCGAT<br>TGGAAAAATTTCAAATTCAACTTCTCAGAAACAGCTTCTTATGATGACACTAGTGCTTTTTATAA<br>CGAAATTTCTAATCAAGGATACATGCTTTCATTTACTTCTATTCCCGATTCACAAATCGATACATG<br>GATTGATGAAGGAAAGTTATTCCTGTTCCAGATTTACAATAAGGATTTTGCTCCAGGAGCAAAA<br>GGCAAGCCCAATTTGCATACATTATATTGGAAAGCAACATTCTCTCCCGAGAATTTGAAAGATG<br>TTGTATTTAAATTGAATGGAGAAGCAGAACTTTTCTATCGTCCTTGCAGCATCAAGAAACCATAC<br>TCTCACAAAATCGGTGAAAAAATGGTGAACCGAATAACAAAGGACGGCAGGCCAATTCCTGAC<br>GCGATATTTGGAGAACTTTTCCATTATTTCAACAATTCGACAAGCCTTCTTTGAGTGACGATGC<br>TAAAAAATACCTTGATTTTGTAATCGTCAAAGATGTAAAGCACGAAATCACTAAAGACAAACGA<br>TACACCGAAGATAAATTTGAATTCCATGTGCCATTAACCATGAATTTTAAATCAAGTGATGGCA<br>GTAGATACATAAATGATCGCGTAAAGGATTCCTAAAGAATAATCCTGACGTCAATATCATTGG<br>AATTGACCGTGGTGAACGCAACCTAATTTATATGACTCTTATCAACCAGAAAGGTGAAATTCTG<br>ATACAAAAGAGTTTTAATCTAGTCGGCAATACAAATTATCATGAAAAGCTGTCCATTCGCGAAC<br>AGGAACGTGATGCCGCAAGGAGGAGCTGGCGAAGCATCGGGAAAATTAAGGAACTCAAAGA<br>GGGCTACCTCAGCCTTGTCATCCATGAAATTGCCAAAACAATGATTGAAAACAACGCAATTATT<br>GTTCTTGAAGATTTAAATTTTGGATTTAAGCGTGGACGATTCTGCGTCGAAAAGCAAGTATATC<br>AAAAGTTTGAGAAAATGCTAATTGACAAGCTCAATTATCTTGTTTTCAAAGATTGCTCGGATTCT<br>GAATATGGTGGAATTCTTAAAGGATATCAGCTTACTCAAAAATTTACGAGTTTCAAAGACATTA<br>GAAAGCAGAATGGATTCCTTTTCTATATTCCCGCTGCTTACACTTCTAAAATAGATCCAACAACC<br>GGTTTCGTGAATCTTTTCAATTTTACAGATTTAACGAATGCGGAAAAGAAAAAGGATTTTTTGA<br>CAAATTTTGATGACATTACTTTTGATTCTAAAACAAATTCTTTTGCTTTTACTTTTGATTACAGCA<br>AATTCAAAGTATTTCAAACTGATTTCCAAAAGACATGGACAGTCTTCACCAATGGGAAGAGAAT<br>CGTCTATGATCGAGAATCAAAGAAATATAACACAATTGAGCCGACAACGATAATACAGGAGGC<br>TTTTGGAAAAGCAAGGCGTTCAATGTGTTGATCAATTAAATGTATTGGCTGAAATTGAAAAAATC<br>GAAACAAAAACGCTAGTTTCTTCAATTCTATATGTTATGCTTTTGAAAAATCATTGCAAATGAG<br>AAATAGTAATTCTGAAACTGATGACGACTATATACTTTCTCCAGTAAAAAACAAGAATGGAGTA<br>TTCTTCAATAGCAATGAAGCAGATGATAAACTTCCTAAAGATGCAGATGCAAATGAGCTTTCC<br>ACATAGCTTTGAAAGGATTGTATCTGTTGCAGCATATATCAGAAACAGATGAAAAATTAAAGAT<br>ACCTCATGAAAAGTGGTTTGAATTCGTACAGTCTCGGAATAAATAA |
| 398 | 387 | CTGTCATTATTTGTCGCAAAGAAAGGTTATATTAAAAAAAACACTATTTTGAGGTCAAAAATGG<br>CTAAAAATACCATATTCTCTAAGTTCACCGGACTTTACCCGGTTTCTAAAACCCTGCGCTTTGAA<br>TTGAAACCCATAGGCCAAACCCTTGAAAAAATCAAGGAAAATGGGATTATTGACCATGATAAA<br>AACAAAGCCGATAATTATGTCAATGCGAAGAAAATTATAGATGAGTACCATAAATATTTTATCA<br>GCGAAGCGTTAAAAGGAGTCAAATTAGACTGGTCACCACTCCGTGACGCATTTATAGATTCATT<br>GACCAACAGAACTCAAGATAGCAAGAAAAACTCGAGGATTTGCAGAAGACATTCAGAAAAA<br>AAATTGCTGAAAAGCTTGCTGCGCACCCACACTTTAAGGAGCTAACAGCCTCAACACCCAAGGA<br>ACTATTTGAAAAGATTCTTCCAAATCATTTTGGAAAAGAAGAATCTGTTGAAGCCTTTAAAAGA<br>TTCTCTACCTATTTTAAAGGATTCCAAGAAACAGGAAAAACATCTATTCTGCCGATGCAATAA<br>GTACAGGAGTTCCATACCGAATTGTTCATGACAATTTTCCCAAGTTTTTATCCAACATTGAAACT<br>TTCCAGAACATTCAGAAACATTGTCCTTCCGTTCTTACCAATGCCGAAACAGAATTAAAAGAACT<br>ACTAAACGGACAAAAACTTGCAGAAATATTCAATATTGTTTTTTCAACAGCATTATCACGCAGG<br>AAGGCATCGATTTCTTCAACCAGATAATCGGTGGATACACAATAGAAAACAACAAAAAAATTCG<br>CGGAATCAACGAATTTACAAATCTTTATCGTCAACAAAATCCTGAATTTGCAAAGCAACGAATC<br>GCAACAAGAATGATTCCCTTATACAAGCAGATTTTAAGCGATCGGGAATCAATGTCTTTCATTCT<br>AGAACCCTTTAAAGACGCATCTCAAGTTACAATCGGCTGTAAAGGCACTTTTTTGAGGACCACATT<br>TTGCATTATAGTACCGATGGTTCCCAAATTAACGTTCTTGACAAAATTTCCAATTTGATCACCAG<br>TTTAAATAATTTTGAACCAGATAAAATTTTCATTGCTAGAGAATCTCTTTCACAAATCTCTCAAAA<br>ATTTTTCGGAAGTTGGAATTCGATAAATGATGCATTCTTTGAATATTGCGAGAAACAATTTGGCT<br>CAGCACAAAAAGCAGCCAATAAGAAAAAAATTGATGCGAAATTAAAGGAAGATTGTTATTCGA<br>TTAATGAAATAAACCATGTCATCAAGCAAATAGACCCATCCAAACAAATATCGGACTATTGGAA<br>AGAATTAGAAAGCTTTAAAAACAATATTGAATCAGGGGACCTTTATAAGAAATATGAGGATTTT<br>ATATCTCTCAAATTTGAACCAGATGCGAAACTGGAAAAAGATGACAATATACAAGGATTGAAG<br>GATTTCCTCGATGCCATTAATGAGTTCCTTCATTATGTCAAGCCTTTAACAGCAAATCACGAAAA<br>CGGAGACACGGCTTTTTACAACGAACTAATGCCATTATTTGATCAGTTATCTAATGTTATTCCTC<br>TATATAACAAACTCGTGATTTCGCAACGCAGAAGCCATCAGATTCGGCGAAATTTAAACTCAA<br>TTTTGAAAATCCAACTCTTGCAGATGGCTGGGATCAAAACAAAGAAGACGCAAACACCTCAATA<br>ATTCTAAAAAAGGTGAGAATTATTATTTGGGAATAATGAACGCCAAGGATAAGCCTAAAATT<br>GACACCTATAAGGTCACCCCGGATGAGCCTCACTATGACAAAATGGTTTATAAGCTTCTTCCTG |

TABLE S12F-continued

Native Nucleotide Sequences Group 12

| SEQ ID NO | Corresponding AA | Sequence |
|---|---|---|
| | | GCCCAAACAAAATGCTTCCTAAAGTTTTCTTCTCCGCTAAAGGAAAGGAAATTTACAATCCATCT<br>AAAGAAATTCAAGATGGATATGCCGCAGAAAAGCACAAAAAAGGTCCCTCTTTTGACAAACGG<br>TTCTGTCATCAGTTGATAGATTTCTTCAAGGAAGGCATTTCTAATCATCCAGACTGGAAAAATTT<br>CAACTTTAACTTCTCAGAAACAAGTTCCTATGAAGACATTAGTGCCTTTTATAACGAAGTTTCTG<br>ACCAAGGTTACAAGCTTTCGTTCACTCCTATTCCCGATTCACAAATCGATACATGGATTGACGAA<br>GGAAAACTGTTCCTGTTCCAGATTTATAATAAGGATTTCGCACCAGGAGCGAAAGGCAAGCCC<br>AATTTACATACATTATATTGGAAGGCGACGTTCTCTCCTGATAATTTGCAAGACATTGTATTTAA<br>ATTAAATGGTGAAGCAGAACTTTTCTATCGTCCATGCAGCATCAAGAAACCATACTCTCACAAA<br>ATCGGTGAAAAAATGGTGAACCGAATAACAAAGACGGCAGGCCAATTCCTGACGCGATATTT<br>GGAGAGATCTTCCATTATTTCAACAATTCGACAAAGCCTTCTTTGAGTGACGATGCTAAAAAAT<br>ACCTTGATTTTGTAATCGTCAAAGATGTAAAGCACGAAATCATTAAAGACAAACGTTACACCGA<br>AGATAAATTTGAATTCCATGTACCATTAACTATTAATTTCAAGGCTGATGACGGCAGCAAACGC<br>CTGAACGACCAGATTAAGGATTTTCTAAAGAATAATCCTGATGTCAATATCATTGGAATTGACC<br>GTGGTGAACGCAACTTGATTTATATGACTCTTATCAACCAGAAAGGTGAAATTCTGATACAAAA<br>GAGTTTTAATCTTGTCGGTAATACAAATTACCATGAAAATTGTCCATTCGCGAACAGGAACGT<br>GATGCCGCAAGAAAGAGCTGGCGAAGCATCGGAAAAATCAAGGAACTCAAGGAGGGTTACCT<br>CAGCCTTGTCATCCATGAAATAGCGAAAACAATGATTGAAAATAACGCTATCATTGTTCTTGAA<br>GACTTGAATTTTGGATTTAAACGTGGGCGATTCTGCGTCGAAAAGCAAGTGTATCAAAAATTTG<br>AGAAAATGCTAATCGACAAACTCAATTATCTTGTTTTTAAAGATTGCTCAGATTCTGAATGTGGG<br>GGAATTCTTAAAGGATTCCAACTCACGCAGAAATTTGAAAGTTTCCAAAAAATGGGCAAACAAA<br>ATGGATTCCTTTTCTATGTTCCCGCAGCTTACACTTCTAAAATAGACCCCGACAACCGGTTTCGTA<br>AATCTTTTCAATTTTACAGATTTGACAAATGCGGAAAAGAAGAAAGCGTTCCTAACGAATTTTG<br>ATGACATTACTTACGATTCTAAAACGAGTACCTTTGCTCTTACTTTTGATTACAGCAAGTTCAAA<br>GTGTTTCAAACCGATTATCAAAAGACATGGACCATTTTCACCAACGGGAAGAGAATTGTCTATG<br>ATCGAGAATCTAAGACTCATAACACAATTGAACCGACAACGATAATACAGGAGGCCTTGGAAA<br>AGCAAGGTATTCAATGCGTTGATCAATTAAATGTATTGACCGAAATTGAAAAAATTGAGCCCAC<br>TCGTGAAAATGCTCGTTTTTCGATTCTATCTGTTACGCTTTTGAAAAAACACTGCAATTGAGAA<br>ACAGTAATTCTGAAACTGGTGATGACTATATACTTTCTCCAGTAAAAAACAAGAATGGAATATT<br>CTTTAATAGCAATGAAGCAGATGATAAACTCCCTAAAGATGCAGACGCAAATGGAGCATTCCAC<br>ATAGCTTTGAAAGGATTGTATCTGCTGCAACATATATCAGAAACCGACGAAAAATTAAAAATAC<br>CTCATGAAAAGTGGTTCGAATTCGTACAGTCTCGGAACAAATAA |

M. Group 13 Type V Nuclease and Associated Sequences
(SEQ ID Nos: 399-435)

TABLE S13A

Enzyme Sequences Group 13

| SEQ ID NO | Sequence |
|---|---|
| 399 | MKDLKQFIGLYPVSKTLRFELRPVGRTQEWMEKNHVLEHDGKRAEDYPRVKELIDAYHKICISNSLKVSDIN<br>WTPLRDAIEKNRQEKSDESKKALEEEQTKMRLEICKKLAKFEHYQELVKADTPSKLINGILPHDKALDTFNKF<br>AVYFEGFQENRRNIYSSEAISTGVAYRLVHDNFPKFLANIEVFENIKEICPEVIQQVATEMAPFLEGVMIEDVF<br>TVSYYNAVLTQNGIDYYNQILGGVAKDDQKYRGINEFINLYRQAHPELATKKKSLTMVPLFKQILSDRETLSD<br>IVRPVESEKQLIEVINNFYQRITNFDINGKNVNVVKELTDLVLSIDTYNPEGIFISAKSITDVSHSLYDHWNRIN<br>EKLYDKAVEAIGGVQTVKNKKKVEAYLKKDAYTLSELSFGDDVSISQYFSALTNSTDSINSLWLQFQSWCKS<br>AEKPQFVHNEVGTEYVKMLLDAIMLVLHKCGALLVSLENELDSDFYNKFLPLYAELENVILVYTRVRNFLTKK<br>LSDTGKIKLKFDTPSLGAGWGINKEKTNKAVLLFKDGLSYLGIMNVKGTLDFNCKIEADEPTFKKMVCRNYS<br>KPYMDLPNSFFSQNGISKFHPSERIQKIYFAFKENSKNVDIKKVHELIDYYKDAISRHEDWGSFGFKYSPTESY<br>ETINDFYTEVAAQSYKLRFIEVPQKQVDEWVEEGKLYLFQLYNKDYAEGAHGRKNLHTMYWECLFSEENLS<br>NLFIKLGGQAELFYRPQSIKKPVSHKVGTKMLNRRAKDGKPIPDAIYRSLYQYFNGKKAEAELTTEEKAYISQ<br>VIVKDVHHEIIKDRRYTKQFFYQFHVPIVFNANAPQRPKINERVLEYIKENPDVNIIGIDRGERHLVYLTLINQR<br>GEILKQKTFNVVGDYNYQEKLKQRENERDQARKSWQSVGKIKDLKEGFLSAVVHEIAKMMIENNAIVVLE<br>DLNWGFKRGRFKVERQVYQKFEKMLIDKLNYLSFKDVDTSDEGGILRGYQLTEPVANYTDIGKQTGFLFYIP<br>AAYTSKIDPATGFVNHFNFNDITNAEKRKEFFMKMERIEMKNGNVEFEFDYRKFKTYQTDFQNVWTVNTS<br>GKRIVFDTEKREHKAVYPTQEFVQAFGNKGITLEEGMDIKAFIGGIEADIKNASFFSSLFYAFKTTLQMRNSN<br>ADTREDYILSPVVHDGRQFCSTDEVNKGKDADGNWISKLPVDADANGAYHIALKGLYLLMNPQTKKIENE<br>KWLQFMAEKPYKE |
| 400 | MYDLKQFIGIYPVSKTLRFELKPIGRTQEWIEKNHVLEHDWKRAEDYPRVKEMIDVYHKLCISKSLKNMDFD<br>WEPLRDAIERNRQEKSDESKKELEAEQTRMRNKIHDQLSKFEHYKKLNADTPSLLINHILPQEDALESFKKFA<br>TYFEGFQKNRKNIYSKEAISTGVPYRLVHDNFPKFLANIEVFENLQELCPEVIRQAATEMAPFLQGVMIEDVF<br>TVGFYNAILTQDGIDFYNQILGGVVKDEQHYQGINQLTNLYRQAHPDLTANRKSMTMVPLFKQILSDRETL<br>SDIAKPIESEEQLIEVVTSFYHRVTDFTLNGNSINIIDELATLVQSLNTYNPEGIFVSAKSLTDVSHTLYGHWNKI<br>NEKLYEKAVELFGDVQVVKNRKKVEAYLNKDTYTLAELSFGDDISIAQYFENISGSADATNSLWVQFQSWC<br>KTAEKPKFVHNEAGTELVKMLLDSILNVLHKCSVLVVSMENDLDKDFYNKFLPLYAELENVILLYNRVRNFLT<br>QKPSSTGKIKLKFDIPSLGAGWGINKEKKNKAILLFKDGRSYLGIMNVKGTLDFDCKAEHGEPTYKKMVCVN<br>HSKPYMDLPNSFFRQTGIDKYKPSERILKIYEAFKKDSKSVDINEVRELIDYYKDAITRNEDWNSVSFTYSPTET<br>YETIDDFYKEVAKQSYQVSFKDISQKQVDEWVEKGQLYLFQLYNKDYAEGAHGRKNLHTLYWESLFTAENL |

TABLE S13A-continued

Enzyme Sequences Group 13

| SEQ ID NO | Sequence |
|---|---|
| | SDIVIKLGSNAELFYRPQAIKKPVKHEVGTKMLNRRDNSGKPIPDTIYRSLYQFYNGKKAKAELTAEERAYISQ<br>VIVKDVQHEIIKDRRYTKQFHYQFHVPIVFNANANGKVKFNDKVMDYIQDNPDVNIIGIDRGERHLIYLTLIN<br>QRGEILKQKTFNVVGNYDYQEKLKQREKERNEARRSWQSVGKIKDLKEGFLSAVVHEIAQMMIEHNAIVV<br>LEDLNRGFKRGRFKVERQVYQKFEKMLIDKLNYLSFKDREIADEGGILCGYQLTEKTLNYSDIGRQTGFLFYIP<br>AAYTSKIDPVTGFVNHFNLNDITNAEKRKAFLMKMERIEVKNGNVEFEFDYRKFKTFQTDFQNVWTVNTS<br>GKRIIFDTETRKAKDVYPTKEIAQSFANRGIALEEGMDLKAIIAEVEPDVKNAAFFKSLFYAFENTLRMRNSN<br>TETQEDYILSPVAINGKQFCTTDEANKGKDADGNWLSKLPVDADANGAYHIALKGLYLLNNPQTKKIENEK<br>WFQFMIEKLYLK |
| 401 | MKDLKQFIGIYPVSKTLRFELRPVGKTQEWIEKNRVLENDESKAADYPVVKKLIDEYHKVCIRESMKDVHLD<br>WAPLKEAMEEYQKKKSDDAKKRLEAEQTMMRKRIATAIKDFRHYKELTAATPSDLITSVLPEFSDNEALKSF<br>RGFASYFIGFQENRNNIYSPDAISTGVPYRLVHDNPPKFLSNLEVYDKIKATCPEVIQQASEEIQPFLEGVMID<br>DIFSLDFYNSLLTQDGIDFFNRVIGGVSEEDKQKYRGINEFSNLYRQQHKELAGSKKALTMIPLFKQILSDRDT<br>LSYIPAQIETENELMTSISQFYKHITYFERDGKTINVLNELVALLSKIDTYNPDGICVTANKLTDISQKVFGKWSI<br>IEEENLKEKAVQQFCDISVAKNKKKVDAYLSRKAYCLSDLCFDDEFHISQYFSDLPQTLNAIEGYWLQFNEWC<br>KNDEKQKFLNNPAGTEVVKSLLDAMMELSHKCSVLVMPEEYEVDKSFYNEFIPLYEELDTLFLLYNKVRNYL<br>TRKPSDVKKFKLNFETPSLADGWDQNKERANKAILLFKDGLSYLGIMNAQNMPNLNQKWSADESHYSKM<br>VYKLIPGPNKMLPKVFFSKKGLDIFNPSRHILRIKEEETFKKGSPNFKLADLHDLIDFYKDGINRHPDWSKFNF<br>QFADTKAYEDIAGFYRDIANQAYKITFSDIPVWQINDWIDNGQLYLFQLYNKDYAEGAHGRKNLHTLYWE<br>NLFTDENLSNLVLKLNGQAELFCRPQSIKKPVSHKMGSKMLNRRDKSGMPIPESIYRSLYQFYNGKKKESEL<br>TAAEKQYMDQVIVKDVTHEIIKDRRYTRQEYFFHVPLTFNANAEGNEYINENVLNYLKDNPDVNIIGIDRGE<br>RHLIYLTLINQRGEILMQKTFNVVNSYNYQAKLEQREKERDEARKSWDSVGKIKDLKEGFLSAVIHEICKMM<br>IENNAIVVLEDLNFGFKRGRFKVERQVYQKFEKMLIDKLNYLSFKDREAEEDGGILRGYQMAQKFVSFQRLG<br>KQSGFLFYIPAAYTSKIDPITGFVNHFNFNDITNAEKRKEFLMKMERIEMRNGNIEFEFDYRKFKTFQTDYQ<br>NLWTVSTYGKRIVMRIDDKGYKQMVDYEPTKDIVNTFKNKGIQLTEGSDLKALIADIEANATNAGFFNTLLY<br>AFQKTLQMRNSNAATEEDFIFSPVARDGRYFCSMDEANKGRDAQGNWVSKLPIDADANGAYHIALKGLY<br>LLRNPETKKIENEKWLQFMVEKPYLE |
| 402 | MLNLNYYLFYFVSLWQDNEYLKPITMNNLKQFIGIYPVSKTLRFELRPIGKTQEWIEINKVLEGDVQKAADYP<br>TVKKLIDEYHKICIHDSLKNVHFDWAPLKEAIVIFQKTKSDESKKRLEAEQTIMRKQIAAAIKDFKHFKELTAAT<br>PSDLITSVLPEFSDDDSLMSFRGFATYFSGFQENRINIYSQESISTGVPYRIVHDNFPKFLSNQEVYDRIRSVCP<br>EVIKQASEELQPFLEGVMIDDIFSLDFYNSLLTQDGIDFYNRVIGGVSEEGKQKYRGINEFSNLYRQQHKDLA<br>ASKKAMTMIPLFKQILSDRETLSYIPVQIESEDELVSSIKQFYEHITHFERDGKTVNVLSELVAVLGNISDYNPD<br>GICISASKLTDISQKVYGKWSIIEEKLKEKAIMQYGDISVAKNKKKVDAYLSRKAYCLSDLCFDEVVSFSRYYSE<br>LPQMLNAINGYWMQFNEWCRSDEKQKFLNNPMGTEVVKCLLDAMMELYHKSAVLVMPEEYEVDKSFY<br>NEFIPLYEELDTLFLLYNKVRNYLTRKPSDVKKFKLNFESPSLASGWDQNKEMKNNAILLFKDGKSYLGVLNA<br>KNKAKIKDAKGDASSSSYKKMIYKLLSDPSKDLPHKLFAKGNLDFPKPSEYILEGRELGKYKKGPNFDKKFLHD<br>FIDFYKAAIAIDPDWSKFNFQYSPTESYEDIGAFFSEIKKQAYKIRFTDITESQVNEWVDNGQLYLFQLYNKDY<br>AEGAHGRKNLHTLYWENLFTDENLSNLVLKLNGQAELFCRPQSIKKPVSHKIGSKMLNRRDKSGMPIPENI<br>YRSLYQFYNGKKKESELTTAEKQYMDQVIVKDVTHEIIKDRRYTRQEYFFHVPLTLNANADGNEYINEQVLN<br>YLKNPDVNIIGIDRGERHLIYLTLINQRGEIIKQKTFNIVNNYNYQAKLEQREKERDEARKSWDSVGKIKDLK<br>EGFLSAVIHEITKMMIENNAIVVLEDLNFGFKRGRFKVERQVYQKFEKMLIDKLNYLSFKDREVGEEGGILRG<br>YQMAQKFVSFQRLGKQSGFLFYIPAAYTSKIDPVTGFVNHFNFNDITNAEKRKDFLMKMERIEMKNGYIEF<br>TFDYRKFKTYQTDYQNVWTVSTFGKRIVMRIDEKGYKKMVDYEPTNDIIYAFKNKGILLSEGSDLKALIADVE<br>ANATNAGFFGTLLYAFQKTLQMRNSNALTEEDFILSPVAKDGHHFCSTDEANKGRDAQGNWVSRLPVDA<br>DANGAYHIALKGLYLLRNPETKKIENEKWFQFMVEKPYLE |
| 403<br>ID403 | MKDLKQFIGIYPVSKTLRFELPIGKTLEWIKKNKVLESDEQKAEDYPKVKTLIDEYHKVCICESLKGVNFDWN<br>PLRLALKEYQSSKSDESKAVLEKEQALMRKQIATVIKDFRHYKELTTPTPQKLIDNVFPSIYESDALKSFNRFAV<br>YFKGFQENRNNIYSSDAISTGVPYRLVHDNFPKFLADIEVFENIKTNCPEVIEQAATELQPFLEGVMIEDIFTID<br>FYNSLLTQDGIDFFNQVLGGVAEEEGKQKYRGINEFSNLYRQHPEQTAKKKTLTMIPLFKQILSDRDTLSYIP<br>QQIESEQQLIELLNQFYSHITAFDYNGKTVDVLKELTKLTGNINKYNPDGIYLSAKSLTDVSQKLFSKWNVITE<br>RLSEEAIKRFGDVSITKNKKKIDAYLSKDAYALSEIPLDNDHSLSMFFAEFPKTIENVGSNWLQFMEWCKGES<br>KQLFLNNADGTEIVKNFLDSIMEILHRCSVLVVSVEHDLDKDFYNDFLPLYAELENAVMVYNRVRNFLTKKP<br>SDTKKFKLNFGVPSLGDGWDQNKERDNKAIILFKDGKSYLGIMNAKDMPIIKERDESTPSSYKKMIYKLLAD<br>PAKDFPHTFFSKKGIDTYHPSRYILDGREQKGYKKGETFDKKFMRDFIDFYKDAVAKHPIWSKFNFVYSPTES<br>YEDIGAFFNEVSKQAYKIRRFSYIEESQINEWTEKGQLY<br>LFQLYNKDYAEGAHGRKNLHTLYWESLFSPENLSNIVLKLNGQAELFYRPQSIKQPFSHKTGSKMLNRRDKS<br>GMPIPEAIYRSLYQYFNGRKAESELTLVEKSYIDQVVVKDVTHEIVKDRRYTKPEFFFHVPITFNVNADGNEYI<br>NEQVMEYLKDNPDVNIIGIDRGERHLIYLTLINQRGEILKQKTFNIVGNYNYHAKLEQREQERDQARKSWQ<br>SVGKIKELKEGFLSAVIHEIAMMMIKYNAIVVLEDLNFGFKRGRFKVERQVYQKFEKMLIDKLNYLSFKDRKP<br>DEAGGILRGYQLTQQFTSFQRLGKQSGFLFYIPAAYTSKIDPVTGFVNHFNFNDITNAEKRKAFFMKMERIE<br>MRNGDIEFEFDYRKYKTYQTDYQNIWTVNSSGKRIVMRIDENGRKQMTDYFPTKEIVKAFSDKNITLCEGT<br>DLKALMAVIDTSPKNASLYGTLFYAFQKTLMRNSDSATEEDYILSPVTQNGKQFNTKDEADKGQDSAGN<br>WVSKFPVDADANGAYHIALKGLFLLMNQQTKKIENQKWLQFMVQKPYKS |
| 404 | MKDLKQFIGIYSVSKTLRFELRPIGKTQEWIEKNKILESDEQKAEDYPKVKTLIDDYHKVCIRESLRGVHLDWS<br>PLRQALEEYQQTKSDESKAVLEKEQTSMRKQIAAAIKDFRHFRELTAPTPQKLIDDVFPGIYEDEALKSFNRF<br>ALYFRGFQDNRNNIYSAEAISTGVPYRLVHDNFPKFLADIEVYENIKATCPEVIEQVAVEMQPFLEGVMIDDI<br>FTLDFYNSLLTQDGIDFFNQVLGGVAEEGKQKYRGINEFVNLYRQQHPELTGKKKALTMVPLFKQILSDRET<br>LSYIPQQIESEQQLIDVLSQFYAHITDEYNGKTINVLKELSNLTNRIGDYNPAGIFLSAKTLTDVSQKLFGRWS<br>AINDKLYEKAVSQFGDPAIVKDKKKIDAYLAKDAFALSEINLDSEHHLSTYFSEMALVVEQVGSSWLQFKEW<br>CKGSDKQLFLNNADGTEIVKNLLDAMMDILHRCAVLVVPIEYDLDKDFYNDFLPLYAELENVIFVYNRTRNY<br>LTKKPSDTKKFKLNFGTPTLGDGWGVNNERKNKAILLFKEGLSYLGIMNVKGTLKFEETKDASLHSYKKMTC<br>RYLSKPFMDLPHTFFSEKGISTFHPSERIMDIYKNGTFKKDSPSYSIAALHDLIDFYKDAINKHEDWVKYGFSF |

TABLE S13A-continued

Enzyme Sequences Group 13

| SEQ ID NO | Sequence |
|---|---|
|  | SPTESYEDISSFYSEIAKQAYKISFTNVSEQQVNDWVENGQLYLFQLYNKDYAEGAHGRKNLHTLYWENLFS EENLNNLVLKLGGQAELFYRPQSINKPAKHVVGSKMLNRRDKSGMPIPEPIYRSLYQYFNGKKQEDELTAA EKAYIDQVVVKDTNHEIVKDRRYTKPEYFFHVPIVFNANADGNEYINERVLDYLKDNPEVNIIGIDRGERHLIY LTLINQRGEILKQKTFNMVGNYNYHAKLELREKERDDARKSWKSVGKIKELKEGFLSAVIHEIAVMMVENN AIVVLEDLNFGFKRGRFKVERQVYQKFEKMLIDKLNYLSPKDRMADEEGGILRGYQLALQFTSFQRLGKQSG FLFYIPAAYTSKIDPVTGFVNHFNLNDITNAEKRKAFLMNMERIEVKNGNVEFEFDYRKFKTYQTDYQNIWT VNTSGKRIVFDSETRKAKDVYPTQEIIAAFKEKGINLNDGTDLKPLIADIEANAKNASFYYAIFDAFKRTLQMR NSNAATEEDYILSPVVCNGKQFCTTDEVNKGKDADGNWLSKLPVDADANGAYHIALKGLYLLNNPQTKKIE NEKWFQFMVEKPYLE |

TABLE S13B

Human Codon Optimized Nucleotide Sequences Group 13

| SEQ ID NO | Corresponding AA | Sequence |
|---|---|---|
| 405 | 399 | ATGAAGGACCTGAAGCAATTTATAGGCCTGTATCCGGTCAGTAAAACCCTGAGATTCGAATTA AGGCCCGTCGGACGTACACAGGAATGGATGGAGAAGAATCATGTGCTGGAGCACGATGGCA AAAGAGCAGAAGATTATCCAAGGGTTAAGGAACTAATAGATGCCTATCACAAGATCTGTATT AGCAATTCGCTCAAAGTATCTGACATTAATTGGACGCCACTTCGGGACGCAATTGAGAAGAA TCGACAGGAGAAGAGTGATGAAAGCAAAAAGGCTCTGGAAGAAGAACAGACTAAATGCGT CTGGAGATTTGTAAGAAGCTCGCCAAATTTGAGCACTATCAGGAACTCGTGAAAGCCGACAC ACCTTCAAAATTAATCAACGGGATACTCCCTCACGATAAAGCGCTGGACACATTTAACAAGTT CGCTGTCTACTTTGAAGGCTTTCAGGAGAATCGGCGAAATATCTACTCTAGCGAGGCAATATC AACCGGTGTCGCCTACCGCCTGGTGCACGATAACTTCCCTAAATTCCTGGCGAATATCGAGGT CTTCGAAAACATAAAGGAAATTTGTCCAGAGGTTATACAGCAAGTGGCCACTGAGATGGCCC CATTTTTGGAAGGAGTGATGATCGAGGATGTGTTTACCGTAAGTTATTATAACGCCGTTCTCA CCCAGAACGGGATCGACTATTACAACCAAATCCTTGGTGGCGTTGCAAAGGACGACCAGAAG TATCGAGGTATCAACGAATTCATCAACCTTTACAGACAGGCTCATCCAGAGCTGGCCACAAAA AAGAAAAGCCTGACTATGGTCCCTCTATTTAAGCAAATATTAAGCGACAGGGAGACACTGAG TGATATTGTCCGCCCAGTGGAAAGCGAGAAGCAGTTGATCGAAGTAATTAACAACTTCTACC AGCGCATCACTAACTTTGACATTAACGGTAAGAACGTCAATGTTGTTAAGGAATTGACAGATC TGGTCCTGTCAATCGACACATACAATCCTGAGGGAATCTTTATCTCCGCTAAGTCCATTACCGA TGTGTCTCATTCCCTGTACGACCACTGGAACCGTATCAATGAGAAACTGTATGACAAAGCCGT GGAAGCCATAGGAGGGGTGCAAACTGTGAAGAATAAGAAGAAAGTGGAGGCCTATCTGAA AAAAGACGCATATACCTTGTCCGAACTGAGTTTCGGGGATGATGTATCCATCTCGCATGTACTT TTCTGCCCTTACGAACAGTACTGACTCCATTAACTCCCTGTGGCTGCAATTTCAATCATGGTGC AAGTCAGCTGAGAAGCCTCAATTCGTCCATAACGAGGTGGGTACTGAGTATGTGAAAATGCT ACTGGATGCTATCATGCTTGTACTGCACAAATGCGGCGCGCTGTTGGTGTCCTTGGAGAATGA GCTCGATAGCGACTTCTACAATAAATTCCTGCCCTTGTACGCTGAATTGGAGAATGTTATCCTG GTCTATACCAGAGTACGGAATTTTCTAACCAAAAAACTCTCCGACACGGGTAAGATCAAACTC AAATTTGATACGCCCTCACTAGGGGCCGGATGGGGGATTAACAAGGAGAAAACGAACAAGG CCGTGTTACTGTTTAAGGACGGCCTGAGTTATCTGGGCATCATGAATGTCAAAGGAACATTG GACTTTAATTGCAAGATCGAAGCTGACGAACCTACATTTAAGAAGATGGTCTGCCGGAATTAT TCTAAGCCCTATATGGATCTTCCCAACAGCTTTTTCAGCCAGAACGGAATCTCTAAGTTTCACC CTTCCGAGCGAATCCAGAAGATATATTTCGCCTTCAAGGAGAACTCCAAAAATGTTGACATCA AAAAGGTGCATGAGCTCATCGACTACTACAAAGATGCTATCTCCAGGCACGAGGACTGGGGC TCTTTCGGCTTCAAGTACTCACCCACCGAAAGCTATGAGACTATTAATGACTTCTACACAGAG GTGGCAGCACAGTCTTATAAGCTTCGCTTTATAGAGGTGCCCCAAAAGCAGGTGGATGAGTG GGTCGAAGAAGGAAAACTCTACCTGTTCCAGTTGTACAATAAGGACTACGCTGAAGGTGCAC ATGGCAGGAAGAATCTCCATACAATGTATTGGGAGTGTCTGTTTTCTGAGGAAAACTTGTCCA ATCTGTTCATAAAGCTCGGGGGGCAGGCAGAATTATTTTACCGGCCTCAGTCAATCAAGAAA CCCGTGAGCCATAAAGTCGGCACCAAGATGTTGAATAGACGGGCTAAAGATGGCAAACCGA TCCCGGATGCCATTTACAGATCCCTCTATCAATACTTCAATGGAAAGAAGGCCGAGGCGGAA CTGACTACAGAGGAAAAGCCTACATTTCTCAGGTTATCGTGAAGGATGTGCACCATGAGAT TATTAAAGATAGACGGTACACCAAACAATTCTTCTATCAGTTTCACGTTCCAATTGTTTTCAAC GCCAACGCACCACAGCGGCCTAAAATCAATGAACGCGTACTCGACGTATATTAAGGAGAACCC GGACGTAAATATCATTGGAATCGATCGGGGGGAAAGGCACTTGGTGTACCTTACCCTCATTA ACCAAAGGGGTGAGATCCTTAAGCAGAAACCTTTAACGTGGTTGGCGACTACAACTATCAA GAAAAACTCAAGCAGAGGGAGAACGAGAGAGATCAGGCTCGCAAGTCATGGCAGAGCGTC GGGAAGATTAAGGATCTCAAAGAGGGGTTCCTGAGCGCCGTTGTGCACGAGATTGCCAGA TGATGATTGAAAACAATGCCATAGTGGTGCTCGAAGACCTCAATTGGGGATTCAAAAGAGGG CGGTTTAAAGTGGAGAGACAGGTTTACCAAAAGTTCGAGAAGATGCTGATTGACAAGCTGAA TTACCTGAGTTTCAAAGACGTGGACACATCTGACGAGGGCGGAATCCTACGAGGCTATCAGC TGACAGAGCCAGTGGCCAACTACACTGATATAGGCAAACAGACTGGGTTCCTTTTCTACATCC CCGCTGCTTATACCAGTAAAATTGACCCTGCTA |
| 406 | 400 | CCGGATTCGTGAACCACTTCAATTTCAATGATATCACCAATGCCGAAAAAAGGAAGGAGTTTT TCATGAAAATGGAGCGCATTGAAATGAAAAATGGTAACGTAGAGTTCGAGTTTGACTACCGC AAGTTTAAGACCTATCAGACGGATTTCCAGAATGTATGGACCGTCAACACATCAGGCAAGCG |

TABLE S13B-continued

Human Codon Optimized Nucleotide Sequences Group 13

| SEQ ID NO | Corresponding AA | Sequence |
|---|---|---|
| | | CATTGTGTTCGACACTGAAAAGCGAGAACATAAGGCTGTGTACCCAACTCAGGAGTTTGTGC AGGCTTTTGGCAACAAAGGCATCACCCTTGAGGAAGGAATGGACATTAAGGCATTCATAGGT GGGATTGAGGCCGACATTAAGAACGCCTCTTTTTTTTCGAGTCTGTTCTACGCGTTTAAAACTA CACTTCAGATGAGGAACAGCAATGCGGATACCAGGGAAGATTATATCCTTAGCCCCGTCGTC CACGACGGGCGTCAGTTTTGCAGCACCGATGAGGTGAACAAGGGAAAAGATGCAGATGGGA ACTGGATTTCTAAGTTACCCGTGGACGCAGATGCAAACGGCGCGTACCATATCGCTCTAAAA GGCCTGTACCTGCTCATGAATCCCCAGACTAAGAAGATCGAGAATGAAAAGTGGTTACAGTT CATGGCAGAGAAACCATACAAGGAATGA |

TABLE S13C

Direct Repeat Group 13

| SEQ ID NO | Direct Repeat (Variant #1) | SEQ ID NO | Direct Repeat (Variant #2) |
|---|---|---|---|
| 411 | ATCTACAATAGTAGAAATTTAATATGGT CTTACA CC | 412 | ATCTACAATAGTAGAAATTTAATATGGTCT TACA CC |
| 413 | GCTGTAAGAGCATATTAAATTTCTACTA TTGTAG AT | 414 | GCTGTAAGAGCATATTAAATTTCTACTATT GTAG AT |
| 415 | GGTGTAAACCATAGTAAAATTTCTGCTA TTGCAG AT | 416 | GGTGTAAACCATAGTAAAATTTCTGCTATT GCAG AT |
| 417 | ATCTGCAATAGCAGAAATTTTACTATGG TTTACA CC | 418 | ATCTGCAATAGCAGAAATTTTACTATGGTT TACA CC |
| 419 | GGTGCAAATACATATAAAATTTCTACTA TTGTAG AT | 420 | GGTGCAAATACATATAAAATTTCTACTATT GTAG AT |
| 421 | GCTGTTAGAGCATATGAAATTTCTACTA TCGTAG AT | 422 | GCTGTTAGAGCATATGAAATTTCTACTATC GTAG AT |

TABLE S13D crRNA Sequences Group 13

Figure 13A:
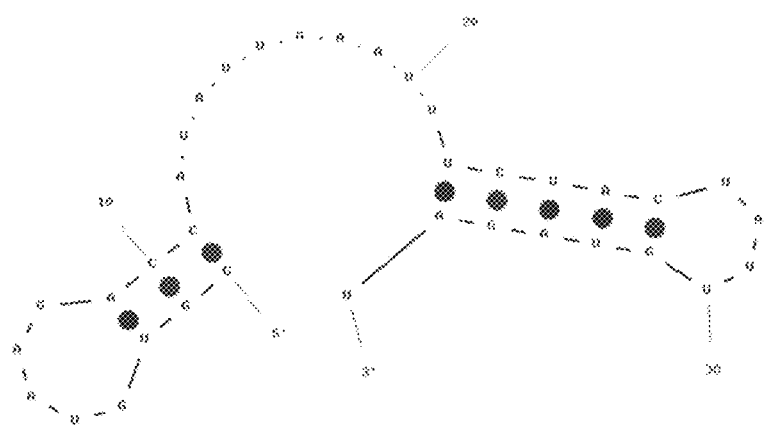
FIG. 13A-13F (SEQ ID NOs:423-428) are schemes depicting the predicted stem loop structures of crRNA sequences of the present disclosure corresponding to Group 13 sequences.
Figure 13B:
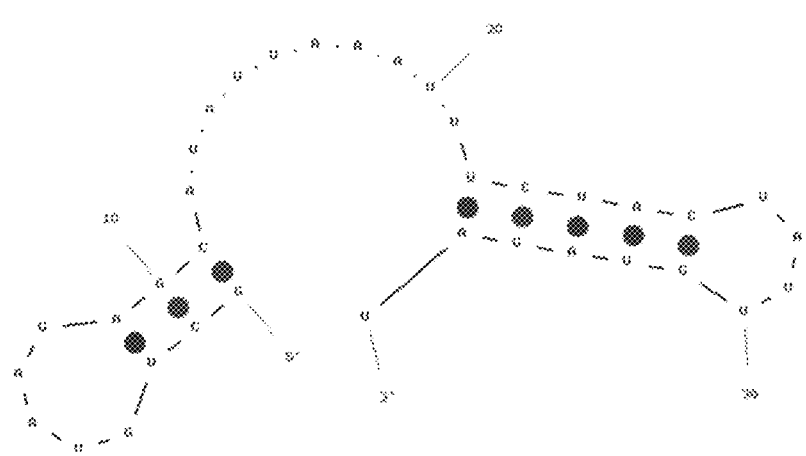
Figure 13C:
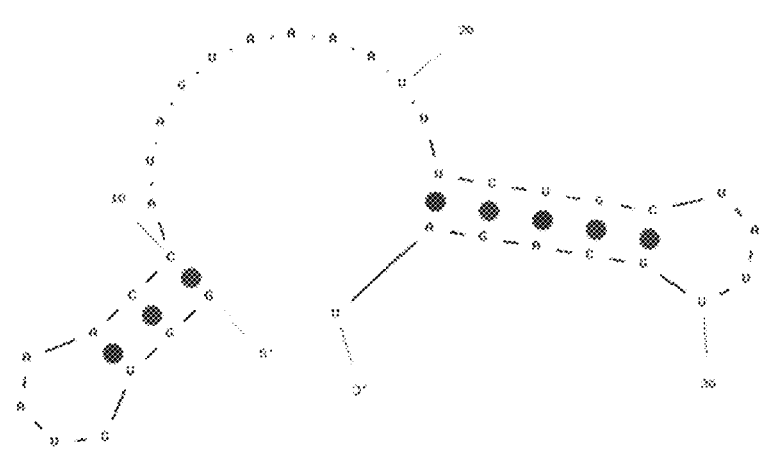
Figure 13D:
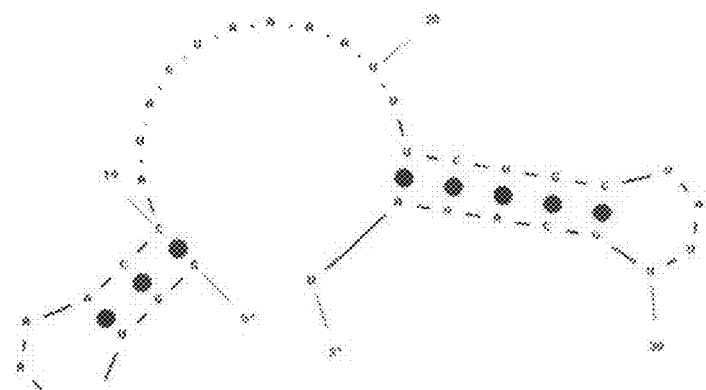
Figure 13E:
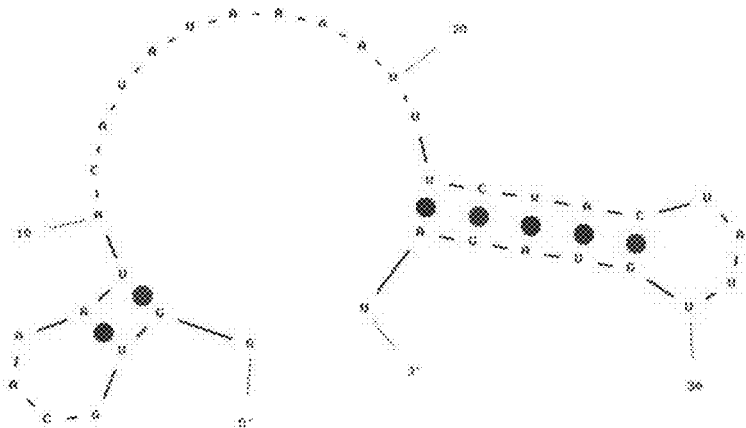
Figure 13F:
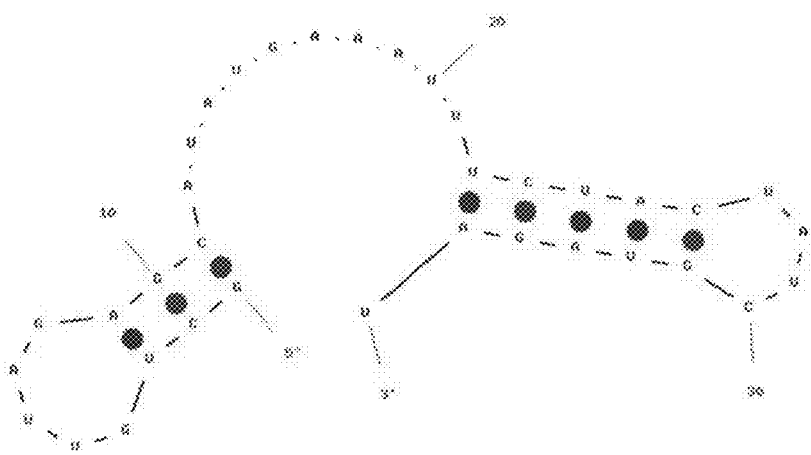

| SEQ ID NO | Sequence | FIG |
|---|---|---|
| 423 | GGUGUAAGACCAUAUUAAAUUUCUACUAUUGUAGAU | FIG. 13A |
| 424 | GCUGUAAGAGCAUAUUAAAUUUCUACUAUUGUAGAU | FIG. 13B |
| 425 | GGUGUAAACCAUAGUAAAAUUUCUGCUAUUGCAGAU | FIG. 13C |
| 426 | GGUGUAAACCAUAGUAAAAUUUCUGCUAUUGCAGAU | FIG. 13D |
| 427 | GGUGCAAAUACAUAUAAAAUUUCUACUAUUGUAGAU | FIG. 13E |
| 428 | GCUGUUAGAGCAUAUGAAAUUUCUACUAUCGUAGAU | FIG. 13F |

TABLE S13E

Consensus Sequence Group 13

| SEQ ID NO | Consensus Sequence |
|---|---|
| 429 | MLNLNYYLFYFVSLWQDNEYLKPITMKDLKQFIGIYPVSKTLRFELRPIGKTQEWIEKNKVLEXDEQKAEDY PXVKXLIDEYHKVCIXESLKXVHPDWAPLRXAIEEYQQXKSDESKKXLEAEQTXMRKQIAXAIKDFRHYKELZ TAXTPSKLIXSVLPXXXXDDALKSFNXFAXYFEGFQENRNNIYSSEAISTGVPYRLVHDNFPKFLANIEVXENI KXTCPEVIZQAATEMQPPFLEGVMIXDIFTLDFYNSLLTQDGIDFXNQVLGGVAEEGKQKYRGINEFSNLYR QQHPELXAKKKALTMXPLFKQILSDRETLSYIPQQIESEQQLIEVIXQFYXHITDFEXNGKTXNVLKELXALXG XIDTYNPDGIFXSAKSLTDVSQKLXGKWXIINEKLYEKAVEQFGDVSVVKNKKKVDAYLSKDAYXLSELXFD DDXSISQYFSELPQXLXAINSXWLQFXEWCKXXEKQKFLNNXXGTEXVKXLLDAXMEXLHKCSVLVVXEEY |

TABLE S13E-continued

Consensus Sequence Group 13

| SEQ ID NO | Consensus Sequence |
|---|---|
| | XLDKDFYNXFLPLYAELENVILXYNRVRNXLTKKPSDTKKFKLNFXTPSLGDGWXQNKERKNKAILLFKDGL<br>SYLGIMNXKGTLXFZBXKXEAXESSYKKMVXKLLSKPYXDLPHXFFSKKGIDXXHPSERILXIYEZGXFKKGSP<br>NFDIKFLHDLIDFYKDAIXRHXDWSKFNFQYSPTESYEDIGXFYSEXAKQAYKIRFXDIXEXQVNEWVENGQ<br>LYLFQLYNKDYAEGAHGRKNLHTLYWENLFXXENLSNLVLKLXGQAELFYRPQSIKKPVSHKVGSKMLNRR<br>DKSGMPIPEAIYRSLYQXXNGKKAESELTAAEKAYIDQVIVKDVTHEIIKDRRYTKQEYFZFHVPIXFNANAD<br>GNEYINEXVLXYLKDNPDVNIIGIDRGERHLIYLTLINQRGEILKQKTFNVVGNYNYQAKLEQREKERDEAR<br>KSWQSVGKIKDLKEGFLSAVIHEIAKMMIENNAIVVLEDLNFGFKRGRFKVERQVYQKFEKMLIDKLNYLS<br>FKDREADEEGGILRGYQLXQKFXSFQRLGKQSGFLFYIPAAYTSKIDPVTGFVNHFNFNDITNAEKRKAFLM<br>KMERIEMKNGNXEFEFDYRKFKTYQTDYQNVWTVNTSGKRIVXXXXDXXXXKMKDXYPTKEIVQAFKNK<br>GITLEEGXDLKALIADIEANAKNASFFGTLFYAFQKTLQMRNSNAATEEDYILSPVAXBGKQFCXTDEANK<br>GKDADGNWVSKLPVDADANGAYHIALKGLYLLXNPQTKKIENEKWXQFMVEKPYLE |

Wherein:
each X is independently selected from any naturally occurring amino acid; and
each Z is independently selected from absent and any naturally occurring amino acid.

TABLE S13F

Native Nucleotide Sequences Group 13

| SEQ ID NO | Corresponding AA | Sequence |
|---|---|---|
| 430 | 399 | ATGAAAGACCTAAAACAATTCATCGGCTTATATCCTGTATCAAAGACATTGCGCTTTGAGT<br>TGAGACCTGTGGGCAGAACGCAGGAGTGGATGGAAAAGAATCATGTGTTGGAACATGAT<br>GGCAAAAGGGCTGAGGATTATCCCAGAGTGAAGGAACTAATAGATGCTTACCACAAAAT<br>ATGCATCAGCAACTCGTTGAAAGTGTCTGATATTAATTGGACTCCGTTGCGAGATGCCATT<br>GAAAAGAATCGCCAAGAGAAGTCTGACGAGTCAAAAAAGGCATTGGAGGAAGAGCAAA<br>CCAAGATGCGCCTTGAGATATGCAAGAAGCTGGCTAAGTTTGAACACTATCAGGAACTGG<br>TAAAAGCCGATACGCCATCTAAGCTTATTAACGGTATTCTTCCTCATGATAAGGCTTTAGAT<br>ACGTTCAACAAGTTTGCTGTTTACTTTGAGGGCTTTCAGGAGAACAGGAGAAATATCTATA<br>GTAGTGAAGCTATCAGTACGGGCGTTGCTTATAGACTTGTTCACGATAATTTCCCAAAGTT<br>CCTGGCCAATATTGAGGTGTTTGAAAACATCAAGGAGATTTGTCCAGAAGTCATCCAACA<br>GGTAGCTACAGAAATGGCTCCATTCCTTGAAGGTGTTATGATTGAGGATGTATTTACTGTC<br>AGCTACTATAATGCCGTTTTAACTCAAAATGGTATAGATTACTATAACCAGATTCTGGGCG<br>GAGTGGCAAAAGATGATCAGAAGTATCGTGGCATCAATGAGTTTATAAACTTATACCGTC<br>AGGCTCATCCAGAGTTGGCTACAAAGAAGAAGTCGCTAACGATGGTGCCACTCTTCAAGC<br>AGATTTTGTCAGACAGAGAAACACTTTCAGATATAGTTCGCCCCGTTGAATCAGAGAACT<br>AGCTGATAGAGGTGATAAACAATTTCTATCAACGCATTACTAACTTTGATATTAATGGAAA<br>GAATGTCAACGTCGTTAAAGAACTGACCGATTTGGTTTTAAGTATTGATACGTATAACCCT<br>GAAGGTATCTTTATTTCAGCCAAATCAATAACCGATGTATCTCATTCCTTATATGACCATTG<br>GAATAGAATTAACGAGAAGCTTTATGACAAGGCTGTGGAGGCAATTGGAGGTGTTCAGA<br>CAGTGAAGAACAAAAAGAAGGTGGAGGCTTATTTGAAAAAAGATGCCTATACGCTTTCTG<br>AACTGAGCTTTGGCGATGATGTTTCTATCTCTCAGTATTTCTCTGCATTAACGAATTCCACT<br>GACTCCATCAATAGCTTATGGTTGCAATTTCAGAGTTGGTGCAAGTCGGCAGAGAAACCA<br>CAATTCGTCCATAATGAGGTTGGTACGGAATACGTAAAGATGCTGTTGGATGCTATCATG<br>CTTGTATTGCACAAGTGCGGAGCACTTCTGGTATCCTTGGAAAACGAATTGGACAGCGAC<br>TTCTATAACAAGTTCCTGCCGCTCTACGCAGAACTGGAGAATGTGATATTGGTTTATACAA<br>GAGTAAGGAACTTCCTCACCAAGAAGCTTTCTGATACAGGCAAGATAAAGCTGAAGTTCG<br>ATACACCCTCGCTTGGTGCTGGATGGGGCATCAATAAAGAGAAGACGAATAAAGCTGTAT<br>TATTGTTCAAGGACGGATTATCATATCTGGGTATTATGAACGTCAAAGGCACGTTAGACTT<br>TAATTGCAAGATAGAAGCTGACGAGCCGACGTTCAAGAAAATGGTTTGCAGAAACTATTC<br>CAAACCTTACATGGACCTGCCTAATTCATTCTTCAGCCAGAACGGAATAAGCAAGTTCCAC<br>CCGTCTGAGCGAATCCAAAAGATATATTTTGCATTCAAAGAGAATTCAAAAAACGTTGATA<br>TCAAGAAGGTGCACGAACTGATAGATTACTACAAAGATGCTATCAGTCGCCATGAAGATT<br>GGGGATCATTTGGCTTTAAGTATTCTCCCACAGAATCCTACGAGACCATCAATGATTTCTAT<br>ACAGAGGTGGCTGCGCAATCATACAAACTTCGTTTCATAGAAGTTCCCCAAAAACAAGTT<br>GACGAGTGGGTTGAAGAAGGAAAACTCTACTTGTTCCAACTATATAACAAAGATTATGCA<br>GAGGGCGCTCATGGTCGCAAGAATCTTCACACGATGTATTGGGAGTGCCTCTTCTCTGAA<br>GAAAATCTCAGCAACCTGTTCATCAAGTTGGGAGGTCAGGCAGAATTGTTCTATCGCCCAC<br>AAAGCATCAAGAACCAGTATCACATAAAGTTGGCACGAAGATGCTGAATCGCAGAGCG<br>AAGGACGGAAAGCCTATACCAGATGCTATATATCGTAGTCTCTATCAGTATTTCAATGGCA<br>AGAAAGCGGAAGCAGAACTGACCACAGAAGAAAAGGCCTATATCAGCCAGGTCATCGTG<br>AAGGATGTGCATCACGAAATCATCAAGGACAGACGTTACACCAAGCAGTTCTTCTATCAAT<br>TCCACGTGCCTATCGTGTTTAATGCAAATGCTCCCCAAAGACCGAAGATTAATGAGAGGG<br>TTTTGGAATACATCAAGGAGAATCCAGACGTAAACATCATCGGAATAGACCGTGGTGAGC<br>GCCACTTGGTTTATCTTACCCTTATCAATCAGCGAGGAGAGATTCTGAAGCAGAAGACCTT<br>CAACGTTGTTGGCGATTACAACTATCAGGAGAAACTAAAGCAGCGCGAAAATGAACGAG |

TABLE S13F-continued

Native Nucleotide Sequences Group 13

| SEQ ID NO | Corresponding AA | Sequence |
|---|---|---|
| | | ACCAAGCGCGAAAGAGCTGGCAGAGCGTAGGTAAAATCAAGGACCTGAAAGAAGGTTTC<br>CTTTCTGCTGTTGTGCATGAGATAGCCAAGATGATGATAGAAAATAATGCCATCGTGGTTC<br>TTGAAGACCTGAATTGGGGATTCAAGCGTGGCCGTTTCAAGGTGGAACGCCAGGTGTATC<br>AGAAATTCGAGAAGATGCTGATTGACAAACTGAACTACCTGTCGTTCAAAGATGTAGATA<br>CGTCAGATGAAGGTGGCATTCTTCGTGGTTACCAATTAACAGAGCCGGTGGCTAACTATA<br>CGGATATTGGCAAACAAACGGGCTTCCTTTTCTATATTCCTGCTGCCTATACGTCAAAGATT<br>GATCCTGCAACGGGGTTTGTTAACCACTTCAACTTCAACGACATCACCAATGCCGAGAAGC<br>GCAAAGAATTCTTCATGAAGATGGAGCGGATTGAGATGAAGAACGGCAACGTGGAGTTT<br>GAGTTTGACTATCGCAAGTTCAAAACCTATCAGACGGACTTCCAGAACGTGTGGACAGTT<br>AATACCTCTGGTAAGCGTATCGTCTTCGATACTGAGAAGAGGGAGCACAAAGCTGTTTAT<br>CCTACGCAGGAATTTGTGCAGGCTTTTGGCAATAAGGGTATAACGCTTGAAGAAGGAATG<br>GATATCAAGGCGTTTATTGGGGGAATCGAAGCTGACATCAAGAATGCGTCATTCTTCAGT<br>TCACTCTTCTATGCGTTCAAGACTACTCTGCAGATGCGTAACAGTAATGCCGATACAAGAG<br>AGGACTATATCCTTTCGCCCGTAGTTCATGACGGCAGGCAGTTCTGTTCTACAGACGAAGT<br>CAACAAGGGCAAGGACGCAGACGGCAATTGGATATCAAAACTACCTGTAGATGCCGATG<br>CCAATGGTGCATACCACATCGCTCTGAAGGGTCTCTACCTACTAATGAACCCGCAA<br>ACAAAGAAGATAGAAAACGAAAAATGGCTCCAGTTCATGGCCGAAAAGCCGTATAAGGA<br>GTAA |
| 431 | 400 | ATGTACGACCTGAAACAATTTATCGGCATATATCCAGTTTCAAAGACGTTGCGCTTTGAGT<br>TGAAACCTATTGGCAGAACGCAGGAATGGATCGAGAAGAATCATGTGCTGGAACATGAT<br>TGGAAGAGGGCTGAGGATTATCCCAGAGTGAAGGAGATGATTGATGTTTACCACAAATT<br>GTGCATCAGCAAGTCGTTGAAAAACATGGATTTTGACTGGGAACCCCTGCGCGATGCAAT<br>TGAGCGGAATCGTCAGGAGAAGTCAGACGAATCGAAGAAAGAATTGGAGGCAGAGCAG<br>ACCAGGATGCGCAACAAGATACATGATCAGTTATCAAAATTTGAACATTACAAAAAGCTC<br>AACGCCGATACGCCATCGTTGCTGATTAATCACATTCTGCCCCAAGAAGATGCCTTGGAGA<br>GCTTCAAGAAGTTTGCTACGTATTTTGAGGGATTTCAGAAGAACAGAAAGAACATTTACA<br>GCAAGGAGGCCATCAGTACTGGTGTACCATACCGACTTGTACACGACAACTTCCCTAAGTT<br>CTTAGCAAACATTGAGGTCTTTGAAAACTTACAGGAGCTCTGCCCTGAAGTCATTCGGCAG<br>GCCGCTACAGAAATGGCACCTTTTCTGCAAGGAGTCATGATAGAGGATGTATTTACCGTC<br>GGCTTTTATAACGCTATACTGACGCAAGATGGCATTGATTTTTATAATCAGATTCTGGGTG<br>GAGTGGTAAAAGACGAACAACACTATCAAGGTATTAACCAATTGACGAATCTCTACAGAC<br>AGGCTCATCCAGACCTTACCGCCAATAGGAAATCGATGACAATGGTGCCGCTCTTCAAGC<br>AGATTCTGTCAGACCGCGAAACGCTTTCAGATATTGCCAAGCCTATCGAGTCGGAAGAAC<br>AACTGATAGAGGTTGTAACCAGTTTCTACCATCGCGTTACGGATTTCACACTCAACGGAAA<br>CAGCATCAACATCATCGACGAGCTAGCGACTCTCGTGCAAAGTCTCAATACCTATAATCCT<br>GAGGGAATATTCGTTTCGGCTAAGTCATTGACAGATGTCTCTCATACGTTGTATGGGCATT<br>GGAACAAGATCAACGAAAAACTCTATGAAAAGGCTGTCGAATTGTTTGGTGATGTTCAGG<br>TGGTCAAAAACAGAAAGAAGGTAGAGGCTTATCTGAACAAAGACACATACACACTCGCA<br>GAACTGAGTTTCGGCGACGATATTTCCATTGCACAATACTTCGAAAACATCTCTGGTTCCG<br>CTGATGCCACAAACAGCCTTTGGGTACAATTCCAAAGCTGGTGCAAAACGGCAGAGAAGC<br>CAAAATTCGTACACAACGAGGCTGGTACAGAACTCGTTAAGATGCTGTTGGATTCCATCTT<br>GAACGTACTGCACAAATGCTCAGTTTTGGTTGTATCGATGGAAAACGACTTAGACAAAGA<br>CTTCTACAATAAGTTCTTGCCTCTCTATGCTGAATTGGAGAATGTGATATTGTTATATAACA<br>GGGTGCGAAATTTCCTCACGCAGAAGCCATCGAGTACGGGCAAGATAAAACTGAAGTTC<br>GACATCCCTTCGCTTGGCGCTGGTTGGGGCATCAACAAGGAAAAGAAGAATAAGGCAAT<br>ATTGCTATTCAAAGATGGACGTTCTTATCTTGGCATTATGAATGTTAAAGGAACGTTAGAT<br>TTTGACTGCAAAGCAGAACATGCGGAGCCTACATACAAGAAAATGGTTTGCGTAAACCAT<br>TCCAAGCCTTACATGGATTTGCCCAATTCATTCTTCCGTCAAACAGGCATTGACAAGTATAA<br>GCCTTCAGAGCGCATCTTGAAAATCTATGAGGCATTTAAGAAAGATTCAAAGAGTGTAGA<br>TATCAATGAGGTGAGAGAACTTATAGACTATTACAAGGATGCTATCACCAGAAATGAAGA<br>CTGGAATTCTGTTAGCTTCACTTATTCTCCCACGGAAACCATTGAAACCATTGACGACTTTT<br>ATAAGGAGGTCGCCAAACAATCCTATCAAGTCAGTTTTAAGGACATATCCCAAAAACAGG<br>TTGACGAATGGGTTGAAAAGGGGCAGTTATATCTCTTCCAGCTTTACAACAAAGATTATGC<br>AGAAGGTGCTCATGGGCGCAAGAATCTTCATACCCTGTATTGGGAAAGTCTCTTTACTGCT<br>GAGAATCTAAGCGACATAGTTATAAAGCTGGGAAGCAACGCAGAATTATTCTATCGTCCG<br>CAGGCCATTAAGAAACCTGTAAAACACGAGGTAGGCACAAGATGCTAAACCGCAGGGA<br>TAATAGCGGAAAGCCTATACCTGATACCATCTATCGTAGCCTCTATCAGTTCTACAACGGC<br>AAGAAAGCAAAAGCAGAACTGACGGCAGAAGAGCGTGCTTACATCAGTCAGGTGATAGT<br>GAAAGACGTGCAGCACGAAATCATCAAGGACCGCCGATACACCAAGCAGTTCCACTACCA<br>GTTCCACGTACCTATCGTGTTTAATGCGAATGCCAATGGGAAGGTCAAGTTCAACGACAA<br>GGTGATGGACTACATCCAGGATAATCCTGATGTCAACATCATCGGAATAGACCGTGGTGA<br>GCGTCATCTGATTTATCTGACATTAATAAACCAACGCGGCGAGATTCTGAAGCAGAAAAC<br>CTTTAATGTGGTAGGCAACTATGACTATCAGGAGAAGCTGAAGCAGCGTGAGAAGGAGC<br>GCAACGAAGCCCGTAGAAGCTGGCAGAGCGTAGGTAAGATTAAGGATCTGAAAGAAGGT<br>TTTCTGTCAGCTGTGGTTCACGAGATAGCCCAGATGATGATTGAACATAACGCAATCGTCG<br>TGCTCGAAGACCTGAATCGCGGTTTTAAGCGCGGCCGCTTCAAGGTGGAACGTCAGGTGT<br>ATCAGAAGTTTGAGAAGATGCTGATAGACAAGCTGAACTATCTGTCGTTCAAAGACCGCG<br>AGATTGCTGATGAAGGCGCATCTTGTGTGGTTACCAACTGACGGAAAAGACATTGAACT<br>ACTCTGACATTGGTCGCCAGACTGGATTCTTGTTCTACATTCCTGCAGCCTACACGTCGAA<br>GATTGACCCTGTAACGGGGTTTGTCAACCACTTCAACCTGAACGACATCACCAATGCCGAA<br>AAGCGCAAAGCATTCCTAATGAAGATGGAGCGCATCGAGGTGAAGAACGGCAACGTGGA<br>GTTTGAGTTCGACTATCGTAAGTTCAAGACGTTCCAGACGGATTTCCAAAATGTGTGGACT<br>GTCAATACCCTCAGGCAAGCGCATCATATTCGACACAGAGACGCGAAAAGCGAAGGATGTT |

TABLE S13F-continued

Native Nucleotide Sequences Group 13

| SEQ ID NO | Corresponding AA | Sequence |
|---|---|---|
| | | TATCCTACAAAAGAGATTGCTCAGTCTTTTGCCAATAGAGGCATTGCTCTTGAAGAAGGAA<br>TGGACCTGAAAGCAATCATTGCAGAGGTTGAGCCGGATGTCAAGAATGCTGCGTTCTTTA<br>AGTCTTTGTTTTATGCATTTGAAAACACCTTGCGAATGCGTAATAGCAATACTGAAACGCA<br>AGAAGATTATATCCTGTCGCCAGTCGCTATCAACGGCAAACAGTTCTGCACTACGGACGA<br>AGCAAACAAGGGTAAGGATGCCGATGGCAATTGGCTTTCCAAACTCCCTGTTGATGCCGA<br>CGCCAATGGTGCCTATCACATTGCCCTCAAGGGTCTCTACCTGCTAAATAACCCTCAAA<br>CAAAGAAGATAGAAAACGAAAAATGGTTCCAATTTATGATTGAAAAGCTCTATTTAAAGT<br>AA |
| 432 | 401 | ATGAAGGACTTAAAACAATTTATCGGCATATATCCAGTATCAAAGACTTTGCGCTTTGAGT<br>TAAGGCCTGTAGGCAAAACCCAGGAATGGATAGAAAAGAACAGGGTGTTGGAAAATGAT<br>GAGAGTAAGGCTGCGGATTACCCTGTGGTCAAGAAACTCATTGACGAGTATCATAAGGTT<br>TGCATTCGCGAATCCATGAAAGATGTCCATCTTGACTGGGCACCTCTAAAGGAGGCCATG<br>GAGGAATATCAGAAGAAGAAAAGCGATGATGCCAAGAAACGCCTGGAGGCAGAACAGA<br>CGATGATGCGCAAACGAATTGCTACTGCAATCAAGGATTTCAGACATTACAAGGAACTGA<br>CGGCAGCAACTCCCAGCGATTTGATTACATCAGTATTGCCAGAGTTCAGTGATAATGAGG<br>CTTTGAAATCATTTCGAGGATTCGCTTCCTATTTCATAGGCTTCCAAGAGAATCGGAACAA<br>CATCTATAGTCCTGATGCTATCAGTACGGGTGTCCCATATAGATTGGTGCATGACAATTTC<br>CCCAAATTCTTATCCAATCTGGAAGTTTATGATAAGATCAAGGCCACTTGTCCTGAGGTCA<br>TCCAACAGGCATCAGAGGAAATACAGCCTTTCTTGGAGGGTGTGATGATTGATGATATCT<br>TCTCGCTTGATTTTTATAACTCTCTGCTAACACAGGATGGCATTGACTTCTTTAACCGTGTG<br>ATTGGTGGTGTGAGCGAAGAGGATAAGCAGAAATATCGTGGCATCAACGAGTTCTCTAA<br>CCTCTATCGCCAGCAGCATAAGGAACTGGCTGGTTCCAAGAAGGCCTTGACGATGATTCC<br>ATTGTTTAAGCAGATCTTGTCTGATCGTGACACCTTGTCATATATCCCTGCTCAGATAGAAA<br>CGGAAAATGAACTCATGACCTCTATAAGCCAATTCTATAAGCACATCACCTATTTCGAGCG<br>TGATGGAAAAACCATCAACGTACTAAATGAATTGGTGGCTCTGCTAAGCAAGATTGATAC<br>TTATAATCCAGATGGTATTTGTGTTACAGCTAACAAACTGACTGATATCTCGCAGAAGGTA<br>TTCGGCAAGTGGAGTATCATCGAAGAGAATCTGAAGGAAAAGGCTGTCCAGCAATTTTGC<br>GACATCTCTGTAGCCAAGAATAAGAAAAGGTGGATGCCTATCTTTCGCGTAAGGCTTAT<br>TGTCTTTCTGACTTGTGCTTTGATGACGAGTTCCATATTTCCCAATATTTTTCAGATCTTCCT<br>CAAACGCTCAATGCCATTGAAGGCTATTGGCTGCAGTTTAATGAATGGTGCAAAAACGAT<br>GAAAAGCAGAAGTTCCTGAATAATCCAGCGGGTACGGAAGTTGTGAAGAGCCTCCTGGA<br>TGCCATGATGGAACTCTCTCACAAATGTTCCGTTCTGGTGATGCCAGAAGAGTATGAGGT<br>GGACAAGAGTTTCTATAATGAGTTCATCCCCCTTTATGAGGAACTTGACACGCTCTTCCTTT<br>TATATAATAAGGTAAGGAACTACCTTACTCGGAAGCCTTCTGATGTCAAGAAGTTCAAACT<br>CAACTTTGAAACTCCATCATTAGCTGACGGATGGGATCAGAACAAGGAAAGAGCTAACAA<br>GGCTATTCTGCTTTTCAAAGACGGGTTATCCTATTTGGGAATCATGAATGCCCAGAACATG<br>CCAAACCTGAATCAAAAATGGTCAGCGGATGAAAGCCATTATAGTAAGATGGTTTACAAA<br>CTGATACCTGGTCCTAACAAGATGTTGCCAAAGGTGTTCTTCTCCAAGAAAGGACTCGACA<br>TATTCAATCCGTCCAGACATATCTTGAGAATCAAGGAGGAAGAGACCTTCAAGAAAGGCT<br>CTCCCAATTTCAAACTTGCTGACCTGCATGACCTGATTGATTTCTATAAAGATGGGATTAAC<br>CGTCATCCGGACTGGAGCAAGTTCAATTTCCAGTTTGCTGATACTAAGGCGTATGAGGAT<br>ATTGCAGGTTTCTATCGTGATATAGCTAATCAGGCATACAAGATTACATTCTCGGATATCC<br>CTGTCTGGCAAATCAACGACTGGATTGATAATGGCCAGTTATATCTGTTCCAACTCTATAA<br>TAAGGACTATGCTGAGGGCGCTCACGGACGAAAGAATCTTCATCACACTCTATTGGGAAAA<br>TCTATTCACAGACGAGAATCTCAGCAACCTGGTGCTGAAACTAAATGGCCAGGCGGAGTT<br>GTTCTGTCGCCCTCAAAGCATTAAGAAACCCGTATCGCATAAGATGGGCTCGAAGATGCT<br>CAATCGTAGGGACAAGAGTGGAATGCCGATACCAGAATCCATCTATCGCAGCCTGTATCA<br>GTTCTATAATGGCAAGAAGAAAGAAAGCGAACTGACAGCTGCAGAAAAGCAGTATATGG<br>ATCAAGTCATCGTGAAGGATGTCACCCACGAGATTATCAAAGATCGCAGATATACCAGAC<br>AGGAATACTTCTTCCATGTACCTCTTACATTCAATGCGAATGCAGAAGGTAATGAGTATAT<br>CAATGAGAATGTGCTGAATTATCTGAAAGACAATCCTGATGTGAATATCATTGGTATCGAT<br>CGTGGTGAGCGTCATCTCATCTATCTCACACTGATTAATCAGCGTGGAGAAATCTTAATGC<br>AGAAGACGTTCAACGTAGTGAATAGCTACAATTACCAGGCAAAGTTGGAGCAGCGCGAA<br>AAAGAACGTGACGAGGCCCGTAAGAGTTGGGATAGTGTAGGTAAAATCAAAGACCTGAA<br>AGAAGGGTTTCCTTTCTGCTGTTATCCACGAGATTTGCAAGATGATGATCGAAAACAATGCC<br>ATCGTGGTATTGGAGGATTTGAACTTTGGATTCAAACGCGGTCGTTTCAAGGTAGAGCGT<br>CAGGTCTATCAGAAGTTCGAAAAGATGCTGATTGATAAACTGAACTATCTTTCCTTTAAGG<br>ATCGTGAGGCCGAAGAGGATGGTGGTATACTCAGAGGCTATCAGATGGCACAGAAGTTT<br>GTCAGCTTCCAGAGACTTGGTAAGCAGAGCGGCTTCTTGTTCTATATCCCTGCTGCCTATA<br>CCTCAAAGATAGATCCCATAACTGGTTTTGTGAATCATTTCAACTTTAACGATATCACAAAT<br>GCTGAGAAGCGAAAAGAATTCCTGATGAAGATGGAACGCATTGAGATGAGAAATGGAAA<br>TATCGAGTTTGAATTCGACTATCGTAAGTTTAAGACTTTCCAGACGGACTATCAAAACCTTT<br>GGACGGTCAGTACCTATGGTAAGCGAATCGTGATGCGAATAGACGATAAAGGATATAAA<br>CAGATGGTTGACTACGAGCCAACAAAGGATATTGTCAATACCTTTAAGAACAAAGGCATA<br>CAACTGACAGAAGGTTCTGATCTTAAAGCCCTGATTGCTGATATTGAGGCTAATGCTACCA<br>ATGCTGGCTTTTTCAACACCTTGCTTTATGCATTCCAGAAGACCTTGCAGATGCGTAATAG<br>CAATGCTGCAACGGAAGAAGATTTTATTTTCTCGCCAGTAGCCAGAGACGGGCGCTACTT<br>CTGCAGTATGGATGAGGCTAACAAGGGCAGAGATGCACAAGGCAACTGGGTATCAAAGC<br>TTCCTATTGATGCAGATGCGAATGGTGCCTATCATATTGCTTTGAAGGGACTATACTTGCT<br>CAGAAATCCAGAAACGAAGAAAATAGAAAACGAAAAATGGCTCCAATTTATGGTAGAGA<br>AACCGTATTTGGAGTAA |

TABLE S13F-continued

Native Nucleotide Sequences Group 13

| SEQ ID NO | Corresponding AA | Sequence |
|---|---|---|
| 433 | 402 | ATGCTCAATTTGAATTATTATCTATTTTATTTTGTATCTTTGTGGCAAGATAATGAATATTTA<br>AAACCTATTACAATGAACAACTTAAAACAATTTATCGGCATATATCCTGTTTCAAAGACCTT<br>GCGCTTTGAGTTGAGACCTATTGGTAAGACACAAGAATGGATAGAAATTAATAAGGTTTT<br>AGAAGGTGATGTACAGAAAGCCGCAGATTATCCTACGGTCAAGAAGCTTATTGATGAGTA<br>CCATAAAATTTGTATTCATGACTCTTTAAAAAACGTTCACTTTGATTGGGCTCCTTTGAAAG<br>AAGCTATTGTCATTTTTCAAAAGACCAAGAGTGACGAGTCCAAGAAACGACTTGAGGCAG<br>AGCAGACCATCATGCGTAAACAGATTGCTGCTGCAATCAAGGATTTCAAGCATTTCAAGG<br>AGTTAACAGCTGCAACCCCCAGCGATTTGATTACCTCAGTCCTTCCTGAATTCAGCGATGA<br>TGACTCATTGATGTCTTTCCGTGGCTTTGCTACCTATTTCAGCGGGTTTCAAGAGAACAGA<br>ATTAATATCTATAGTCAGGAATCCATCAGTACGGGAGTTCCTTATAGAATAGTACATGATA<br>ACTTTCCTAAGTTCCTTTCTAACCAGGAGGTCTATGACAGAATCAGGTCTGTATGCCCAGA<br>AGTTATCAAGCAGGCATCAGAAGAGTTACAGCCTTTTTAGAAGGGGTAATGATCGACGA<br>TATATTTTCACTTGATTTCTATAATTCTCTATTGACTCAGGACGGAATAGATTTCTATAACC<br>GTGTAATTGGTGGTGTGAGCGAAGAAGGTAAACAGAAATATCGTGGAATCAACGAGTTC<br>TCAAATCTCTATCGTCAACAGCACAAAGATCTTGCAGCCTCCAAGAAGGCTATGACGATGA<br>TACCTCTTTTCAAACAGATTTTGTCTGATCGTGAAACTTTGTCATACATTCCTGTACAGATA<br>GAATCAGAAGATGAGCTAGTATCTTCTATCAAACAATTCTATGAGCATATTACCCACTTCG<br>AGCGGGATGGAAAAACGGTCAATGTGCTATCAGAATTGGTGGCTGTGCTGGGGAATATA<br>GACTCATATAATCCTGATGGTATATGTATATCAGCCAGCAAACTGACAGACATATCTCAGA<br>AGGTATATGGCAAGTGGAGCATTATCGAAGAGAAACTGAAAGAAAAGGCTATCATGCAG<br>TATGGTGACATCTCTGTAGCCAAGAATAAGAAGAAAGTAGATGCATATCTTTCACGTAAA<br>GCCTATTGCTTGTCTGATTTGTGTTTTGACGAGGTTGTCAGTTTCTCACGCTATTACTCTGA<br>ATTACCACAAATGCTCAATGCTATTAATGGCTATTGGATGCAGTTTAACGAATGGTGTAGG<br>AGTGATGAAAAACAGAAGTTCCTTAATAACCCAATGGGTACTGAAGTGGTGAAGTGTCTG<br>TTAGATGCAATGATGGAGCTATACCATAAGAGCGCAGTCTTGGTAATGCCAGAAGAGTAC<br>GAGGTTGACAAGAGTTTCTATAACGAATTCATACCCCTCTATGAGGAACTTGATACACTCT<br>TCCTGTTATATAATAAGGTAAGGAATTACCTCACTCGAAAACCATCTGACGTTAAGAAGTT<br>TAAACTAAATTTTGAGTCGCCTTCATTGGCAAGTGGATGGGACCAGAATAAGGAAATGAA<br>GAATAACGCGATTCTTCTTTTCAAGGATGGTAAATCGTATTTAGGTGTTTTAAATGCCAAG<br>AACAAAGCAAAGATAAAAGATGCCAAGGGCGATGCGTCATCTTCTTCATATAAAAAAATG<br>ATTTACAAACTTCTGTCTGATCCGTCAAAGGATCTGCCCCATAAGTTATTCGCTAAGGGTA<br>ATCTTGATTTCTACAAGCCATCAGAGTATATCTTAGAAGGAAGGGAATTGGGTAAATACA<br>AGAAAGGACCAAATTTTGACAAGAAGTTCCTTCATGACTTTATAGATTTCTACAAGGCGGC<br>AATTGCTATTGATCCTGATTGGAGCAAGTTCAACTTCCAGTATTCTCCAACGGAGTCGTAT<br>GAGGATATTGGTGCCTTCTTTAGTGAAATCAAGAAGCAGGCTTACAAGATTCGTTTTACTG<br>ATATAACAGAGTCTCAGGTGAACGAGTGGGTTGATAATGGTCAGTTGTATCTGTTCCAGC<br>TGTATAATAAGGATTATGCAGAAGGGGCTCATGGACGAAAGAATCTGCATACACTCTATT<br>GGGAGAATCTTTTTACTGATGAGAATTTGAGTAATCTGGTTCTGAAACTAAATGGTCAGG<br>CAGAATTGTTCTGCCGTCCTCAGAGTATCAAGAAGCCTGTGTCGCATAAGATTGGTTCGAA<br>GATGCTGAATCGTAGGGATAAGAGCGGTATGCCCATACCAGAAAATATCTATCGCAGTTT<br>GTATCAGTTCTATAATGGTAAGAAGAAAGAGAGTGAGCTAACAACTGCAGAAAAGCAGT<br>ATATGGATCAGGTGATAGTGAAGGATGTTACCCACGAAATCATTAAAGACCGCAGATACA<br>CCAGGCAAGAATACTTCTTCCATGTACCTCTGACGTTAAATGCCAATGCTGATGGTAATGA<br>GTATATTAATGAGCAAGTGCTGAACTATCTGAAGTATAATCCTGACGTGAATATCATAGGT<br>ATTGACCGTGGTGAACGTCATCTGATTTACCTCACATTGATTAATCAGCGTGGAGAAATCA<br>TAAAGCAGAAGACTTTTAACATTGTGAATAATTACAACTATCAGGTCAAGTTGGAACAGC<br>GAGAAAAAGAACGCGACGAGGCTCGTAAAAGTTGGGATAGTGTTGGTAAAATAAAGGAT<br>TTGAAAGAAGGCTTTCTTTCTGCCGTTATCCATGAGATAACTAAGATGATGATTGAAAACA<br>ATGCCATCGTGGTTCTTGAGGATTTGAACTTTGGTTTCAAACGTGGTCGTTTTAAAGTGGA<br>GCGTCAGGTATATCAGAAGTTCGAGAAAATGCTGATAGATAAGCTGAATTATCTGTCATTT<br>AAGGATCGTGAGGTAGGCGAAGAAGGAGGTATACTTAGAGGTTACCAGATGGCACAGA<br>AGTTTGTTAGTTTCCAGAGATTAGGTAAACAGAGTGGTTTCTTGTTCTATATTCCTGCAGCT<br>TATACCTCCAAGATAGACCCTGTGACAGGCTTTGTAAATCATTTCAACTTCAACGATATCAC<br>CAATGCAGAAAAGCGAAAAGACTTCTTGATGAAGATGGAGCGCATTGAGATGAAGAATG<br>GATATATAGAATTTACATTCGACTATCGTAAGTTTAAGACTTACCAGACAGACTATCAAAA<br>CGTTTGGACCGTAAGTACTTTCGGAAAACGAATTGTGATGCGAAATAGACGAAAAAGGATA<br>TAAAAAGATGGTGGATTACGAACCAACAAACGATATTATTTATGCCTTTAAGAACAAAGG<br>CATCCTGTTGTCTGAGGGTTCTGATTTAAAGGCGCTCATTGCAGATGTTGAGGCCAATGCT<br>ACTAATGCAGGCTTCTTTGGCACGCTGCTCTATGCATTCCAAAAGACTCTACAGATGCGTA<br>ACAGCAATGCTTTAACGGAAGAAGATTTCATCCTTTCACCTGTAGCAAAAGATGGGCATCA<br>CTTCTGCAGCACTGATGAGGCAAACAAAGGCAGAGATGCGCAGGGCAACTGGGTATCAA<br>GGCTACCTGTAGATGCAGATGCAAATGGCGCATATCACATCGCTTTGAAGGGACTTTATCT<br>GCTCCGAAACCCTGAAACGAAGAAAATAGAAAACGAAAAATGGTTCCAGTTTATGGTTGA<br>GAAACCATATTTGGAGTAA |
| 434 | 403 | ATGAAGGATTTAAAACAATTTATCGGCATATATCCAGTCTCAAAAACATTACGTTTTGAGT<br>TGAAGCCAATTGGTAAAACACTTGAATGGATAAAGAAGAACAAAGTTCTTGAAAGTGATG<br>AGCAAAAAGCTGAGGACTATCCAAAAGTGAAGACATTGATTGATGAATATCACAAAGTCT<br>GCATTTGTGAGTCTTTGAAAGGAGTCAATTTTGACTGGAATCCACTTAGATTGGCTTTGAA<br>AGAATACCAAAGTAGCAAGAGTGATGAGAGCAAAGCCGTTTTGGAGAAAGAACAAGCAT<br>TAATGCGTAAACAGATTGCCACAGTCATCAAGGACTTTCGACACTATAAGGAACTTACTAC<br>CCCCACACCACAGAAACTTATTGATAATGTTTTCCCTAGCATTTATGAGAGTGATGCCTTGA<br>AGTCATTCAACAGATTTGCCGTTTATTTCAAAGGTTTCCAAGAGAATCGTAACAACATTTAT |

TABLE S13F-continued

Native Nucleotide Sequences Group 13

| SEQ ID NO | Corresponding AA | Sequence |
|---|---|---|
| | | AGCTCAGATGCTATTAGTACTGGTGTACCTTATAGACTTGTTCACGACAATTTTCCAAAGTT
TTTGGCAGACATTGAAGTCTTTGAGAATATCAAGACGAACTGCCCTGAGGTCATAGAACA
GGCAGCAACAGAATTACAGCCATTCCTTGAAGGAGTAATGATTGAGGATATTTTTACGATT
GATTTCTACAACTCCCTTCTAACTCAAGATGGTATAGATTTCTTTAATCAAGTATTGGGTGG
AGTAGCAGAAGAAGGCAAGCAAAAGTATCGCGGCATCAACGAGTTCTCCAATTTGTATCG
TCAACAACATCCTGAGCAAACAGCAAAGAAGAAAACCCTCACCATGATTCCGCTTTTCAAG
CAGATACTTTCAGATAGGGATACGCTTTCTTACATTCCACAGCAGATAGAGTCAGAACAAC
AATTGATAGAACTATTAAACCAGTTCTATTCTCACATCACGGCCTTTGACTATAATGGCAA
GACTGTTGATGTTCTTAAAGAATTGACCAAATTAACTGGCAATATCAACAAATACAACCCT
GATGGCATATATCTTTCTGCCAAGTCATTGACAGACGTTTCGCAAAAGTTGTTTAGTAAAT
GGAACGTCATTACAGAAAGGCTTTCTGAAGAGGCAATAAAAAGATTTGGGGATGTATCG
ATAACTAAAAATAAAAAGAAGATTGACGCTTATCTGTCGAAAGATGCTTATGCGCTTTCAG
AAATACCCCTCGACAATGACCATTCATTGTCAATGTTCTTTGCAGAGTTTCCCAAAACCATA
GAAAATGTTGGCAGCAACTGGCTACAATTTATGGAATGGTGCAAAGGAGAGAGTAAGCA
ACTCTTCCTCAATAATGCTGATGGTACAGAAATCGTTAAGAACTTCCTTGATTCTATTATGG
AAATCCTACATAGATGTTCTGTGCTTGTGGTTTCTGTAGAGCATGATTTAGACAAAGATTT
CTATAATGATTTCTTGCCACTTTATGCAGAATTAGAGAATGCAGTAATGGTTTATAATCGT
GTACGCAATTTCCTGACGAAGAAGCCTTCTGATACAAAGAAATTTAAATTGAATTTTGGTG
TACCTTCGTTAGGAGATGGTTGGGACCAGAATAAAGAGCGAGACAACAAGGCCATTATTC
TTTTCAAAGATGGTAAATCTTATTTGGGCATCATGAACGCAAAGGATATGCCTATAATAAA
AGAAAGAGATGAAAGCACTCCATCATCTTATAAGAAGATGATATACAAATTGCTCGCTGA
CCCTGCCAAGGATTTTCCGCATACATTCTTTTCGAAAAAAGGAATAGACACATATCATCCTT
CAAGATATATTCTTGACGGACGTGAGCAAGGAAAATATAAGAAGGGGGAAACTTTCGAT
AAAAAGTTCATGCGGGATTTTATTGATTTCTATAAGGATGCTGTGGCGAAGCACCCTATTT
GGAGTAAATTCAATTTCGTCTATTCTCCTACTGAGTCATACGAAGATATAGGTGCTTTCTTC
AATGAGGTGTCTAAGCAAGCATACAAGATTCGCTTCTCTTATATTGAAGAATCGCAAATCA
ATGAATGGACAGAGAAAGGCCAACTTTATCTTTTCCAGTTATATAACAAGGACTATGCCGA
AGGTGCTCACGGACGAAAGAACCTTCATACCCTGTATTGGGAAAGTTTATTCTCTCCTGAA
AATCTCAGCAACATTGTGCTGAAACTGAACGGGCAGGCAGAATTGTTCTATCGTCCACAA
AGTATCAAGCAACCATTTTCACATAAAAACGGGGAGCAAGATGCTTAATCGCAGGGACAAG
AGTGGTATGCCCATCCCTGAAGCAATCTACAGAAGTCTGTACCAATATTTTAATGGCAGAA
AGGCTGAAAGCGAATTGACTCTTGTCGAAAAGTCCTATATTGACCAAGTGGTTGTTAAAG
ATGTGACTCATGAGATAGTAAAGGACAGGAGATACACCAAGCCTGAATTTTTCTTCCACGT
TCCTATCACATTCAATGTCAATGCAGATGGAAACGAATATATCAATGAGCAGGTGATGGA
ATATCTCAAGGATAATCCAGACGTTAACATCATCGGAATAGACAGGGGTGAACGCCACCT
AATATATCTTACACTAATTAACCAACGAGGTGAGATATTGAAGCAAAAGACATTCAATATA
GTTGGCAACTATAACTATCATGCCAAACTGGAACAGCGCGAACAGGAGCGTGATCAAGCT
CGTAAGAGTTGGCAAAGCGTTGGGAAAATCAAAGAACTGAAGGAAGGTTTCCTTTCTGCT
GTCATCCATGAGATAGCCATGATGATGATAAAATACAATGCCATTGTAGTGCTTGAGGAC
TTGAATTTCGGATTTAAGCGTGGACGTTTCAAAGTGGAACGACAAGTGTATCAGAAGTTT
GAGAAAATGCTAATTGACAAACTAAACTATCTCTCCTTTAAAGACCGCAAACCTGATGAAG
CAGGAGGCATCTTACGTGGTTATCAGTTGACACAGCAGTTTACGAGTTTCCAAAGACTTG
GAAAACAAAGTGGATTCCTTTTCTACATTCCTGCTGCCTACACCTCGAAGATAGACCCAGT
TACAGGCTTTGTCAACCATTTCAACTTCAATGACATCACCAATGCAGAAAAACGAAAGGCA
TTCTTCATGAAGATGGAACGAATAGAGATGCGCAATGGCGACATCGAGTTTGAATTCGAC
TATCGCAAGTACAAGACCTATCAAACAGACTACCAAACATCTGGACGGTTAATAGTTCTG
GCAAACGCATTGTGATGAGGATTGATGAGAATGGGCGTAAGCAAATGACGGATTACTTC
CCAACTAAAGAAATAGTGAAAGCCTTTTCAGATAAAAACATTACACTTTGCGAGGGTACA
GACTTGAAAGCTTTGATGGCGGTGATTGATACAAGCCCAAGAATGCATCATTGTATGGA
ACACTGTTTATGCTTTCCAAAAGACCTTGCAGATGCGTAATAGTGATTCTGCAACAGAAG
AAGATTACATTCTTTCACCAGTTACTCAGAACGGAAAGCAATTCAATACCAAAGATGAGGC
TGACAAAGGACAAGATTCTGCTGGGAACTGGGTCTCAAAGTTCCCAGTAGATGCAGATGC
TAACGGAGCATATCATATAGCACTAAAGGGTCTCTTCTTGCTTATGAATCAACAGA
CAAAGAAGATAGAAAACCAAAAATGGCTCCAGTTTATGGTTCAGAAGCCATATAAGAGCT
AA |
| 435 | 404 | ATGAAAGACCTAAAACAATTTATCGGCATATATTCAGTCTCAAAGACATTGCGCTTTGAGT
TAAGACCTATTGGCAAGACACAAGAATGGATAGAAAAGAACAAGATACTGGAGAGTGAT
GAGCAGAAAGCAGAGGACTACCC
TAAAGTGAAGACCCTCATAGATGACTATCATAAGGTATGTATCCGCGAATCGCTGAGAGG
TGTTCATTTAGACTGGAGTCCTTTGAGGCAAGCATTAGAAGAATACAGCAAACCAAGAG
TGACGAGAGTAAGGCTGTACTGGAGAAAGAGCAAACCTCGATGCGTAAACAGATTGCTG
CTGCAATCAAGGATTTCCGCCATTTCAGGGAACTGACTGCGCCAACACCACAGAAGTTGA
TTGATGACGTGTTTCCTGGCATCTATGAAGACGAGGCATTGAAGTCTTTCAACAGGTTTGC
TCTGTATTTCAGGGGATTCCAAGATAACAGGAACAATATCTATAGTGCTGAGGCCATTAGT
ACAGGGGTGCCCTATAGGCTTGTTCATGACAATTTCCCCAAGTTCTTAGCAGATATAGAAG
TTTATGAAAATATCAAGGCCACATGCCCAGAGGTCATCGAGCAAGTGGCTGTAGAAATGC
AGCCATTCCTTGAAGGTGTGATGATAGATGACATCTTCACGCTCGACTTCTACAATTCGCT
TTTAACTCAAGATGGTATTGATTTCTTTAATCAGGTATTAGGCGGCGTAGCTGAAGAAGG
GAAGCAAAAGTATCGTGGCATCAACGAATTCGTCAACTTGTATCGACAGCAGCATCCTGA
GTTGACAGGAAGAAAAAAGCCTTGACGATGGTACCACTATTCAAGCAAATACTGTCGGA
CAGGGAGAGCGCTTTCGTATATTCCGCAGCAGATAGAATCAGAACAACAGTTGATAGATGT
TTTGAGTCAATTCTATGCCCACATTACCGATTATGAATATAATGGCAAGACCATCAACGTTC
TGAAAGAACTATCCAACCTGACGAATAGGATTGGGGACTACAATCCCGCCGGGATTTTCC |

TABLE S13F-continued

Native Nucleotide Sequences Group 13

| SEQ ID NO | Corresponding AA | Sequence |
|---|---|---|
| | | TTTCTGCAAAGACATTGACTGATGTTTCTCAGAAGTTGTTTGGTAGATGGAGTGCCATCAA<br>CGATAAACTCTACGAGAAGGCTGTCAGCCAGTTTGGCGACCCTGCTATTGTCAAGGACAA<br>AAAGAAGATAGATGCCTATCTTGCGAAAGACGCATTCGCGCTTTCGGAAATCAATCTTGAT<br>AGCGAACATCATTTGTCGACGTATTTCTCAGAAATGGCCCTTGTCGTAGAACAAGTAGGTA<br>GTAGTTGGCTACAATTTAAGGAATGGTGCAAAGGCAGCGACAAACAGCTGTTCCTTAATA<br>ACGCAGATGGAACAGAAATCGTCAAGAATCTGTTGGACGCTATGATGGACATTCTGCACA<br>GATGCGCTGTGCTTGTTGTCCCAATAGAGTATGATTTGGACAAGGATTTTTATAATGACTT<br>CCTGCCACTCTATGCTGAACTGGAAAACGTTATCTTTGTCTATAACAGGACAAGAAACTAT<br>CTAACCAAGAAACCTTCTGACACCAAGAAGTTCAAACTGAACTTTGGAACGCCGACATTG<br>GGCGATGGATGGGGAGTGAACAACGAAAGAAAGAACAAGGCTATTCTTTTGTTTAAAGA<br>AGGTCTGTCCTACTTAGGCATTATGAATGTGAAAGGCACTCTAAAGTTTGAAGAGACCAA<br>GGATGCCAGTTTGCATTCATACAAGAAGATGACATGTAGGTATCTGTCAAAACCCTTTATG<br>GACTTGCCTCACACCTTCTTTTCAGAGAAAGGCATTAGTACTTTCCACCCATCAGAGCGTAT<br>CATGGATATCTATAAGAATGGTACATTCAAGAAGGATTCGCCAAGCTATAGTATCGCAGC<br>GCTGCACGACTTAATCGACTTCTATAAAGACGCTATCAACAAACATGAGGATTGGGTTAA<br>ATATGGCTTTTCATTCTCACCCACAGAGTCCTACGAAGATATCAGTTCGTTCTATTCTGAAA<br>TAGCCAAGCAGGCATACAAAATCAGCTTTACCAATGTCTCTGAACAACAAGTTAATGACTG<br>GGTAGAGAACGGACAGCTTTATCTGTTCCAATTATATAATAAGGATTACGCCGAGGGTGC<br>TCATGGGCGTAAGAATCTGCATACGCTCTATTGGGAGAATCTTTTCTCTGAAGAGAATCTC<br>AACAACCTTGTTCTCAAGTTGGGAGGGCAGGCAGAACTCTTCTATCGCCCTCAAAGCATCA<br>ATAAGCCAGCCAAGCACGTTGTTGGCAGTAAGATGCTGAATCGCAGGGACAAGAGCGGA<br>ATGCCTATTCCAGAACCTATTTACAGAAGTCTTTACCAGTATTTCAACGGTAAGAAACAAG<br>AAGATGAACTGACGGCAGCGGAGAAAGCATACATCGACCAAGTTGTTGTTAAAGATACC<br>AATCATGAGATTGTCAAGGATAGAAGATACACAAAACCAGAATACTTCTTCCATGTTCCCA<br>TTGTATTCAATGCTAACGCTGACGGCAACGAATATATCAACGAAAGGGTGCTTGACTATCT<br>AAAGGATAATCCTGAAGTGAACATCATCGGCATCGATCGTGGTGAGCGTCATCTGATATA<br>TCTGACACTCATCAACCAACGGGGTGAGATTTTGAAACAGAAGACCTTCAATATGGTTGG<br>CAACTACAACTATCATGCCAAGTTGGAGTTGCGCGAGAAAGAACGTGATGATGCCAGGA<br>AGAGTTGGAAGAGTGTAGGTAAAATCAAGGAATTGAAAGAAGGTTTCCTCTCAGCTGTTA<br>TTCACGAAATAGCTGTGATGATGGTTGAGAATAATGCCATTGTTGTGCTCGAAGACCTAA<br>ACTTCGGCTTCAAGCGTGGTCGTATTTAAAGTGGAGCGCCAAGTATATCAGAAGTTCGAGA<br>AGATGCTGATTGACAAACTGAACTACTTGTCATTCAAAGACCGCATGGCTGATGAAGAAG<br>GTGGCATTCTTCGAGGCTACCAGCTGGCTCTGCAATTCACGAGTTTCCAAAGACTTGGAAA<br>GCAAAGCGGTTTCTTGTTCTACATTCCTGCTGCCTATACGTCGAAGATTGATCCTGTGACG<br>GGTTTTGTCAACCACTTCAACCTGAACGACATCACCAATGCAGAAAAGCGTAAGGCATTCT<br>TGATGAATATGGAGCGTATTGAGGTGAAGAACGGCAATGTGGAGTTCGAGTTCGACTAT<br>CGTAAGTTCAAGACCTACCAGACAGACTATCAGAATATATGGACGGTCAATACCTCAGGC<br>AAGCGCATTGTTTTTGATTCAGAAACAAGAAAGGCCAAAGACGTATACCCCACGCAAGAG<br>ATTATTGCTGCCTTCAAGGAAAAAGGCATCAATCTAAATGATGGAACGGATTTGAAACCCT<br>TAATCGCTGATATTGAGGCCAATGCGAAGAATGCCTCGTTCTATTACGCTATATTTGATGC<br>ATTCAAGAGAACGTTGCAGATGCGTAACAGCAATGCAGCGACTGAAGAAGATTATATTTT<br>GTCGCCTGTTGTTTGCAACGGCAAGCAATTCTGCACCACGGACGAAGTCAATAAGGGTAA<br>GGATGCTGATGGAAACTGGCTATCCAAACTCCCTGTTGATGCTGATGCCAATGGTGCCTAT<br>CACATCGCCCTCAAGGGGCTTTACCTCTTAAATAACCCTCAAACAAGAAGATAGAAAATG<br>AAAAATGGTTCCAATTCATGGTTGAAAAGCCCTACTTAGAGTAA |

45
N. Group 14 Type V nuclease and associated sequences (SEQ ID Nos: 436-563)

TABLE S14A

Enzyme Sequences Group 14 (SEQ ID Nos: 436-456)

| SEQ ID NO | Sequence |
|---|---|
| 436 | MNTMTQRSPVSGGKNPEGQKSVFDSFTHKYALSKTLRFELVPQGKTSESLKAVFEEDKKVEENYQKT<br>KVRLDQLHRLFVQASFTESKVSALKLASFVRAYNALIGVAKKTQTKEQKSAYEKERKALLYEVAGLFDE<br>MGDEWKAQYEEIESVGRTGKQKKIKFSSTGCKILTDEAVLNILMDKFAEDTQVFSTFFGFFTYFGKFN<br>ETRENFYKSDGTSTAVATRVVENLEKFLRNKHIVESEYKKVKTAIGLTDSEILALTDVEAYHRCFLQAGI<br>DVYNTVLGGSTELEQSVNKKVNEYRQKTGNKISFLAKLHNQILSEKDVFEMLVIKGDAQLWEKLKVFS<br>EENVAYCTKMLALIRDALTMPEKSGYEWSKIYFSSGAINTISSKYFTNWSVLKGALLDAVGTAKGGGG<br>ELPDFVSLQHVQNALDVNEINKGKKPSELFRSEILKHAAFVESVGHFTNLITILLSELDARVAESAVDLA<br>DLKKDSFWTTGALSQRRKEKEDEGTIQINRISAYLNSCRDAHRMIKYFATENRRDWVEPEEGYDPKFY<br>DAYREEYAKDIFFPLYNVARNFLTQKPSDENKVKLNFECGTLLSGWDKNKEQEKLGIILRKDGAYYLAI<br>MRKQFSDILEEKKHPEAYRAGDNGYSKMEYKLFPDPKRMIPKVAFAETNKKTFGWTPEVQAIKDEYA<br>KFQESKKEDQSAWKNQFDANKTARLIAYYQNCLAKGGYQETFGLTWKKPEEYVGIGEFNDHIAQQN<br>YKIKFVPVDADYIDEHVAKGEMYLFKIKSKDFASGSTGTKNVHSLYFSQLFSEANLAQTPTVVQLAGN<br>AEIFYREASVEPEKEKRNFPRDITKYKRFTEDKVFFHVPIKINAGTDAMRSQYQFNKILNAELIAKRAKD<br>FCIIGIDRGEKHLAYYSVINQKGVIVDEGSLNEISGTDYHKLLDGKEKERTANRQAWLPVRQIKDLKRG<br>YVSHAVKKICDLAIEHNAIIVLENLNMRFKQIRSGIEKSVYQQLEKQLVDKLGHMVFKDRPELEIGGVL |

TABLE S14A-continued

Enzyme Sequences Group 14 (SEQ ID Nos: 436-456)

| SEQ ID NO | Sequence |
|---|---|
| | NGYQLAAPFESFKDMGNQTGIVFYTEAAYTSTTDPVTGFRKNVYVSNSATKEKLEKAIKSFDAIGWNE ERQSYFITYDPVRLVDKKEKTKTISKLWTVYADVPRIRRERNEQGVWNARNVNPNDMFKSLFEAWN FEDKIATDLKSKIEEKMKNGELSSYKMIDGRERNFFQAFIYIFNIILDIRNSSDKTDFIASPVAPFFTTLNA PKPNPCDINLANGDSLGAYNIARKGIITIGRINDNPEKPDLYISKEQWDEWATKHGIQL |
| 437 | MNKFTNLYSVDITLRNSLIPIGETLENMTQRSYIEHDEQRAEAYKLVKGIIDDYHRAFIDSRLAHFELRV NSRGAFDSIEEFATLYNIRRDKKRDKEFTTVKKNLRKAISQQLTKCDAYGRIDKRELIREDLPYFIDSLDIS EDEKEEKKKQVEQFAKFATYFSNFHTNRANMYVADEKSTSIAYRLINQNLPVFLDNMKVFAMLKAIG FEDELDAIYSDMEEKLNVQSLDELFQQDYYSMLLTQRQITVYNEVIGGRSEKDGKKVKGLNEYINSHN QDHPTARLPFLRPLYKQILSDRVSMSWLPEAFVSDEEMIHAINIPIHQNIHPLLWGPMDDAGEPLKNIL SQIDTFDTEHIFITNDSALTNISQRLFGQYNLITDALLKRLSQQTPRKRGRKPESDEAYEERIRKAFKAIKS FSIAEINESLKSYMEEETYKDVSSYFRAMDERNDEHVQQANIFNRIEHAYTEAKPFLNKQRASNSPYN QDDDAIKCIKALLEAYKTLQRFINPLVGSGEESSKDDMFYGEFMPIVEELKNITPLYNKVRNWLTRKPY STEKPKICFDNSSFLSGWPQDYETKGGYIAEHNGLYYLFINEVRLNENQIGFLCDHPDEDNASRILLDF QKPDYRNIPRFFIRSKGDNFAPAVEKYGLPIASVIDIYDQGRFETEYRSINSDDYYRSLHKLIDYFKLGFT RHESYKHYTFQWKPTNEYNDISQFYHDVEVSCYQLKRIPINWNHLLELVRQGAVYLFQIYNKDFSTQS KGKGTPNLHTLYWRMLFDERNAQNLVYKLNGQAEIFFRHASIKPENKVVHKANRPIENKNPLRKPVK PNSSFPYEITKDKRYTLDHFEFHVPITMNFKSPGINNVNPIVIDKIRKGEITHVIGIDRGERHLLYLSLIDL KGKIIHQMTLNTISNQWAEGKIDTDYQKLLGQKEGNRLEARRNWKTIENIKELKEGYLSQAIHLIAQL MVENKAIVVLEDLNFGFMRGRQKVEKQVYQQFEKMLITKLNYYVDKKDADALGGLLHALQLTNKF ESFEKLGKQSGFLFYVPAWNTSKIDPVTGFVNLLNHYETREKASLFFSKFERISFNEEKNWFEFVLDYG KFTTKAEGTRTAWTLCTFGERIETFRDPQANHQWGNRIMNLTQAFKDFFRDSNIDIYGNLKDQICSQ QKAKFFEQLLHLMKLLLQMRNSKKDSTSPEDDYILSPVADDNGVFYDSRHSSESLPNDADANGAYNI ARKGLWIIRQIQSASADERPSLTLSNKEWLHFAQTKPYLND |
| 438 | LRKILHRHSFIFVAEIIKTHIMENLKKFTNLYSKPITLRFSAEPIGNTGKNFRDNILQKDKDLDESYQEAKLI IDNYHRWHIDTVLKRTNLDENKLLEFYAIYTDKRYKDRDKLLASLQKGFRKVLSDSLLHNEKDLFGEKLI TSLIPQWLELCGNKEALEVISKFNKFTTYFTGFNTNRKNIYTEEEKKNSITYRLIHENLLKFIDNINLFERIK ETEVANNFDTIKNEAKLNIQLEEVFTITYFNKLLTQSGIDLFNLIIGGYSTEKRVYKGLNEYINEYNQTH AGNQLPKFRPLFKQILSEKDSTSYIDKQFADSKDVIIAINQSYDAINTYVLPHLTQVLSLITPEKLSLIYIEN GADITRISNELCGNYDFIKQHFIKEFELQRPRTSKETIEKYYEEKINKAWSKDKFVTLEYINTILRQNNKEDI ISYFTKERLATTLKKIEEAYKKFQSILTVDYNGELKSDKESVSLIKDLLDSIKDLQLFIKPLSKGEFETQKDN NFYNEFIPIYSVLNDNISHLYDRVRNYVTQKPYSTEKIKLNFENSTLMSGWDVNKEPDNTTIILRKDGFY YIGIMDKKSNKCFSSKNLPSEGECYEKMEYKLLPGANKMLPKVFFSKSRIEEFAPNPQLLRAYEKGTHK KGVGFRIEDCRNLIDFFKISIEKHNDWKQFNFRFSPTNSYQDISDFYREVEHQGYKITFRNISQSYIDAL VAEGKLYLFRLYNKDFSQYSKGQPNLHTMYWKMLFDEDNLANVMYALNGGAELFFRPASLERKITH PANEPIACKSVENKGKASTFKYDLIKDKRYTQDTFQFHVPITLNFKGRGINTPKGFNEHINKYYLPHAT HIIGIDRGERNLLYISVIDMNGRIVEQFSLNDIVNEYNGKQYHTDYHHKLDDREKARAKARESWQSIE NVKELKEGYLSQVVHKIVQLVLKYNAIIVMEDLEKAFKNNRLKIEKSVYQKFEDALINKLSYIVDKTAGK ENVCGLLNALQLAYIPQKKNDIINQCGIIFYIPAWCTSKIDPVTGFINKIDTRYTSIEKAKELIGKFADICY DDENECFEFKIEDYTKLGGIDDTRKDWVLTSRGMRIETVLNPTTQKYSEQVEINLTDEFMKLLQGGIG TNLKDYILHQDNSKFFKDLLRCIKLMLQMRNSKIGTDIDYLISPVKQDNGEFYSSKEEKQKGTDSCGQ WKSTLPIDADANGAYNIARKGLMVANKLKSGSIPKEAFAVSNKDWLNFVQQNNV |
| 439 | MFEKLSNIVSISKTIRFKLIPVGKTLENIEKLGKLEKDFERSDFYPILKNISDDYYRQYIKEKLSDLNLDWQ KLYDAHELLDSSKKESQKNLEMIQAQYRKVLFNILSGELDKSGEKNSKDLIKNNKALYGKLFKKQFILEV LPDFVNNNDSYSEEDLEGLNLYSKFTTRLKNFWETRKNVFTDKDIVTAIPFRAVNENFGFYYDNIKIFN KNIEYLENKIPNLENELKEADILDDNRSVKDYFTPNGFNYVITQDGIDVYQAIRGGFTKENGEKVQGIN EILNLTQQQLRRKPETKNVKLGVLTKLRKQILEYSESTSFLIDQIEDDNDLVDRINKFNVSFFESTEVSPSL FEQIERLYNALKSIKKEEVYIDARNTQKFSQMLFGQWDVIRRGYTVKITEGSKEEKKKYKEYLELDETSK AKRYLNIREIEELVNLVEGFEEVDVFSVLLEKFKMNNIERSEFEAPIYGSPIKLEAIKEYLEKHLEEYHKWK LLLIGNDDLDTDETFYPLLNEVISDYYIIPLYNLTRNYLTRKHSDKDKIKVNFDFPPTLADGWSESKISDNR SIILRKDGYYYLGILEDNKLFNNIKSNSLKNYYEIMRYNLFPDAAKMIPKCSISKKEVKNHFENGVDKSIY LDNQFVSPLEISKELYELQNNLVDGKKKYQIDYLRNTDDEVGYKNALVQWITFCKDFLLKYQGTQDFD YSELKEAKYYDKLDQFYADVDSCGYNLDFDNIDEDLVNKAVEDGKLLIFQIYNKDFSPESKGKKNLHTL YWLSMFSEENLRTRKLKLNGQAEIFYRKKLEKKPIIHKEGSILLNKIDKEGNTIPENIYHECYRYLNKKIGR EDLSDEAIALFNKDVLKYKEARFDIIKDRRYSESQFFFHVPITFNWDIKTNKNVNQIVQGMIKDGEIKHI IGIDRGERHLLYYSVIDLEGNIVEQSLNTLEQNRFDNSTVKVDYQNLKRTREEDRDRARKNWTNINK IKELKDGYLSHVVHKLSRLIIKYEAIVIMENLNQGFKRGRFKVERQVYQKFELALMNKLSALSFKEKYDE GKNLEPSGILNPIQACYPVDAYQELQGQNGIVFYLPAAYTSVIDPVTGFTNLFRLKSINSSKYEEFIKKFK NIYFDNEEEDFKFIFNYKDFAKANLVILNNIKSKDWKISTRGERISYNSKKKEYFYVQPTEFLINKLKELNI DYENIDIIPLIDNLEEKAKRKILKALFDTFKYSVQLRNYDFENDYIISPTADDNGNYYNSEIDIDKTNLPN NGDANGAFNIARKGLLLKDRIVNSNESKVDLKIKNEDWINFIIS |
| 440 | LFNLYSCLTEYILMQITIFTNKNKRNKNNMENSNLFTNKYQVSKTLRFRLEPTGGTDDLLRQAQIIEGD ERRNKEAITMKQILDNCHKQIIERVLSDFNFKEHSLEEFFKVYTRNDDDREKDIENLQSKMRKEIADAF TKQDVTKLFSSKFKDFVERGLIKYASNEKERNIVSRFKGFATYFTGFNTNRLNMYSEEAKSTAISFRLIN QNLIKFIDNILVYKKVSQTLPSDMLSNIYIDFKAIINTSSLEEFFSINNYNNILTQKQIEIFNAVIGGKKDKD EKIITKGFNQYINEYNQTNKNIRLPKMMRLFNQILSDREGVSARPEPFNNANETISSVRDCFTNEISKQI TILSETTSKIESFDIDRIYIKGGEDLRALSNSIYGYFNYIHDRIADKWKHNNPQGKKSPESYQKNLNAYLK GIKSVSLHSIANICGDNKVIEYFRNLGAENTVDFQRENVVSLIDNKYNCASNLLSDAQITDEELRTNSRS IKDLLDAVKSAQRFFRLLCGSGNEPDKDHSFYDEYTPAFEALENSINPLYNKVRSFVTKKDFSTDKFKLN FDSSSFLSGWATKSEYEKSSAFIFIRDNQYYLGINRCLSKEDIAYLEDSTSSSDAKRAVYLFQKVDAKNIP RIFIRSKGSNLAPAVNEFQLPIETILDIYDNKFFTTSYQKKDRTKWKESLTKLIDYYKLGFSQHKSYADFD LKWKASSEYNDINDFLADVQKSCYRIEFININWDKLIEFTEDGKFYLFRIANKDLSGNTGLPNLHTIYW |

TABLE S14A-continued

Enzyme Sequences Group 14 (SEQ ID Nos: 436-456)

| SEQ ID NO | Sequence |
|---|---|
| | KMLFDESNLKDIVYKMSGNAEVFMRYNSLKNPIVHKAGVEIKNKCPFTEKKTSIFDYDIIKDRRYTKDQ<br>LELHVPILMNFKSPSAAKGNVFNKECLEYIKNNGIKHIIGIDRGERNLLYMVITDLDGNIVEQKSLNQIA<br>SNPKLPLFRQDYNKLLKTKADANAQARRDWETINTVKEIKFGFLSQIVHEIAMSIIKYDAIVVLENLNR<br>GFMQKRGLENNVYQKFEQMLLDKLSYYVDKTKHPEEAGGALHAYQLSDTYANFNSLSKNAMVRQS<br>GFVFYIPAWLTSKIDPVTGFASFLKFHRDDSMATIKSTISKFDCFKYDKECDMFHIRIDYNKFSTSCSGG<br>QRRKWDLFTFGDRILAERNTMQNSRYVYQTVNLTSEFKNLFATKDIDFSGNLKDSICKIEDVGFFRKLS<br>QLLSLTLQLRNSNAETGEDFLISPVADKDGNFFDSRNCPDSLPKDADANGAYNIARKGLMLVEQLKR<br>CKDVSKFKPAIKNEDWLDYVQR |
| 441 | LQHTKKRIVMANFENFTNLYSISKTLRFELRPDEKTQENIKKHGLLQEDTHRADSYKKVKKIIDEYHKDF<br>IEKSLSSCVLKIESDGKKDSLQEYCELYKKKDKSDSDKKALEKIQEQLRKQIVKSFSDRDEFKKITKKELITD<br>LISGFLDNENKRELVEEFKSFTTYFTGFNENRKNMYSNEEKSTAIAFRLIHENLPKHMDNVSIFERLKTS<br>KVSEDFALLSKELKEELQGKSLEDFFLIESYTKLLSQSQIDNYNALIGGKSLEKNKKIKGLNEYINLYNQKQ<br>KESKDRLPKLKMLYKQILSDRGVLSWLPKTFNSDKELLEKIEECRREFTTNEDGKGSLLEKIKQLIISLDKY<br>DSNRIYIRNDKQITNISQKVFGGYGIIYGGLRLLLKKDTPKKKNENNEKYEERLEKRIKALDSVAISTIEEG<br>VDTLELEDRNTILDYFKQNIEILFENIEKNYSIVKDLLNVEYPKERNLRQDKVNIEKIKNYLDSLKSLQNFI<br>KPLCGKGNEAEKDEKFYGEFTLLWDEFNKITQLYNMVRNYITQKPYSEEKIKLNFQNSTLLNGWDLNK<br>ERDNTSVLLRKDGLYYLAIMNKDHNKVFDIKQTKEKNSGECYEKIEYKLLPGPNKMLPKVFLSTKGIAE<br>FNPSEELLSNYQKETHKKGDNFKIEDCHALIDFFKTSIEKHKDWKQFGFVFSDTKSYENLSGFYREVEH<br>QGYKITFRNIAVDYIDSLIEEGKIYLFQIYNKDFSPHSKGTPNLHTLYWKMLFEKENLSNVVYKLNGEAE<br>VFFRKKSLSNNKPTHRANEPIDHKNKRNGDYKSMFPYDLIKDKRYTIDKYQFHVPITINFKSENINYIND<br>RVNQYIRKSKDLHIIGIDRGERHLLYISVVDLQGNIKCQKSLNIINNYDYQGKLTEREKERDEERRSWQT<br>IEGIKDLKEGYLSQAIHEISNLILKYNAIVVLEDLNFGFMRGRQKFEHSVYQKFEKMLIDKLNYLADKKK<br>EPEEIGGLLKAYQLTNQFKSFKELGKQSGILFYTQAWNTSKIDPVTGFVNLFDTRYSNTKNAQRFFNN<br>FEDIRFNKDKGYFEFEFDYDKFTTKAEGTKTKWTICTFGNRIETFRNKEKNSQWDSVEIDLTQKFKDLF<br>EEKKIDLENLKAEIVKQDSKEFFEKLLRLFCLTLQLRNSISNTDVDYIISPVANENGVFYNSKECDESLPQ<br>DADANGAYNIARKGIMIVERIKANKKGKKLDLAISNKDWLKFAQEKPYRK |
| 442 | MNIYENFTNMYQVNKTIRMGLKPICKTDENIAKFLEEDKERSEKYKIAKKIIDKENRAFIEDRLKDFSISG<br>LDEYLELLKQKKDITKIQKKMRDEISKQLKGFPQFDSKYKFQYITDKEDTEILEYFKKFTTFFTGFNSNRE<br>NVYSKEDISTSIGHRIIHENLPKFISNFRILNKAIEALGTGKINEDFKNNEINVTVEELNKIDYFNKVLTQS<br>GIDLYNNLIGILNQNINLYNQQQKVKKNKIGKLETLHKQILSEKDKVSFIEEFAEDNQLLKCIDEYFKEKS<br>CLINVDLKNLLENIDTYSLNGIFIKNDKSLKNISIYLYKDWGYISNLINEEYDYKHKNKVKDDKYYEKRKK<br>AIDKIKYFSIGYIDELLKDKNVPMVECYFKEKINLVVKEFNASLNKFNEYKFTNELKTDEIAVEIIKNLCDSI<br>KKIQGIIKPLIITGNDKDDDFYVEINYIWDELNKFDKIYNMVRNYLTKKDYIEEKIRMMFSKSSFMDGW<br>GKDYGTKEAHIVYHDKNYYLVIVDEKLKLEDIDKLYKPGGDTVHYIYNYQSIDYRNIPRKFIYSKGNRFA<br>PSVERYNLPIEDVIEVYNNKYYRTEYEEKNPKIYKKSLTSLIDYPKIGVNRDMDPEKFDIKLKDSNEYKNI<br>NEFYYNLETCCYKLQEEKVNFSVLEEFSYSGKIYLFKIYNKDFSKYSKGTPNLHTLYFKMLFDKENLENPI<br>YKLSGNAEMFFRKGNLDLDKTTIHHANQPINNKNPNNRKRQSVFKYDIIKNRRYTVDKFALHMSITT<br>NFQVVYKNKNVNETVNRALKYCDDIYAIGIDRGERNLLYACVVNSRGEIVKQVPLNFVGNTDYHQLLA<br>KREEERMNSRKNWKIIDNIKNLKEGYLSQAIHIITDFMVEYNAVLVLEDLNFRFKEKRMKFEKSVYQKF<br>EKMLIDKLNFLVDKKLDKNANGGLFNAYQLTEKFTSFKDMKNQNGIVFYIPAWMTSKIDPVTGFTNL<br>FYIKYESIEKAKEFFGKFKSIKFNKVDNYFEFEFDYNDFTDRAQGTRSKWTVCSPFGPRIEGFRNPEKNN<br>NWDGREIDITEEIKKLLDDYKVSLDEDIKAQIMDINTKDFFEKLIKYFKLVLQMRNSKTGTDIDYIISPVR<br>NKQNEFFDSRKKNEKLPMDADANGAYNIARKGLMFIDIIKETEDKDLKMPKLFIKNKDWLNYVQKSD<br>L |
| 443 | MDMKSLNSFQNQYSLSKTLRFQLIPQGKTLDNINESRILEEDQHRSESYKLVKKIIDDYHKAYIEQALGS<br>FELKIASDSKNDSLEEFYSQYIAERKEDKAKKLFEKTQDNLRKQISKKLKQGEAYKRLFGKELIQEDLLEF<br>VATDPEADSKKRLIEEFKDFTTYFIGFHENRKNMYAEEAQSTAIAYRIIHENLPKFIDNIRTFEELAKSSIA<br>DVLPQVYEDFKAYLKVESVKELFSLDYFNTVLTQKQLDIYNAVIGGKSLDENSRIQGLNEYINLYNQQH<br>KDKKLPFLKPLFKQILSDRNSLSWLPEAFDNDKQVLQAVHDCYTSLLESVFHKDGLQQLLQSLPTYNLK<br>GIYLRNDLSMTNVSQKLLGDWGAITRAVKEKLQKENPAKKRESDEAYQERINKIFKQAGSYSLDYINQ<br>ALEATDQTNIKVEDYFINMGVDNEQKEPLFQRVAQAYNQASDLLEKEYPANKNLMQDKESIEHIKFL<br>LDNLKAVQHFIKPLLGDGNEADKDNRFYGELTALWNELDQVTRLYNKVRNYMTRKPYSVDKIKINFK<br>NSTLLNGWDRNKERDNTAVILRKDGKFYLAIMHKEHNKVFEKFPVGTKDSDFEKMEYKLLPGANKM<br>LPKVFFSKSRIDEFKPSAELLQKYQMGTHKKGELFSLNDCHSLIDFFKASIEKHDDWKQFNFHFSPTSS<br>YEDLSGFYREVEQQGYKLTFKSVDADYINKMVDEGKIFLFQIYNKDFSEHSKGTPNLHTLYWKMLFDE<br>RNLQNVVYKLNGEAEVFFRKKSLTYRPTHPKKEPIKNKNVQNAKKESIFDYDLIKNKRFTVDSFQFHV<br>PITMNFKSEGRSNLNERVNEFLRQNNDAHIIGIDRGERHLLYLVVIDRHGNIVEQFSLNSIINEYQGNT<br>YATNYHDLLDKREKEREEARESWQSIENIKELKEGYLSQVVHKIADLMVKYHAIVVLEDLNMGFMRG<br>RQKVEKQVYQFEKMLIDKLNYLVDKKQDAETDGGLLKAYQLTNQFESFQKLGKQSGFLFYVPAWN<br>TSKIDPCTGFTNLLDTRYESIEKAKKFFQTFNAIRYNAAQGYFEFELDYNKFNKRADGTQTLWTLCTYG<br>PRIETLRSTEDNNKWTSKEVDLTDELKKHFYHYGIKLDADLKEAIGQQTDKPFFTNLLHLLKLTLQMRN<br>SKIGTEVDYLISPIRNEDGTFYDSRQGNKSLPANADANGAYNIARKGLWVINQIKQTPQDQKPKLAIT<br>NKEWLQFAQEKPYLKD |
| 444 | MMETFSDFTNLYPLSKTLRFRLIPVGKTLRHFIDSGILEEDQHRAESYVKKAIIDDYHRSYIESSLSAFEL<br>PVESMGKSNSLEEYYLYHNIRNKTEDIQNALSKVRNNLRKQIVAQLTKNEMFKRIDKKELIQNDLIDFV<br>KNEPDANEKIALISEFRNFTVYFKGFHENRKNMYSDEEKSTSIAFRLIHENLPKFIDNMEVFAKIQNTSI<br>SEKFDAIQKELCPDSVAFVDMFKLGYFNRTLSQRQIDAYNTVISGRTTAEGEKIKGLNEYINLYNQQHK<br>QEKLPKMKLLFKQILSDRESASWLPEKLENDKQVVGALVDFWNAIHDTVLAEGGLKTVISSLVSYSLE<br>GIFLKNDLQLTDVSQKATGSWSKIPAAIKQKLEAMNPQKKKESYEGYQERIDKIFKSYKSFSLAFINECL<br>HGEYKIEDYFIKLGAINTDLLQKENHFSHILNTYTDIKEVIESYSESTDTKLIRDNGSIQKIKQFLDAVKDL<br>QSYVKPLLGNGDETGKDERFYGDFVEYWNQLDSITPLYNMVRNYVTQKPYSIEKIKINFQNPTLLNG |

TABLE S14A-continued

Enzyme Sequences Group 14 (SEQ ID Nos: 436-456)

| SEQ ID NO | Sequence |
|---|---|
| | WDLNKETDNTSVILRRDGKYYLAIMNSKFRKVFLKYPSGSDRNCYEKMEYKLLPGANKMLPKVFFSKS RIQEFMPDERLLSNYEKGTHKKTGNCFSLTDCHALIDFFKKSLNKHEDWKNFGFKFSNTSTYTDMSGF YKEVENQGYKLSFKPVDAVYVDQLVDEGKIFLFQIYNKDFSEHSGTPNMHTLYWKMLFDETNLGD VVYKLNGEAEVFFRKASIKVSSPTHPANVPIKKKNPKHKDEERLLKYDLIKDKRYTVDQFQFHVPITMN FKSDGNGNINQKVVEYLRSASNIHIIGIDRGERNLLYLVVIDGSGKICEQFSLNEIKVEHNGETYSTNYH DLLDIKENERKQARQSWQSIANIKELKEGYLSQVIHKISELMVKYNAIVVLEDLNTGFMRGRQKVEKQ VYQKFEKMLIEKLNYLVFKKQPSDSCGGLMHAYQLTNKFEGFNKLGKQSGFLFYIPAWNTSKMDPM TGFVNLFDLKYESIDKAKSFFSKFDSIRYNVERDMFEWKFNYDEFTKKAEGTKTNWTVCSYGNRIITFR NPNKNSQWDNKEINLTENIKLLFERFGIDLSSNLKDEIMQRTEKEFFIELISLFKLVLQMRNSWTGTDID YLVSPVCNEKGEFFDSRNVDKALPQNADANGAYNIARKGLILLDRIKESTSDKKLNFSITNKEWLSFVQ GCCKNG |
| 445 ID419 | MPNISEFSEHFQKTLTLRNELVPVGKTLENIISSNVLINDEKRSEDYKKAKEIIDSYHQEFIEKSLSSVTVD WNDLFSFLSRKEPEDYEEKQKFLEELESIQLEKRKSIVNQFEQYDFGSYTDLKGKKTKELSFESLFKSELF DFLLPNFIKNNEDKKIISSPNKFTSYFTGFYENRKNLYTSAPLPTAVAYRIVNDNFPKFISNQKIFRVWKD NVPKFVEIAKTKLREKGISDLNLEFQFELSNFNSCLNQTGIDSYNELIGQLNFAINLECQQDKNLSELLRK KRSLKMIPLYKQILSDKDSSFCIDEFENDESAINDVISFYKKAVCENGPQRKLSELLRDLSSHDLDKIFIQG KNLNSISKNLFGGKNWSLLRDAIIAEKSKDKSYKKAIKTNPSSDDLDRILSKDEFSISYLSKVCGKDLCEEI DKFIKNQDELLIKINSQAWPSSLKNSDEKNLIKSPLDFLLNFYRFAQAFSSNNTDKDMSLYADYDVSLSL LVSVIGLYNKVRNYATKKPYSLEKIKLNFENPNLATGWSENKENDCLSVILLKNQIYYLGILNKSNKPNF SNGISQQPSSESCYKKMRYLLFKGFNKMLPKCAFTGEVKEHFKESSEDYHLYNKDTFVYPLVINKEIFDL ACSTEKVKKFQKAYEKVNYAEYRQSLIKWISFGLEFLSAYKTTSQFDLSNLRKPEEYSDLKEFYEDVDNL TYKIELVDLKEEYVDSLVENGQLFLFEIRNKDFAKKSSGTPNLHTLYFKSIFDPRNLKNCIVKLNGEAEIFY RKKSLKIDDITVHQKGSCLVNKVFFNPDSGKSEQIPDKIYNNIYAYVNGKSTTLSKEDEFFYTKATIKKAT HEIVKDKRFTVDKFFFHCPITINYKSKDKPTKFNDRVLDFLRKNEDINIIGIDRGERNLIYATVINQKGEII DCRSFNTIKHQSSSVNYDVDYHNKLQERENNRKEEKRSWNSISKIADLKEGYLSAVIHEIALMMVKYN AIVVMENLNQGFKRIRGGIAERSVYQKFEKMLIDKLNYFVIKNENWTNPGGVLNGYQLTNKVSTIKEI GNQCGFLFYVPAAYTSKIDPSTGFVNLLNFNKYNNSDKRRELICRVEICVYQNENLFKFSIDYGKLCPD SKIPVKKWDIFSYGKRIVKEDLKTGYMKENPEYDPTEELKNLFTLMRVEYKKGENILETISIRDMSREF WNSLFKIFKAILQMRNSLTNSPVDRLLSPVKGKDATFFDTDKVDGTKFEKLKDADANGAYNIALKGLLI LKNNDSVKTDKELKNVKKVSLEDWLKFVQISLRG |
| 446 | MKRLIDFTNIYQRSKTLRFRLEPIGKTADYIKVSQYLETDERLAKESKKVKELADEYHKEFIGDVLSSLELP LSKINELWDIYMSNDTDREIKFKKLQENLRKVIAEAFSKDKRFGSLFKKEIITDILPKFLQDKDDDIKIVNR FKGFTTYFYAFHKNRENMYVSEEKSTAIPYRIVNQNLVKYFDNYKTFKEKVMPLLKDKNIVESIERDFK DILNEKSIEDVFGLANFTHTLCQADIEKYNTLIGGLVVKNEKKEIKGINQYINEHNQTSKKGNGIPKLKPL FNQILSDRKSLSFTLDDIKKTSEAIRTIKDEYENLRDKLATIERLIKSIKEYDLAGIYIKMGEDTSTISQHWF GAYYKIIEAIADAWERRNPKKNRESKAYSKYLSSLKSISLQEIDDLKIGEPIENYFATFGTTCSDRTSGVSS LNRIEAAYTEFVNKFPEGFEDGDDCNDAYFKANVEVVKNLLDSIKDFQRFVKPLLGNEDERDKDEAFY GEFVPTYTDMDNIITPLYNRVRNFATKKPYSTDKIKINFEKSTLLTGWANYKQYGGVLFCKNDSDFYLG IVKSSKTEIHTVDDSASDIYRIDYALIPNPGKTIPCLMFRDEVKAEKVNGRKDKRTGENLRLEEEEKDKYLP AEINRIRKSRSYLKSSECYCNQDMVAYIDYYKKCCISYYDKLSFTFKDSSMYSDWNDFIADVDGQGYQ LNRIPVSMQELENLVDNGNMLLFRIANKDFSPNSKGRPNLHTIYWRMLFDPANLKDVVYQLNGNAE IFFRKASITRTEPTHPANVAIKNKSEYNKQNKPYSTFKYGLIKDRRYTTDQFEFHVPITMNFKQPESSKL QDKLNKQVLDFLKQDGVRHIIGIDRGERNLLYLVMVDMEGKIKKQISLNEIAGNPKNSEFKQDFHALL REREGDRLESRRSWNTIQSIKDLKEGYMSLVVHEIANMMLENDAIVVLENLNRSFMQKLGGREKSVY QKFEKMLIDKLGYIVDKTKDVSDNGGALHAVQLADTFENFNKTQKGAIRQCGFIFYIPAWRTSKIDPV TGFVPMLRCQYESIVASKDFFGKFDSIYYDATGKYFVFQTDFTKFNTESKGGIQKWDICTYGDRIYTPR TKDRNNSPVSERVNLTEAMKSLFVLHNINIQGDIKAGIMQQTDKAFFESLHRLLRLTLQIRNSKKSTGE NYEDYIISPVMGKDGRFFDSRNADATQPKDADANGAYNIARKGLMLLRQIQAQEKQDLSNGKWLE FAQR |
| 447 | MIIYNCYIGGSFMKKIDSFTNCYSLSKTLRFKLIPIGATQSNFDLNKMLDEDKKRAENYSKAKSIIDKYHR FFIEKALSSVTENKVFDSFLEDIRAYAELYYRSNKDDSKASMKTLESKMRKFIALALQSDEGFKDLFGQ NLIKKTLPEFLESDADKEIIAEFDGFSTYFTGFFNNRKNMYSADDQSTAISHRCINDNLPKFLDNVRTFK NSDVANILNNNLKILNEDFDGIYGTSAEDVFNVDYFPFVLSQKGIEAYNSILGGYTNSDGSKIKGLNEYI YLYNQKNGNIHRIPKMKQLFKQILSERESVSFIPEKFDSDDDVLSSINDYYLERDGGKVLSIEKTVEKIEK LFSAVTDYCTDGIFVKNAAELTAVCSGAFGYWGTVQNAWNNEYDALNGYKETEKYIDKRKKAYKSVE SFSLADIQKYADVSESSETNAEVTEWLRNEIKEKCNLAVQGYESSKDLISKPYTESKKLFNNDNAVELIK NALDSVKELENVLRLLLGTGKEESKDENFYGEFLPCYERICEVDSLYDKVRNYMTQKLYKTDKIKINFSN SHFLSGWAQTYSTKGALIVKKENNYYLVIVDKKLSNDDIVFLGTNTQLSPAERIVYDFQKPDNKNTPRL FIRSKGTSYAPAVKEYDLPISDIIEIYDNEYFKTEYRKINPKGYKEALIKLIDYFKLGFSRHESYRCFNFKWK ESEQYSDISEFYNDVVKSCYQLKSESINFDSLLKLVDEGKLYLFQLYNKDFSEHSKGTPNLHTLYFKMLF DERNLENVVFKLNGEAEMFYREASISKDDMIVHPKNQPIKNKNEQNSRKQSTFKYDIVKDRRYTVDQ FMLHIPITLNFTANGGTNINNEVRKALKDCDKNYVIGIDRGERNLLYICVVDSEGRIIEQYSLNEIINEYN GNTYSTDYHALLDKKEKERLESRKAWKTVENIKELKEGYISQVVHKICELVEKYDAVIVMEDLNPGFKQ GRSGKFEKSVYQKFEKMLIDKLNYFADKKKSPEEIGSVLNAYQLTNAFESFEKMGKQNGFIFYVPAYLT SKIDPTTGFADLLHPSSKQSKESMRDFVGRFDSITFNKTENYFEFELDYNKFPRCNTDYRKKWTVCTY GSRIKTFRNPEKNSEWDNKTVELTPAFMALFEKYSIDVNGDIKAQIMSVDKKDFFVELIGLLRLTLQM RNSGKEVDRDYLISPVKNSEGVFYNSDDYKGIENASLPKDADANGAYNIARKGLWIIEQIKACENDA ELNKIRLAMSNAEWLEYAQKK |
| 448 | LLPARRCNGAVPHIRHTDNHATPGHSMSLDSFTRKYKLAKTLRFELRPVGRTLETFRSKFLPGDERRA AAYPGAKEMLDNEHKALLERALANPPAGLDWSGLAQAHDTYRTSDKSKAAKGALAARQAVFRKAL ADHLTKDPSYKTLTAATPKDLFKALKARCEEAGQPVPGDLQTFLRFSCYFKGYQENRRNIYSDKAQAT |

TABLE S14A-continued

Enzyme Sequences Group 14 (SEQ ID Nos: 436-456)

| SEQ ID NO | Sequence |
|---|---|
|  | AAANRAVNGNFPRFLEDVRIFRHIAERYPQIPADAARELAPLLEGRTLDSIFTPAAYNGFLAQSRIDFF<br>NSVLGGFVPAEGEKTRGINEFVNLYRQRHEDAREDRALAPLRPLHKQILSDRESHSLVPRMFENDGA<br>VVSAIREMLDKRLLALETENGTENVPDALQSLLATLSPSPAIWIDGAEITRVSKDLLGSWNALSILMEA<br>AAEIRFASESTEKKRDAAVANWMKKPVFSLAEMGGLRVDTDNGANPVDVSGLWKGPVAAARFDA<br>VRKAVAEVRPVLDSAPSGEGTPLREREQEDIARIKAALDAILDLLRFVKPLRAGGELDRDEAFYGAFDPL<br>FDALDGFVPLYNKVRNYLTRKPGETGSVKLMFDNPSFLEGWEQNLETKRTSILFFRDGFYYLGVMAP<br>DAKINFSAFAVSAASGCYRKVVYKAISKAAQYFSIKQIKPQNPPQFVLDWLAKGFDKKTLHRDQLTRLI<br>SYVMDDFIPNYPPLKDGSGRVAFDFSFRKPSEYGSWKEFTDHIASMAYKISFEDIPAEAVDRLVEEGKL<br>CLFLLWNKDFSQASNGRPNLHTMYWKAVFSPENLRDVVIKLNGEAEVFYRPKSIRTPFRHKVGEKM<br>VNRRGRDGAPVPEAIHGELFRHANGDTAPLSGAARQWLESGNLVVKEVTHEIVKDARFAADKFSPH<br>VPVTINFKQPDVSARFNDQVRAFLRANPDVKVIGIDRGERNLLYLALVDREGNLLEQRSFNTVSRTRK<br>DGVVTPTDYQAKLVQSEKDRAEARASWAEIGAIKDLKAGYLSAVVHEIAEMMVKHNAIVVLEDLNF<br>GFKRGRFRIERQVYQKFEKALIDKLNYLVFKDRGMEEPGGTLRGYQLTDAFESFEKIGKQTGFLFYVPA<br>GYTSKIDPTTGFTNLFNTKKCTNAAGIRDFFAAFDAIRWDAARRVFAFSFDYRNFKTSQESHRTKWTV<br>YSADRRLAFDKESRSEREINPTAILLGALEERGIAVADGFDLKALLLATEPSKANAAFFRSVFYAFDRTL<br>QMRNSRAEEDYIHSPVLNARGGFFDSREAGDALPREADANGAYHIALKGVQLLEENLAAETPNLKIE<br>HKDWFRFAQELAERKFR |
| 449 | MNKAADNYTGSNYDEFIALSKVQKTLRNELKPTPFTAEHIKQRGIISEDEYRAQQSLELKKIADEYYRN<br>YITHKLNDINNLDFYNLFDAIEEKYKKNDKENRDKLDLVEKSKRGEIAKMLSADDNFKSMFEAKLITKLL<br>PDYVERNYAGEDKEKALETLTLFKGFTTYFKGYFDIRKNMFNGEGGASSICHRIINVNASIFFDNLKTF<br>MRIQEKAGDEIALIEEELTEKLDGWRLEHIFSRDYYNEVLAQKGIDYYNQICGDINKHMNLYCQQNKF<br>KANIFKMMKIQKQIMGISEKAFEIPPMYQNDEEVYASFNEFISRLEEVKLTDRLRNILQNINIYNTAKIYI<br>NARYYTNVSSYVYGGWGAIDSAIERYLCNTIAGKGQSKVKKIENAKKDNKFMSVKELDSIVAEYEPDY<br>FNAPYIDDDDNAVKAFGGQGVGLGYFNKMSELLADVSLYTIDYNSDDSLIENKESALRIKKQLDDIMSL<br>YHWLQTFIIDEVVEKDNAFYAELEDICCELENVVTLYDRIRNYVTKKPYSTQKFKLNFASPTLAAGWSR<br>SKEFDNNAIILLRNNKYYIAIFNVNNKPDKQIIKGSEEQRLSTDYKKMVYNLLPGPNKMLPKVFIKSDTG<br>KRDYNPSSYILEGYEKNRHIKSSGNFDINYCHDLIDYYKACINKHPEWKNYGFKFKETNQYNDIGQFYK<br>DVEKQGYSISWAYISEEDINKLDEEGKIYLFEIYNKDLSAHSTGRDNLHTMYLKNIFSEDNLKNICIELNG<br>EAELFYRKSSMKSNITHKKDTILVNKTYINETGVRVSLSDEDYMKVYNYYNNNYVIDTENDKNLIDIIEK<br>IGHRKSKIDIVKDKRYTEDKYFLYLPITINYGIEDENVNSKIIEYIAKQDNMNVIGIDRGERNLIYISVIDNK<br>GNIIEQKSFNLVNNYDYKNKLKNMEKTRDNARKNWQEIGKIKDVKSGYLSGVISKIARMVIEYNAIIV<br>MEDLNKGFKRGRFKVERQVYQKFENMLISKLNYLVFKERKADENGGILRGYQLTYIPKSIKNVGKQCG<br>CILYVPAAYTSKIDPATGFINIFDFKKYSGSGINAKVKDKKEFLMSMNSIRYINEGSEEYEKIGHRELFAFS<br>FDYNNFKTYNVSSPVNEWTAYTYGERIKKLYKDGRWLRSEVLNLTENLIKLMEQYNIEYKDGHDIRED<br>ISHMDETRNADFICSLFEELKYTVQLRNSKSEAEDENYDRLVSPILNSSNGFYDSSDYMENENNTTHT<br>MPKDADANGAYCIALKGLYEINKIKQNWSDDKKLKESELYIGVTEWLDYIQNRRFE |
| 450 | MTSLYPTSKTIRFKLEPIGKTSENINKNGILSADECKAKDYLKIKETIDAYHKYFIDQQLRLVKTETINKQK<br>TGTKFFLIDGVQNVYNIYNNLKKDRKDEKNRRLFLDKCTALRKKLVSEAFPSEVIKKLTSGKLFTDILPE<br>WVAQENTTRSNEKKLFWSDTFKRFSTYFSGFHENRENMYSGEEKSTAIAYRLINENLPRFFDNVENF<br>GKIQNTLKEWTSIFSDKEKQLFNEKTIKSTFVLENYANCLTQSDITCYNNLICGYTSENKEKVRGLNEFIN<br>LHNQKIKDKKEKLRSFKLLYKQILSDRETVSFIPYQFTSINKLYDAINNFYLVCIVNEKDDGGENCNVFEA<br>IEKHFKKIKDGNYDLKHIYISHRSVSSISQKVFGRYSFIKDALEYYYCTDIRPKYEEEIQKAKPSKREKIEKEL<br>DNYVNQQYLPIELVDKACEKYSKTLEDNFKHSESSAITDYCAHFLTKIISSKTYSAGKYEDERYSCIKGEL<br>NTQHDENYHPSTEVVNNIKLFMDTILESIHRLRDFIIRRDEENICEKDEHFYEFIDKLWEKLSAFINLYDK<br>TRNYLTGKPYSTDKIRLTFNIPALADGWDENKEKDCRAFIFKKSEQYYLGIAAKSGLHFVYNDKEHNLS<br>SCYWKMIYKYFPDPSKMIPKCTITTKDVKTHFASSDDNYELFDPKKFVKPIIISKDIYDIYFNAGPKPAFT<br>GEFIKNGGDQKEYKNALTKWIDFSKQFLSSYSSTAVYNFDSLRPSNSYQNISEFYSEIAALTYKINFKPIL<br>SKYIDDLVQKGDLYLFRITTKDFNSTHGMPNLHTLYWRSLFSEENLVKTCIKLNGQANIFYRVPSITSPV<br>IHKKGSILVGRTATNGKNIPEHIYTELCLIKNGKKAEKDADTETREYLTKIKIREAQYDIIKDRRFTQSTFLF<br>HVPLTFNFGIKPSKTFEFNNKINDFLKKHDDVNIIGIDRGERHLLYVSVINRQGDILEQTTLNILNGVDY<br>HSKLDNREKERAGARKNWGTIGRIADLKEGYLSIVIHTLVEMMIRYNAIIVMEDLNTGFKRGRFKVEK<br>QVYQKFEKALITKLNYLCLKDIAIDKIGGILHGWQLTNPFESFKKMGHQNGIIFYIPAWNTSKIDPITGF<br>VNVIKHKYTNRESANKFFENFKEISYKSKDDAFDFVYIDKFSGKNWIITTGGKVRYFWLKDPSGHGGS<br>TQKVDITQKLKNCFTKNNIPWENGENIVETLTTSVNASVLKEVIWCLQRVLAMRNSSAEDGVDFILSP<br>VRMPDGRTFCSNNAGEKLPCDANGAYNIARKGILVMEKIKAGDKNPTLIKNEDWLNYAQSEVVVA<br>MQMKKYK |
| 451 | LSQSEIDSYNSKVGNLNYLVNLYYQQTKNNLPKFKSLFKQIGCGEKKDFLKTIKDNDELNDVLTKAKNL<br>GDKYFTGGKDKETVKAFTDYLLNLDNFENIYWSDKAINTISGKYFGNFGNLKEKLIKAKIFNEDKNSGE<br>AKVPRAVQLSDLFEVLDGQDDWDKEGVLFRENFKDNNKAKQDIIKNAQTPHEALLKMICNDIEDLSK<br>KFIKGADEVLKIEKGDYQKDESKIAIKAWLDDALFAGQILKYWRVKAKYSIDGNFTEILDKVKVFEVVK<br>DYDVVRNYLTQKPQNKLGKLKLNFENSSLAAGWDINKEKDNSCVILQNEHGKQYLAIMKYEETSVFE<br>QNKKNELYMSDNSGWKKINYKLLPGPNKMLPKVLFSSKWVTNNPTPANIKKIYGKGTFKKGDNFNK<br>NDLHILLDFYKNQLKKYPSEKESWDKIFNFDFSNTKSYESVDRFYAEVEKQGYKLEFIPVKKNKIEELVE<br>NGKIYLFEIKSKDSNLKNGKEKTSAKDLQTIYWNRIFSDIENKPKLNGEAEIFYRPALEGKNLRKKWKN<br>KEIIENFRFSKEKFIFHCPITLNPCLKNKRINDLVNQVIVETKNQLFLGIDRGEKNLAYYSLVNQRGEILEQ<br>GSFNIIINKQNYWEKLDIKQGDRDLARKNWTTIGNIKDLKDGYISQVVRKIVDLAVYNEGDRKKGFRET<br>PALIILEDLNIGFKRGRQKIEKQVYQKLELALAKKLNFLVDKSAKDGEMASVDNALQFTPPVHDFNDIK<br>GKQFGIMFYTNPSFTSATDPITGWHKTISIKKGSEIKEQIFDLFSDFGFDGKDYYFKYKDANIGKEWILY<br>SGKNGAELDRYRDKFSEKEGKKHWSPDRIDIVKNLENIFKGFDKNKSFKEQIKDGKELNKFDKERTAW<br>ESLRFVIDVIQQIRNTGEDEKDNDFILSPVRGASGDFFDSRKIKNGAKLPQNGDANGAYNIARKGIIMS<br>EHIKRNADLFVRNEEWDAWLAGEKNWVDYMANNLKIRQKTV |

TABLE S14A-continued

Enzyme Sequences Group 14 (SEQ ID Nos: 436-456)

| SEQ ID NO | Sequence |
|---|---|
| 452 | MREKKSSEKLADNFIGVYPVSKTLRFELIPQGKTLEYIQRDGILDSDHHRAENYQKVKELIDRYHKIFIDE<br>ALQSIRLENLSEYERLYSAKRDEKQDREFQEIQTSLRKQIAKKFRSHSKYKNLFNKELIKKELILFLKDEPE<br>KRSLVEEFADFTTYFTGFNANRENMYSDEAKGTAIAYRIVHENLPKFIDNMNAFKCLKESGAFLKVKD<br>SLPSLQKKFGLDSVEYFFTIDGFTQVLSQKGIDIYNGVLGGYICEDDTKIQGLNEIINLYNQQQKGEKNR<br>LPKLKVLYKQILSDRESNSFVLDKFENGQEVLEAVKNCYVHFYKYIFEPEEEMSLNNLINDLENFDLGKI<br>YIANDVSITDISQYIYGDWSILRKAISEDYDRHHLSEKMTRDPEKYEDKKQKELKRRELYSIRELNRMAQ<br>EYAGTVCNIENYFILQISERLMKINHEYEACRSLLEGESEEKELYKDKNAVLKLKNLLDAMKELQLLIKPLI<br>KGREKAEKDELFYVELVRIWDELNAVNQLYNKVRNYATQKPYSLEKVKLNFNKSTLLDGWDRNKEKD<br>NLGVILIKDNKYYLGIMNRNSNRVMEDAPAAVSTNRYQKMEYKLLPGPNKMLPKVFFSASRIDEFAP<br>DEELLEKYKEGTHKKGDNFSLEDCHRLIDFFKRSLKKHPEWSEFDFSFSDTETYKDISGFYREVERQGYK<br>ITFKDIDADYIEKLVEEGQLYLFQIYNKDFSPYSKGTPNLHTIYWKTLFSPDNLKDVVYKLNGQAEIFYRR<br>KSIEEKDIICHPSNEELRNKYPKAEKPTSKFPYELTKDRRFTVDKFQFNPVPITMNFKAKGENYFNRKVRR<br>LIHNCQDMHVIGIDRGERNLLYLSVIDMQGKIKEQLPLNDIVSTNKNEVIHHKDYHLLLEKREEENKAA<br>RQDWQTINTIKELKEGYLSQAIHIIAELMLKYNAIVVLEDLNFGFMRSRQKFEKQIYQKFERMLIDKLN<br>YLVDKKRDINENGGALRAYQLTDKFESFQKLGKQSGFLFYVPAWNTSKIDPSSGFVNLFYTKYETKEKT<br>RDFIKKFDSIIYNEQENYFEFYFDYSNFTYKAEGSRTKWCLCTEGNRIETFRNPAKNAEWDTKEIILTEG<br>FAGLLEKYHISWKSGEIKKAISEIEEAEFYRSFMHFMSLLLQMRNSDKKAGEDWLMSPVKNSRGEFFK<br>TDKDSEDYPRDADANGAYNIAKKGLWIIEQIQKTEIDQLDKVKIAISNKEWLAYAQEHVL |
| 453 | MKNFQDFTNLYELSKTLRFELKPIGGTKKLIEEKNILKLDKKKRENYEKVKPYFNKIHQEFINFALRNPNF<br>DFSQFEEKYLNWLKDKKNKDLLKEKESIDKIFLEKIGKLFENSVKDFLKENGFESIVKEEDQNLKFFRRKE<br>IFEVLQEKYGSELETQMVNKDGEIKSIFNGWEKWLGYFDKFFNTRDNFYKTDGTSTAIATRIIKDNLKIF<br>LENIVAFGKIKNKKIDFSEVEKNFSVSIDTFFEINNFNNCFLQDGIDFYNKVIGGETLENGEKLKGLNEIIN<br>KYRQDTGEKIPYFKKLQKQILSEKDGVFIDKIEDDGGFYEVLKNFYKNAAEKEGFLKNIFENFYTISDKNL<br>EKIYFNKIAFNTISHKFGSALEFERILYEEMKKEKADGIKFEKKENKYKFPDFIQIIFIKRSLENYDSENLFW<br>KERYYKSEENVDGFLEKNNNNLWGQFCKILNFEFLNILKRRIIDEAGEEYEVGFEISKNILGEKLENFELN<br>QENKGIIKDFADYSLALYSFGKYFAVEKGRNWDLNIDISDDFYGGEDGYIEKFYNTGYDEIVKPYNLMR<br>NYISKKPWEDNKKWKINFETSSLLSGWDKNLESNGSYIFQKGNKYYLGIINGSKPAKEILEKLYSGDGE<br>KIKRFIYDFQKPDNKNTPRMFIRSKKDSFSPAVEKYNLPINDILEIYDNGLFKTENKGNPNYKESLRKLID<br>YFKLGFSRHESFKHFNFVWKDSKSYENIADFYRDVEKSCYKIDFEFLNFEELKKLTFEKHLYLFQIYNKDF<br>ELDESLQEKGYNFKGEGQKNIHTKYFEALFLEENISRKSGAVFKLSGGGEVFFRKKSIKAKKEKRNSVEV<br>IKNKRYTECKYFLHPFPIQVNFKEEISGNFNQEINKFLANNPDINVIGIDRGEKHLAYFSVINQKGEILESG<br>SFNKIENYNKNGEKLLFPEREIKEIHKDGSLIDLELVETGRKVDYVDKLLLEYKERKRLLQRQSWKEVE<br>QIKDLKKGYISALVRKIADLIIKHNAIVIFEDLNFRFKQIRGGIEKSIYQQLEKALIDKLNFLVNKNEINLEK<br>AGSILKAYQLTVPVDSLKEIGKQTGVIFYTEAAYTSKIDPITGWRPNLYLKKNNSKINKENILKFDNIVFN<br>SKENRFEFTYDLKKFFGKDSKFPAKTVNTVCSCVERFKWNRNLNNNKGGYIHYENLTDGKLANKEQK<br>EDEFSNFKELFEKYFIDINGNILEQIKNLDTKNNEKFFSSFIDLFTLVCQIRNTNQNAKGDENDFILSPVE<br>PFFDSRKSQNFGKSLPKNGDENGAFNIARKGLIILNRISENPEKPDLLIFNADWDNFARNI |
| 454 | MLFQDFTHLYPLSKTVRFELKPIGKTLEHIHAKNFLSQDKTMADMYQKVKAILDDYHRDFIADMMGE<br>VKLTKLAEFCDVYLKFRKNPKDDGLQKQLKDLQAVLRKEIVKPIGNGGKYKVGYDRLFGAKLFKDGKE<br>LGDLAKFVIAQESESSPKLPQIAHFEKFSTYFTGFHDNRKNMYSSDDKHTAIAYRLIHENLPRFIDNLQI<br>LATIKQKHSALYDQIASELTASGLDVSLASHLGGYHKLLTQEGITAYNRIIGEVNSYTNKHNQICHKSERI<br>AKLRPLHKQILSDGMGVSFLPSKFADDSEMCQAVNEFYRHYADVFAKVQSLFDRFDDYQKDGIYVEH<br>KNLNELSKRAFGDFGFLKRFLEEYYADVIDPEFNEKFAKTEPDSDEQKKLAGEKDKFVKGVHSLASLEQ<br>VIEYYTAGYDDESVQADKLGQYFKHRLAGVDNPIQKIHNSHSTIKGFLERERPAGERALPKIKSDKSPE<br>MTQLRQLKELLDNALNVVHPFAKLVSTETVLDTRSDKFYGEFRPLYVELAKITTLYNKVRDYLSQKPFSTE<br>KYKLNFGNPTLLNGWDLNKEKDNFGVILQKDGCYYLALLDKAHHKVFDNAPNTGKSVYQKMVYKQI<br>ANARRDLACLLIINGKVVRKTKGLDDLREKYLPYDIYKIYQSESYKLSPNFNHQDLVKYIDYNKILASGY<br>FEYFDFRFKESSEYKSYKEFLDDVDNCGYKISFCNINADYIDELVEQGQLYLFQIYNKDFSPKAHGKPNL<br>HTLYFKALFSEDNLANPIYKLNGEAQIFYRKASLDMNETTIHRAGEVLENKNPDNPKQRQFVYDIIKDK<br>RYTQDKFMLHVPITMNFGVQGMTIEGFNKKVNQSIQQYDDVNVIGIDRGERHLLYLTVINSKGEILE<br>QRSLNDIITTSANGTQMTTPYHKILNKKKEGRLQARKDWGEIETIKELKAGYLSHVVHQISQLMLKYN<br>AIVVLEDLNFGFKRGRLKVENQVYQNFENALIKKLNHLVLKDKTDDEIGSYKNALQLTNNFTDLKSIGK<br>QTGFLFYVPARNTSKIDPETGFVDLLKPRYENITQSQAFFGKFDKICYNTDKGYFEFHIDYAKFTDEAKN<br>SRQTWVICSHGDKRYVYNKTANQNKGATKGINVNDELKSLFACHHINDKQPNLVMDICQNNDKEF<br>HKSLMYLLKALLALRYSNANSDEDFILSPVANDEGVFFNSALADDTQPQNADANGAYHIALKGLWVL<br>EQIKNSDDLDKVDLEIKDDEWRNFAQNR |
| 455 | MNNYDEFTKLYPIQKTIRFELKPQGRTMEHLETFNFFEEDRDRAEKYKILKEAIDEYHKKFIDEHLTNM<br>SLDWNSLKQISEKYYKSREEKDKKVFLSEQKRMRQEIVSEFKKDDRFKDLFSKKLFSELLKKEEIYKKGNH<br>QEIDALKSFDKFSGYFIGLHENRKNMYSDGDEITAISNRIVNENFPKFLDNLQKYQEARKKYPEWIIKA<br>ESALVAHNIKMDEVFSLEYFNKVLNQEGIQRYNLALGGYVTKSGEKMMGLNDALNLAHQSEKSSKG<br>RIHMTPLFKQILSEKESFSYIPDVFTEDSQLLPSIGGFFAQIENDKDGNIFDRALELISSYAEYDTERIYRQ<br>ADINRVSNVIFGEWGTLGGLMREYKADSINDINLERTCKKVDKWLDSKEFALSDVLEAIKRTGNNDAF<br>NEYISKMRTAREKIDAARKEMKFISEKISGDEESIHIIKTLLDSVQQFLHFFNLPFKARQDIPLDGAFYAEF<br>DEVHSKLFAIVPLYNKVRNYLTKNNLNTKKIKLNFKNPTLANGWDQNKVYDYASLIFLRDGNYYLGIIN<br>PKRKKNIKFEQGSGNGPFYRKMVYKQIPGPNKNLPRVFLTSTKGKKEYKPSKEIIEGYEADKHIRGDKF<br>DLDFCHKLIDFFKESIEKHKDWSKFNFYFSPTESYGDISEFYLDVEKQGYRMHFENISAETIDEYVEKGD<br>LFLFQIYNKDFVKAATGKLDMHTIYWNAAFSPENLQDVVVKLNGEAELFYRDKSDIKEIVHREGEILV<br>NRTYNGRTPVPDKIHKKLTDYHNGRTKDLGEAKEYLDKVRYFKAHYDITKDRRYLNDKIYFHVPLTLNF<br>KANGKKNLNKMVIEKFLSDEKAHIIGIDRGERNLLYYSIIDRSGKIIDQQSLNVIDGFDYREKLNQREIE<br>MKDARQSWNAIGKIKDLKEGYLSKAVHEITKMAIQYNAIVVMEELNYGFKRGRFKVEKQIYQKFEN<br>MLIDKMNYLVFKDAPDESPGGVLNAYQLTNPLESFAKLGKQTGILFYVPAAYTSKIDPTTGFVNLFNTS<br>SKTNAQERKEFLQKFESISYSAKDGGIFAFAFDYRKFGTSKTDHKNVWTAYTNGERMRYIKEKKRNEL |

TABLE S14A-continued

Enzyme Sequences Group 14 (SEQ ID Nos: 436-456)

| SEQ ID NO | Sequence |
|---|---|
| | FDPSKEIKEALTSSGIKYDGGQNILPDILRSNNNGLIYTMYSSFIAAIQMRVYDGKEDYIISPIKNSKGEFF<br>RTDPKRRELPIDADANGAYNIALRGELTMRAIAEKFDPDSEKMAKLELKHKDWFEFMQTRGD |
| 456 | MSNFNEFTHLYQLSKTLRFELKPIGETLKHFNESGILDQDEHRAESYKKVKKLIDRYHKEFMEEALRDF<br>VFQMDDEGKNNSLSEYFFLYSLGKRTEAQDNDFKDVKKNLREQIAKYFKASPKYKNLFKQELIKEDLC<br>NNMQCNEEEQKLVEEFHNFTTYFTGFHENRKNMYSDEEKSTAIAFRLVHQNLPKFIDNIGVFDRVRN<br>IDEIKAGIENLQKHFETEGLFKQGEKIEDFFTLDYYSRLAVQSRIEIYNAILGGKTTEKGEKIQGLNELINL<br>YNQQHKETHLPKMKALFKQILSDRQAVSWIEESFKSDNEVLSSVNDFYENLKQNEIFERTKELLTSVGS<br>YDLSKVYITNDQQLTSISQQLYGSWAVIENAILAEMQNETPRKKKEDAEKYNERLKKAYSNRSSFSIAYI<br>DQCLEAVFGENRIPVEQHFANLGKAEIETEAECGKIKIPDVFTQIEQTYSAAKSLLCNPYPKDKHLSQSD<br>EDIEKVKNLLDALKRFQHFIKPLTGSGDEAEKDEMFYGDLAELWTEIDQLNSLYNKVRNHLTGKPYSE<br>EKLKLNFENATLLNGWDKNKEPDNTAIILRKDGLYYLAIMNKEHNRIFASDKLPNNGECYEKVIYKLLP<br>GANKMLPKVFLSKKGIEVFKPSQEILAIYNNGTHKKGDTFNINDCHKLIDFFKESISKHNDWKNFDFHF<br>SDTNSYEDLSGFYREVENQGYKITFQNISSDYIDNLVNEGKLYLFQIYNKDFSTKRDLSKHKEGTPNMH<br>TLYWQMLFDERNLNDGVYQLNGHAEVFFRKKSLNYTKPTHPANQPIAKKNPHSKNETSQFTYDLIKD<br>KRFTMDKFLFHVPITLNFKSGETDNINAKVRQWLQKADDVHIIGIDRGERHLLYLTVIDSKGNIKEQM<br>SLNTIENKYNGNTYAFDYHNRLDEKEKERDKAKKSWKTVENIKELKEGYLSQAIHKITQLMLKYNAIIVL<br>EDLNIGFMRGRQKVEKQVYQKFEKMLIDKLNYLADKKKDPSEVGGVLNAYQLTSKFESFTKLGRQSG<br>FLFYIPAWNTSKIDPVTGFVNLFDTQYKSDGKAKMFFSKFKSISYNKDKNWFEFSFDYNDFTSKADGT<br>KTEWTVCTNGERIENFRNGETSNQWGGRTINLSQKFKSLFDEYGIDFTKDLQNSICSQSKKGFFKQLL<br>HLFKLTVQMRNSNTETEEEKGKKDFIISPVCVDDKYYNSDIEAEKGKDEEGNWKSELPVNADANGAY<br>NIARKGLMILNHIKQSSDPSKKQEYDLTNKAWLNFVQKGSVEGK |

TABLE S14B

Human Codon Optimized Nucleotide Sequences Group X

| SEQ ID NO | Sequence |
|---|---|
| 457 | ATGAATACTATGACCCAACGTAGCCCCGTTAGCGGCGGAAAAAACCCTGAGGGCCAGAAGTCTGT<br>GTTTGACTCTTTCACACATAAGTACGCGCTGTCCAAGACGCTACGCTTCGAGCTCGTGCCACAGGG<br>CAAGACGTCTGAGAGTCTTAAGGCCGTGTTCGAAGAGGACAAAAAAGTTGAAGAGAACTATCAG<br>AAGACCAAGGTACGGCTCGACCAGCTGCACCGGCTTTTCGTGCAGGCATCCTTCACTGAGAGCAA<br>GGTCAGTGCGCTGAAACTCGCTTCTTTTGTCAGAGCTTACAATGCCCTGATTGGCGTCGCAAAAA<br>AACCCAGACCAAAGAACAGAAATCAGCTTATGAGAAAGAAAGAAAAGCCCTGCTCTATGAAGTG<br>GCCGGGCTTTTTGATGAGATGGGTGATGAGTGGAAGGCTCAGTATGAAGAAATCGAAGGGTCG<br>GGCGAACAGGAAAGCAAAAAAAGATCAAATTCTCCTCGACCGGTTGCAAGATTCTCACCGACGAA<br>GCCGTCCTGAATATCCTCATGGACAAATTCGCTGAGGACACCCAGGTATTCAGCACATTTTTCGGG<br>TTCTTCACATATTTTGGCAAATTCAACGAGACACGAGAAAATTTTTACAAGAGCGACGGGACTTCT<br>ACTGCCGTGGCGACCAGGGTTGTAGAAAATCTCGAGAAATTCCTTCGCAACAAACATATTGTGGA<br>GAGCGAGTATAAGAAAGTAAAAACTGCCATCGGACTGACTGATTCCGAAATCCTGGCTTTGACCG<br>ATGTCGAGGCCTATCACCGATGCTTTCTGCAGGCGGGGATCGATGTTTACAATACCGTTTTAGGC<br>GGCTCAACCGAGCTGGAACAATCAGTCAACAAAAAGGTGAACGAATCAGGCAGAAGACGGGTA<br>ATAAGATCAGTTTTCTCGCTAAACTGCACAACCAGATTCTCAGTGAAAAGGACGTATTCGAAATGC<br>TGGTGATTAAAGGTGATGCACAGCTCTGGGAAAAACTTAAAGTTTTTTCTGAGGAGAACGTGGCA<br>TACTGTACCAAAATGCTTGCCCTAATCCGGACGCTCTTACCATGCCTGAGAAGTCGGGATATGAG<br>TGGTCAAAGATCTATTTTTCATCAGGGGCCATAAATACGATTTCTTCCAAGTACTTCACAAACTGGT<br>CCGTGCTGAAGGGCGCACTGCTGGATGCTGTAGGCACAGCTAAGGGCGGTGGCGGAGAACTGCC<br>AGACTTCGTGTCACTGCAGCACGTTCAGAATGCATTAGACGTCAACGAAATCAATAAAGGGAAGA<br>AACCATCAGAACTTTTCAGAAGTGAAATCTTGAAGCACGCGGCTTTTGTTGAATCGGTGGGGCAT<br>TTCACTAATCTTATAACCATCTTGCTGAGCGAGCTGGACGCTCGTGTGGCGGAATCCGCGGTGGA<br>TTTGGCCGACTTAAAGAAGGACAGTTTCTGGACTACCGGTGCACTGTCTCAGAGACGGAAAGAA<br>AGGAGGATGAGGGAACTATCCAGATTAATAGGATATCTGCCTACCTCAACTCTTGTCGCGATGCA<br>CACAGGATGATCAAGTACTTTGCGACTGAGAATAGGAGAGACTGGGTCGAACCGGAGGAGGGG<br>TACGATCCAAAGTTTTACGATGCTTACCGGGAAGAGTATGCCAAGGACATATTTTTTCCTCTTTACA<br>ACGTCGCTCGCAACTTTTTAACGCAGAAACCCTCAGATGAGAATAAGGTTAAGTTGAACTTCGAAT<br>GCGGCACCCTCTTATCTGGCTGGGATAAGAATAAGGAGCAAGAAAAGCTGGGAATTATCCTTCGG<br>AAAGACGGAGCGTACTATCTCGCAATTATGAGAAAACAGTTCAGTGACATTCTGGAGGAGAAAA<br>AACATCCAGAGGCCTATAGAGCCGGCGACAACGGTTATTCCAAGATGGAATATAAGCTGTTTCCC<br>GATCCGAAAGGATGATACCTAAGGTAGCATTCGCCGAGACGAATAAGAAGACTTTTGGGTGGA<br>CACCCGAGGTCCAGGCTATCAAAGACGAGTACGCTAAGTTCCAGGAAAGCAAAAGGAGGATCA<br>GTCCGCCTGGAAAAATCAATTCGATGCCAACAAGACCGCCAGGCTCATCGCATATTACCAAAACT<br>GCCTGGCTAAGGGGGATATCAGGAGACGTTTGGTCTGACATGGAAGAAGCCCGAAGAGTACGT<br>AGGAATAGGAGAGTTTAATGATCACATTGCCCAACAAAACTACAAAATCAAGTTCGTTCCAGTGG<br>ACGCCGACTACATCTGATGAACACGTGGCCAAAGGAGAGATGTACCTATTCAAGATTAAGAGCAA<br>GATTTCGCCTCAGGCAGTACAGGGACTAAAAACGTGCACAGCCTGTATTTCAGCCAGTTGTTTTCC<br>GAGGCAAACCTAGCTCAGACTCCTACCGTCGTTCAGCTGGCCGGTAACGCAGAAATCTTCTATAG<br>GGAAGCCTCTGTGGAGCCCGAAAAGGAGAAACGAAACTTTCCTCGCGATATCACAAAGTATAAG<br>AGATTTACAGAGGATAAGGTGTTTTTTCATGTGCCGATAAAAATAAACGCCGGCACCGATGCTAT<br>GCGTTCCCAATATCAGTTCAACAAGATCCTGAACGCTGAATTGATTGCTAAAGAGCTAAGGATTT |

TABLE S14B-continued

Human Codon Optimized Nucleotide Sequences Group X

| SEQ ID NO | Sequence |
|---|---|
| | CTGTATTATTGGCATTGATCGTGGGGAAAAGCATTTGGCCTACTACTCTGTCATCAATCAGAAAGG<br>CGTGATCGTTGACGAGGGCAGTCTCAATGAAATTAGCGGGACAGATTATCACAAGCTCCTGGATG<br>GCAAAGAGAAGGAGCGGACCGCCAATCGGCAAGCTTGGCTGCCAGTGCGCCAAATTAAAGACCT<br>CAAGCGCGGCTATGTCAGCCATGCCGTGAAGAAATATGCGATCTTGCAATTGAGCATAACGCGA<br>TTATCGTGCTGGAAAACCTGAACATGCGCTTTAAACAGATAAGAAGCGGGATCGAGAAGTCCGTC<br>TATCAGCAGCTGGAGAAGCAGTTAGTCGACAAATTAGGGCACATGGTGTTTAAGGACAGGCCTG<br>AACTGGAGATCGGCGGAGTCTTGAATGGCTACCAGCTCGCCGCCCCCTTTGAGTCCTTTAAGGAC<br>ATGGGTAATCAGACAGGAATTGTGTTCTACACCGAAGCCGCTTACACAAGCACCACAGACCCCGT<br>GACTGGTTTTAGAAAAAACGTGTATGTGAGCAATTCAGCAACTAAAGAAAAGCTAGAGAAAGCC<br>ATAAAATCCTTCGACGCTATTGGGTGGAATGAAGAGAGGCAAAGTTACTTTATTACCTACGACCCT<br>GTGAGATTGGTGGATAAGAAGGAGAAGACGAAAACAATTTCGAAGCTATGGACAGTGTACGCCG<br>ACGTTCCTCGAATCCGGAGGGAGCGAAATGAACAGGGCGTCTGGAATGCACGGAACGTGAACCC<br>CAACGACATGTTTAAGAGCCTGTTCGAGGCCTGGAATTTCGAGGACAAGATTGCAACCGACTTGA<br>AGAGTAAGATCGAGGAGAAGATGAAGAATTGTCCTCATACAAGATGATTGATGGGCG<br>GGAGCGGAATTTCTTCCAAGCCTTCATCTACATCTTCAACATCATCCTAGACATCAGGAACTCCTCT<br>GACAAAACAGATTTCATTGCAAGCCCTGTAGCACCATTTTTTACCACCTTAAATGCACCCAAACCCA<br>ATCCGTGTGATATAAACCTGGCAAACGGAGATTCCCTCGGTGCCTACAATATCGCACGTAAAGGA<br>ATTATCACTATAGGCCGCATCAACGACAACCCAGAGAAACCAGACCTGTATATATCTAAAGAACA<br>GTGGGACGAATGGGCCACTAAGCACGGAATCCAACTGTGA |

TABLE S14C

Native Nucleotide Sequences Group X

| SEQ ID NO | Corresponding AA | Sequence |
|---|---|---|
| 482 | 440 | TTGTTCAATTTATATTCTTGTTTAACAGAATATATTCTGATGCAAATAACTATATTTACAA<br>ATAAAAACAAACGAAACAAAAATAATATGGAAAACTCAAACCTATTTACAAACAAGTA<br>CCAAGTAAGCAAAACCCTCCGCTTTCGCCTTGAGCCAACCGGAGGTACTGATGATTTAC<br>TTCGCCAAGCACAAATCATCGAGGGAGACGAGCGCCGCAATAAAGAGGCTATAACAAT<br>GAAACAGATTTTGGACAATTGTCACAAACAGATAATTGAGCGCGTATTGTCCGACTTTA<br>ATTTTAAAGAGCATTCTCTTGAAGAGTTTTTCAAAGTGTATACCAGAAACGATGATGAC<br>CGCGAAAAGGACATTGAAATCTCCAATCAAAAATGCGCAAAGAAATAGCCGACGCCT<br>TCACCAAACAGGATGTTACGAAACTTTTCTCAAGCAAATTCAAGGATTTTGTTGAAAGA<br>GGCTTGATTAAATATGCATCAAACGAGAAGGAACGCAACATCGTTTCCCGCTTCAAAG<br>GTTTTGCCACTTACTTTACAGGGTTCAACACCAATAGACTGAATATGTACTCAGAAGAA<br>GCAAAATCCACAGCTATATCATTCAGATTAATTAATCAAAACTTGATAAAGTTCATAGA<br>CAACATCCTTGTATATAAAAAAGTGTCTCAAACGTTGCCTTCAGATATGCTATCAAACAT<br>TTATATAGACTTTAAGGCAATCATCAACACATCAAGTCTTGAAGAATTCTTCTCCATAAA<br>CAACTACAATAACATACTCACCCAGAAACAGATTGAGATTTTCAATGCAGTTATAGGAG<br>GTAAAAAAGACAAGGATGAAAAAATAATAACCAAAGGATTCAACCAATATATAAACGA<br>ATACAACCAGACAAATAAAAACATCCGTCTGCCTAAGATGATGCGGTTATTCAATCAAA<br>TCCTAAGCGACAGAGAAGGTGTTTCTGCAAGACCAGAGCCATTCAATAACGCGAACGA<br>GACAATCAGTTCCGTCCGTGATTGTTTTACAAACGAAATATCAAACAAATAACGATAT<br>TGTCTGAAACAACATCCAAAATTGAATCATTCGACATTGATAGAATTTACATTAAGGGC<br>GGAGAAGATCTGAGAGCATTATCCAACAGTATATATGGATATTTCAATTATATCCATGA<br>CCGTATCGCAGACAAATGGAAACACAACAATCCTCAGGGCAAAAGAGCCCCGAAAGC<br>TACCAAAAAAACCTCAACGCATATCTGAAAGGCATAAAAAGCGTCTCTTTACACAGTAT<br>TGCAAACATCTGTGGTGACAACAAAGTTATTGAGTATTTCAGGAATCTTGGCGCAGAA<br>AACACTGTTGATTTCCAAAGAGAGAACGTTGTATCATTAATCGACAACAAATACAACTG<br>CGCTTCAAATCTTTTATCCGACGCCCAAATTACGGATGAAGAACTTCGCACAAACAGTC<br>GCTCAATTAAAGACTTGCTTGACGCCGTCAAGAGTGCCCAACGATTTTTCCGTCTACTG<br>TGCGGTTCTGGCAACGAACCAGACAAAGACCACTCTTTTTATGACGAGTATACACCAGC<br>ATTTGAAGCACTTGAGAATTCAATAAATCCCCTATATAACAAAGTCAGGAGTTTTGTAA<br>CCAAAAAAGATTTCTCCACCGATAAATTCAAATTGAATTTCGATAGCAGCAGCTTTCTAT<br>CCGGCTGGGCAACAAAATCAGAATATGAGAAGAGTTCTGCTTTTATATTTATTCGAGAC<br>AATCAATATTACTTAGGTATAAACAGATGCCTTAGTAAAGAAGATATTGCTTACCTTGA<br>GGATTCAACAAGCTCATCAGATGCAAAAGAGCGGTATATCTGTTTCAGAAAGTGGAT<br>GCCAAGAATATCCCCAGAATATTCATCCGTTCCAAAGGTTCCAATTTAGCTCCTGCTGTC<br>AACGAATTCCAACTGCCGATAGAAACCATTCTTGACATTTATGACAATAAGTTTTTCACT<br>ACCAGTTATCAGAAAAAAGACCGGACTAAATGGAAAGAATCATTGACCAAACTCATTG<br>ACTATTACAAGCTTGGATTCAGCCAGCACAAGTCATACGCAGATTTCGACTTAAAATGG<br>AAAGCATCCAGTGAATATAACGACATAAATGACTTTCTTGCAGACGTACAGAAATCCTG<br>CTACAGAATCGAATTTATAAACATCAATTGGGACAAGTTGATAGAATTCACAGAAGAT<br>GGCAAGTTTTACCTATTCCGCATTGCAAATAAAGACTTATCAGGCAACAGCACAGGTCT<br>GCCCAATTTGCACACGATTTATTGGAAAATGCTTTTTGACGAAAGTAATCTCAAAGATA<br>TTGTCTATAAAATGTCGGGCAATGCTGAAGTCTTTATGCGCTATAATTCATTAAAAAACC<br>CAATTGTGCATAAAGCAGGAGTAGAAATCAAAACAAATGCCCTTTTACTGAAAAAAA<br>GACAAGCATATTTGACTACGACATTATAAAAGACCGTCGCTATACAAAAGATCAGCTTG |

TABLE S14C-continued

Native Nucleotide Sequences Group X

| SEQ ID NO | Corresponding AA | Sequence |
|---|---|---|
| | | AACTGCATGTTCCAATCCTAATGAACTTCAAAAGCCCATCGGCAGCAAAAGGAAATGTT<br>TTCAACAAAGAATGCTTAGAATATATAAAAAATAATGGTATAAACATATTATAGGAAT<br>AGACCGAGGCGAACGGAATCTACTTTATATGGTTATAACAGACCTTGACGGCAACATC<br>GTTGAGCAAAGTCTTTGAACCAAATTGCGAGCAATCCAAAATTGCCTCTTTTCAGACA<br>AGACTACAACAAGCTGCTGAAGACAAAGGCTGATGCAAACGCTCAAGCACGTCGTGAT<br>TGGGAGACAATAAACACCGTAAAGGAGATAAAATTCGGCTTCTTGAGTCAGATTGTAC<br>ATGAAATAGCAATGTCTATAATAAAATACGATGCAATTGTTGTTTTGGAGAATCTGAAC<br>AGAGGGTTTATGCAGAAACGAGGTCTTGAGAACAACGTCTATCAGAAATTTGAACAAA<br>TGCTACTTGACAAGTTGAGCTACTATGTTGACAAAACGAAACATCCGGAAGAGGCCGG<br>AGGAGCTTTGCACGCATATCAGCTCTCTGACACTTACGCGAACTTCAATTCTCTGTCGAA<br>GAATGCGATGGTGCGACAGTCAGGTTTTGTTTTCTATATTCCTGCATGGCTTACAAGCA<br>AAATAGACCCCGTCACAGGATTCGCCTCCTTTTTGAAATTTCACAGAGATGACAGTATG<br>GCAACAATCAAATCTACAATTTCAAAGTTTGACTGTTTCAAATACGACAAGGAATGCGA<br>CATGTTCCACATCCGCATTGACTATAACAAGTTTAGCACAAGCTGCAGCGGAGGTCAAC<br>GCAAATGGGACTTGTTCACTTTTGGCGATCGAATCTTGGCAGAACGCAATACAATGCAA<br>AACAGCAGATATGTTTACCAAACAGTCAATTTAACTTCTGAATTCAAAAACTTATTTGCC<br>ACAAAGGATATCGACTTTTCAGGCAACCTGAAGGACTCTATATGCAAAATTGAGGATG<br>TTGGCTTTTTCAGAAAACTAAGCCAACTCTTGTCTCTCACGCTTCAATTACGCAACAGCA<br>ATGCTGAAACAGGAGAAGACTTCTTGATTTCCCCAGTAGCTGACAAAGATGGCAATTTC<br>TTCGATTCAAGAAACTGTCCCGACTCTCTCCCAAAAGACGCAGATGCCAATGGCGCATA<br>CAACATTGCTAGGAAGGGATTAATGCTTGTCGAGCAATTGAAGAGATGCAAAGATGTA<br>TCAAAATTCAAGCCCGCGATAAAAAACGAGGACTGGTTAGACTATGTTCAACGCTGA |
| 484 | 442 | ATGAACATTTACGAAAATTTTACTAATATGTATCAGGTGAATAAGACTATAAGAATGGG<br>GTTAAAGCCAATATGTAAAACTGATGAAAATATTGCTAAATTTCTTGAGGAAGATAAG<br>GAAAGAAGTGAGAAATACAAGATAGCTAAAAAAATAATTGATAAGGAAAATAGAGCC<br>TTTATAGAGGATAGATTAAAGGATTTTTCAATTTCAGGGTTAGATGAATATTTGGAATT<br>GCTTAAACAAAAAAAGGATATAACAAAAATTCAAAAGAAAATGAGAGATGAAATTTCA<br>AAACAGTTAAAAGGCTTCCCTCAATTTGATAGTAAATATAAATTCCAATATATTACAGAT<br>AAAGAAGATACAGAAATTTTAGAATATTTTAAAAAATTTACTACTTTCTTTACAGGATTT<br>AATTCTAATAGAAAATGTTTACTCTAAAGAAGATATTTCGACTTCTATTGGACATAG<br>AATTATTCACGAAAATCTTCCAAAATTTATTTCAAATTTTAGGATTTTAAATAAAGCAAT<br>AGAGGCGTTGGGAACAGGTAAAATAAATGAAGATTTTAAGAATAATGAAATTAATGTT<br>ACAGTTGAAGAACTTAATAAAATAGATTATTTTAACAAGGTTTTAACTCAATCAGGAAT<br>AGATTTGTATAATAATTTGATAGGTATTTTGAATCAGAATATAAATCTATATAATCAACA<br>ACAGAAAGTAAAAAAGAATAAAATTGGAAAGTTAGAAACATTACATAAACAAATATTA<br>AGTGAAAAAGATAAAGTATCGTTTATTGAAGAATTTGCTGAAGATAACCAGCTTTTGAA<br>ATGTATTGATGAATATTTTAAAGAAAAAGTTGTTTGATAAATGTAGATTTAAAGAATT<br>TACTTGAAAATATTGATACTTATAGTTTGAATGGTATTTTTATTAAAAATGATAAGTCTT<br>TGAAAAATATATCTATTTATTTATATAAAGATTGGGGATATATATCAAATCTTATAAATG<br>AAGAATACGATTATAAACACAAGAATAAGGTAAAAGATGATAAGTATTATGAAAAAAG<br>AAAAAAAGCTATAGATAAGATTAAATATTTTTCTATAGGATATATTGATGAATTGTTAA<br>AAGATAAAATGTTCCTATGGTAGAATGCTATTTCAAAGAAAAGATAAATTTAGTAGTA<br>AAAGAATTTAATGCTTCTTTAAACAAATTTAATGAATATAAGTTTACAAATGAGTTAAAA<br>ACTGATGAAATTGCTGTTGAAATAATAAAAAATTTATGTGATTCAATAAAGAAGATACA<br>GGGTATAATAAAGCCTTTAATAATTACTGGAAATGATAAAGACGATGATTTTTATGTGG<br>AAATCAATTATATATGGGACGAGCTTAATAAGTTTGATAAAATATATAATATGGTTAGA<br>AATTATCTTACAAAAAAGGATTACATAGAGGAAAAAATTAGAATGATGTTTTCAAAGA<br>GTAGTTTTATGGATGGTTGGGGAAAAGATTATGGAACAAAAGAAGCACATATAGTTTA<br>TCATGATAAAAATTATTATTTAGTAATAGTTGACGAAAAATTAAAATTAGAGGATATAG<br>ATAAATTATATAAACCAGGTGGAGATACTGTACATTATATATATAATTATCAGTCAATA<br>GACTATAGAAATATTCCTAGAAAATTCATATATTCTAAGGGTACAGATTTGCACCATCT<br>GTGGAAAGATATAATTTACCAATAGAAGATGTTATCGAAGTGTATAATAATAAATATTA<br>TAGAACGGAGTATGAAGAGAAAAATCCTAAAATTTACAAAAAATCATTAACATCCTTAA<br>TTGATTATTTTAAAATAGGGTAAATAGGGATATGGATTTTGAAAAATTTGATATTAAA<br>TTAAAAGATTCAAATGAATACAAAAATATAAATGAATTTTATTATAATTTGGAAACTTGT<br>TGCTATAAGTTACAAGAAGAAAAAGTTAATTTTAGTGTACTTGAAGAGTTTTCTTATAG<br>TGGAAAAATTTATTTATTTAAAATATACAATAAGGATTTTTCTAAATATAGCAAAGGAA<br>CACCTAATCTCCATACTTTATATTTTAAAATGCTATTTGATAAAGAAACCTTGAAAATC<br>CTATTTATAAACTTAGTGGAAATGCTGAAATGTTTTTTAGAAAAGGAAATCTTGATTTA<br>GATAAAACAACTATACATCATGCTAACCAGCCAATAAATAACAAAAATCCTAATAATAG<br>AAAGAGACAAAGTGTATTTAAATATGACATAATTAAAAATAGAAGATATACAGTTGAT<br>AAATTTGCATTACATATGTCAATTACTACAAATTTTCAAGTATATAAGAATAAAATGTT<br>AATGAAACTGTAAACAGAGCTTTAAAATATTGTGATGACATTTATGCTATAGGTATAGA<br>TAGAGGAGAAAGAAATTTATTATATGCTTGTGTAGTAAATTCAAGGGGAGAAATAGTA<br>AAACAAGTTCCTTTAAATTTTGTAGGTAATACAGATTATCATCAATTACTTGCAAAAAGA<br>GAAGAAGAAAATGAATAGCAGGAAAATTGGAAATCATTGATAATATAAAGAAT<br>TTAAAGGAAGGCTATTTAAGTCAGGCTATACATATAATAACTGACTTTATGGTTGAATA<br>TAATGCTGTACTTGTTTTAGAAGATTTGAATTTTAGATTTAAAGAAAAAGAATGAAAT<br>TTGAAAAAGTGTTTATCAAAAATTTGAAAAGATGCTTATTGATAAATTGAATTTCTTAG<br>TTGATAAAAGCTTGATAAGAACGCCAATGGTGGATTGTTAATGCGTATCAATTAACA<br>GAAAAATTTACAAGCTTTAAAGATATGAAAAATCAAATGGTATAGTATTTTATATTCCT<br>GCTTGGATGACAAGCAAAATTGACCCAGTTACAGGATTTACAAATTTATTCTATATTAA<br>ATACGAGAGTATTGAAAAGGCTAAAGAGTTTTTTGGTAAGTTTAAATCAATAAAATTTA |

TABLE S14C-continued

Native Nucleotide Sequences Group X

| SEQ ID NO | Corresponding AA | Sequence |
|---|---|---|
| | | ATAAGGTAGATAACTATTTTGAATTTGAATTTGATTATAATGATTTTACTGACAGAGCTC<br>AAGGTACAAGGTCTAAATGGACAGTTTGTAGTTTTGGACCTAGAATTGAAGGTTTTAG<br>AAATCCTGAAAAAATAATAATTGGGATGGTAGAGAAATAGATATAACAGAGGAAATT<br>AAAAAATTACTTGATGATTATAAGGTATCTTTAGATGAAGATATTAAAGCTCAAATTAT<br>GGATATAAATACCAAGGATTTCTTTGAAAAATTGATTAAATATTTTAAACTTGTATTGCA<br>AATGAGAAACAGTAAAACAGGTACAGATATTGATTATATCATTTCTCCGGTTAGAAATA<br>AGCAAAATGAATTTTTTGACAGTAGAAAGAAAAATGAAAAATTGCCTATGGATGCAGA<br>TGCAAATGGTGCTTATAATATTGCTAGAAAAGGCTTAATGTTTATTGATATAATAAAAG<br>AAACTGAAGATAAAGATTTAAAGATGCCTAAATTGTTCATTAAAAATAAGGATTGGTTG<br>AATTATGTACAAAAGAGTGATTTGTAA |
| 485 | 443 | ATGAAAGCAGAATTGTTTAAGACTTTTGTGGATGAGTATCCTGTTTCAAAAACATTAAG<br>GTTTAGTTTAATACCTGTTGGAAGAACCCCTAGAGAATATTGAGAAAGATGGGATTCTTG<br>ATTGTGATGAAAAAGATCTGAAGAGTATAAACGAGTAAAAAAACTCCTCGATGAGTA<br>TTACAAGACTTTTATTGAGCATGCTTTGACAAATGTAGAACTTGATATTAATAGTCTTGA<br>AGAATATGAGAGACTTTATAATATAAAAAATAAATCCGACAAGGAAAGGCAGATTTT<br>GATAGTGTACAGAAAAATCTAAGAAACAAATAGTCAAGCTTTAAAAGAAGATGAGA<br>AATATAAATTTTTATTTAAAAAAGAAATTATTGAAAAGGAATTAGTGGACTTTTTAAAT<br>GGAAGAGATTCAGATGTTGAATTGGTTAAATCATTTAAGGGCTATGCTACTATGTTTCA<br>AGGCTTTTGGGATGCAAGAAAAAATATATTTTCTGATGAAGAAAGTCTACAGCTATTG<br>CATATCGAATAATTAATGAAAATCTTCCAAAATTCATTTCGAATAAAAATATATATTTTA<br>CTAAAATACAACCTGAAATGGATGCTGAACTTGATCAATTAACGTTATCTAATAATTCA<br>AATGAAATTCGTGATATTTTTAAATTGGAGTATTTTTCTAAAACTATAACTCAAACAGGT<br>ATTGAAATATATAATGGTATTTAGGTGGATATACAATCGATGAACAGGTAAAGTTGCA<br>AGGAATCAATGAAATTGTGAATTTGCATAATCAAAAAAACAAAGATAGTGGAAAAATT<br>CCAAAACTTAAAATGCTTTATAAGCAGATTTTATCTGATACAAATACGTTATCATTTATA<br>GCAGAAGGATTTGAAACAGATGATGAAGTGCTTGAGTCTTTAAATATTTTTATGATGT<br>TTTCAATGAAAATATACTTGATGAGGATTTAGGTATTATTAATTTATTGAGAAATATAGA<br>TAAATTTTCATATGATGGCATTTATATAAAGAATGATAAAGCTTTAATAGATATTTCTAA<br>TTATTTATTTGGAGATTGGCATTATATTAAAAATGCCATTAATAAGAAGTATGAAATTG<br>ATAACCCAGGTAAAAATACAGAAAAGTATATTGTAAAGAGAAACAAGTTTATAAAAAG<br>CTTTGATAGTTTTTCTTTGAAATATCTTCAAGATTGTACAGGAAGTAAATTTAATGAACA<br>TATATTAATTAAAATAAATAATCTTATTGATGATGTAAAAAAAGCGTATAATTCAGTTGC<br>ACTATTGATTAAGAATAAATATGAAGGTACGAATTTAATAAACGATAAAGATGCTATTG<br>AAAAAATAAAACAATTTTTGGATTCTATGAAAAGTTTAGTTTCATTTATTCGTTGTTTTG<br>AAGGTACTGGTCAAGAGCCAGATAGAGATGAGATTTTCTATGGTGAATTTGATACAGG<br>AAAGAAGACATTTTATTACTTAAACAATATATATAATAAAACGCGTAATTATGTTACAAA<br>AAAACCTTATAGCATAGAAAATATAAATTAAATTTTGACAATGCAGAATTATTAACAG<br>GATGGGATTTAAATAAAGAGACAAGTAAGGCTAGCATTATTCTAAAAAAAGATAATTT<br>GTATTATTAGGAATAATGAAAAAGAGCGACCGCAGAGTATTTTTGAATGTACCAGAG<br>ACAGAAAGTACATATAATTGTTATGAAAAAATGGAATATAAGTTGTTACCAGGTCCAAA<br>TAAAATGTTACCTAAAGTGTTTTTTGCTAAATCAAATATAGACTATTATGACCCTAGTCC<br>TGAAATTATGAGGATATATAAAGAAGGCACTTTTAAAAGGGTGATAATTTCAATATA<br>GATGATTGTCATGATTTAATAGATTACTTTAAAGAATCTTTGGATAAAAATGATGATTG<br>GAAAATTTTTGATTTTGACTTTTCGGAGACATCATCTTATAAGGATATAGGGGAATTTTA<br>TAAAGAAGTACAACAGCAAGGATATAAAATTAGTTTTAAGAATATAGCATCTTCTTATG<br>TAGATGAGCTTGTTGAAAATGGTAAGTTGTATTTGTTTCAAATATACAATAAAGACTTTT<br>CTAAAAATAGTAAAGGAACTGAAAATCTACATACAATGTATTGGAGAGCCTTATTTGAT<br>GAAGAAAATTTAGAAAATGTAATATATAAATTGAACGGTGATGCTGAGATTTTCTTTAG<br>ACGAAAGAGTATTTCAGAAAATGAGAAAATAGTTCATCCTGCACATGTTGAAATTGAG<br>AATAAAAATGATGAGACTAGAAAAGAGAAAAAAACAAGTATTTTCAATTATGATATTAT<br>AAAAGATAAACGTTTTACAGTTGATAAATTCCAGTTCCATGTACCTATTACACTGAACTT<br>TCAAGCAATAGATCGTAAAGTGATATTAATTTACGTATGAGACAAGAAATTAAAAAG<br>AATAAGGATATGCATATAATAGGAATAGATAGAGGAGAGCGAAACTTATTATATATAA<br>GCATAATAGATCTTGATGGAAATATTGTAAAACAAGAATCACTTAATACTATTACCAAT<br>GAGTATGATGGTAAGATTTATACTACTGATTATCATAAATTACTTGATAAAAAGGAAGA<br>AAAACGTAAAGTTGCTCGTCAAACATGGAATACTATAGAAAATATAAAAGAATTAAAG<br>GCTGGGTATATGAGTCAGGTGGTTCATAAAATAACTCAGTTAATGATGGAGTATAATG<br>CTATAGTAGTATTAGAAGACTTAAACACTGGATTTAAACGAGGTCGTCAGAAGGTTGA<br>AAAACAAATTTATCAGGCTTTTGAAAAAGCTTTAATTAATAAATTAAACTATTACGTTGA<br>TAAGAAAGTAGATAAAAATGAGATATCTGGTTTATATAAACCTCTTCAATTAACAAAAG<br>AATTTGAAAGTTTTAAAAAGCTTGGAAAACAGAGTGGCGCTATATTTTATGTTCCTGCA<br>TGGAATACAAGTAAAATGGATCCAACAACAGGATTTGTTAATTTATTATCAGTAAAATA<br>TGAAAATATGGAGAAATCAAAAGAATTTATTAACAAAATAAAAGATATTAATTTTAAGG<br>AAGATGATTGTGGAAAATACTATGAATTTCATATTGATTTCAATGAGTTTACCGATAAG<br>GGCAAAGATACAAAAACAGATTGGAATATTTGTAGTTTTGGCAAACGTATAGATAATG<br>CTCGAAATCAAAAGGGGATTTCGAAAGTAAGATGATAGACTTAACAAATGAGTTTCA<br>TAACTTATTCAAAAGTACGGCATTAATGATAATTCTAATCTGAAGGAAGATATTTTAA<br>ATGTAAAAGAAGCCAAATTTTATAAAGAGTTTATAAATTTATTTAAATTGATGCTACAA<br>ATTCGAAATAGCGAATCAAATGAAAAGTTGATTTTCTTCAATCACCAGTTAAGAATAA<br>TAAAGGAGAGTTTTTAATTCAAATAATGTAAATGGAAATGAAGCTCCAGAAAATGCC<br>GATGCAAATGGAGCATATAACATTGCTAGAAAAGGATTGTGGATTGTTAATCAGATTA<br>AAACAATGCCAGATAGTCAAATGCATAAGATTAAGCTTGCAATGAAAAATCAAGAATG<br>GCTTTTATTTGCACAAAAAGGGAATGTATAA |

TABLE S14C-continued

Native Nucleotide Sequences Group X

| SEQ ID NO | Corresponding AA | Sequence |
|---|---|---|
| 487 | 445 | ATGCCAAATATTTCTGAATTTAGTGAACATTTTCAAAAGACTTTAACATTAAGAAACGA GTTAGTACCTGTAGGAAAAACTCTTGAAAACATCATTTCTTCTAATGTATTGATAAATGA TGAAAAAAGAAGTGAAGACTATAAAAAGGCTAAAGAGATTATAGACTCTTATCATCAA GAGTTTATAGAAAAATCTCTTTCATCTGTAACTGTTGATTGGAATGATTTGTTCTCCTTTT TATCCAGAAAAGAACCAGAAGACTATGAAGAAAAGCAGAAGTTCCTAGAAGAGCTAG AAAGTATTCAGCTTGAAAAGAGAAAAAGCATTGTTAATCAATTTGAACAATATGATTTT GGTTCATACACAGATTTAAAGGGAAAGAAAACAAAGGAACTAAGTTTTGAGAGCCTTT TTAAATCGGAGTTATTTGATTTTCTTTTACCTAATTTTATAAAAAATAATGAAGACAAAA AAATAATAAGTAGTTTTAACAAGTTTACTTCTTACTTTACTGGTTTTTACGAAAATAGAA AGAATTTATATACATCAGCACCTTTGCCAACGGCTGTTGCTTACAGAATAGTTAACGAT AACTTTCCTAAATTCATTTCTAACCAAAAGATCTTTCGTGTGTGGAAAGACAATGTTCCT AAGTTTGTAGAAATAGCGAAAACTAAACTAAGAGAAAAAGGTATTTCTGATTTAAATTT AGAATTTCAATTTGAGTTATCAAATTTCAATTCATGTTTAAATCAAACAGGAATTGATTC TTACAATGAACTGATAGGTCAACTAAACTTTGCAATTAACCTTGAATGTCAGCAAGACA AGAATTTAAGTGAGCTTTTAAGGAAGAAAAGAAGCCTTAAAATGATACCTCTGTATAA ACAGATTTTATCAGATAAAGACTCTTCATTCTGCATTGACGAATTTGAAAATGATGAATC AGCGATAAATGATGTTATTTCTTTTTATAAGAAAGCGGTTTGTGAAAACGGTCCTCAAC GAAAACTATCCGAATTATTACGTGATTTGTCATCTCACGATCTTGATAAGATATTTATTC AAGGTAAAAACTTAAATTCAATTTCTAAAAATTTATTTGGAGGAAAAAACTGGTCTTTA CTCAGAGATGCCATTATTGCAGAAAGTCAAAAGACAAAAGCTATAAAAGGCTATAA AGACAAATCCTTCATCAGACGATCTTGACAGAATTCTATCTAAAGATGAATTTTCAATTT CATACTTATCAAAGGTATGCGGAAAAGATTTGTGCGAAGAAATTGATAAATTTATTAAA AATCAAGATGAACTGTTAATTAAAATAAATTCACAAGCTTGGCCAAGCTCTCTTAAGAA TAGTGACGAGAAAAATCTCATAAAATCACCATTAGATTTCTTGTTAAATTTTTATAGATT TGCTCAGGCATTTTCTTCAAATAATACAGATAAGGATATGTCTTTATATGCCGATTATGA TGTATCTTTATCTTTATTGGTCTCTGTAATAGGTCTTTATAACAAAGTTAGAAACTATGC AACCAAGAAGCCTTATAGTCTTGAAAAAATCAAATTAAATTTTGAAAATCCAAACTTAG CAACAGGTTGGAGTGAAAACAAAGAAAATGATTGTTTATCAGTAATCTTATTAAAAAT CAAATTTACTATTTAGGTATTTTAAACAAAAGTAATAAACCTAATTTTTCTAATGGTATTT CTCAACAACCTTCTTCAGAAAGCTGCTATAAAAAGATGAGATACTTATTATTCAAAGGA TTCAATAAAATGTTACCTAAATGTGCTTTTACAGGAGAAGTAAAAGAGCATTTTAAGGA ATCTTCTGAAGATTATCATCTTTATAACAAGGATACTTTTGTTTATCCTCTTGTTATTAAC AAAGAGATTTTTGATCTAGCATGCAGTACAGAAAAAGTAAAAAAATTTCAAAAAGCAT ATGAAAAGGTCAACTATGCAGAATATAGGCAATCACTGATAAAGTGGATTTCTTTTGGC CTTGAATTTTTATCTGCATACAAAACTACATCTCAATTTGATTTATCAAATTTAAGAAAC CTGAAGAATATAGCGATCTAAAAGAATTTTATGAAGATGTAGACAATCTAACATACAA GATAGAATTAGTAGATTTAAAAGAAGAATATGTAGACTCTTTGGTTGAAAATGGGCAA CTGTTTTTATTCGAAATAAGAAATAAAGATTTTGCAAAAAAATCTAGTGGAACTCCTAA TTTACATACTCTTTATTTTAAAAGCATATTTGATCCGAGAAATTTAAAAAATTGTATTGTC AAACTTAATGGTGAAGCCGAGATTTTCTACAGAAAGAAAAGCTTGAAGATTGATGACA TAACAGTTCATCAAAAAGGAAGTTGCCTTGTTAATAAAGTTTTCTTCAATCCTGATTCTG GCAAATCCGAGCAGATCCCAGACAAAATCTATAACAATATTTATGCATATGTTAATGGC AAATCAACAACTTTATCAAAAGAAGATGAGTTTTTTTACACAAAAGCCACAATAAAAA AGCAACTCACGAGATCGTAAAAGATAAACGCTTTACTGTGGATAAATTCTTTTTCCACT GCCCAATTACGATTAACTATAAATCTAAAGATAAGCCAACTAAATTTAATGACAGAGTA TTAGATTTCTTAAGAAAGAATGAAGATATCAACATTATTGGAATAGATCGAGGTGAGA GAAATCTTATCTATGCAACTGTAATTAATCAAAAAGGTGAAATTATTGATTGCAGATCTT TTAATACAATCAAGCACCAGTCTTCATCTGTAAATTATGATGTAGATTATCACAATAAAT TGCAAGAAAGAGAAAATAATAGAAAAGAAGAAAAGAGATCTTGGAACAGTATTTCTA AAATTGCAGACCTTAAAGAAGGATATCTTTCAGCTGTAATTCATGAGATAGCATTAATG ATGGTTAAATACAATGCTATTGTTGTTATGGAAAATTTGAATCAAGGCTTTAAGAGAAT CAGAGGCGGAATCGCTGAAAGATCTGTGTACCAAAAATTTGAGAAAATGCTGATAGAT AAACTTAATTATTTTGTTATTAAAAATGAGAATTGGACAAATCCTGGAGGAGTTCTCAA TGGTTATCAGTTGACAAACAAGGTATCAACAATCAAAGAAATTGGTAATCAATGTGGTT TTTTATTCTACGTACCTGCAGCATATACTTCAAAGATAGATCCTTCAACTGGTTTTGTTA ATTTGTTGAATTTCAATAAAATACAATAACTCAGATAAACGAAGAGAGCTTATTTGCAAA TTTTACGAGATTTGTTATGTGCAAAATGAGAATTTATTTAAATTTTCTATAGATTATGGA AAATTATGCCCTGATAGCAAAATACCTGTAAAAAAATGGGATATTTTCTCTTATGGGAA AAGAATTGTTAAGGAAGATCTAAAGACTGGTTATATGAAAGAAAATCCAGAATACGAT CCAACTGAAGAACTTAAGAATTTGTTTACATTAATGAGGGTTGAGTATAAAAAAGGTG AAAATATACTTGAAACAATATCTATCAGAGACATGAGTAGAGAATTTTGGAATTCTCTT TTCAAGATTTTCAAAGCTATATTACAAATGAGAAATAGTCTAACTAATTCACCGGTAGA CAGACTTTTATCTCCAGTAAAGGGAAAAGATGCAACCTTCTTTGATACAGATAAAGTTG ATGGAACTAAATTTGAAAAATTAAAAGATGCTGATGCAAATGGAGCTTATAACATTGC ATTAAAAGGCTTATTAATTCTCAAAAATAATGATTCTGTAAAGACAGACAAAGAACTAA AAAATGTAAAGAAGGTAAGTCTTGAGGATTGGTTAAAGTTTGTTCAAATCTCCTTAAGA GGATAA |
| 488 | 446 | ATGAAACGCCTAATTGACTTTACAAACATCTATCAGCGATCAAAGACTTTGAGGTTTCG ATTGGAGCCTATCGGTAAAACGGCCGACTATATTAAGGTTTCTCAGTACCTCGAAACTG ATGAGCGTTTGGCAAAAGAGAGCAAGAAGGTAAAAGAGCTTGCTGATGAATATCACA AAGAGTTTATTGGAGATGTCCTGTCTTCGTTGGAATTGCCTTTAAGCAAATCAACGAG TTATGGGATATATATATGTCCAATGATACAGACCGCGAGATAAAATTCAAAAAACTGCA |

TABLE S14C-continued

Native Nucleotide Sequences Group X

| SEQ ID NO | Corresponding AA | Sequence |
|---|---|---|
| | | AGAGAACCTGCGAAAGGTGATTGCAGAGGCTTTTAGTAAGGACAAACGGTTTGGTAGT<br>TTATTCAAAAAGGAGATAATCACAGACATTCTGCCGAAATTCTTGCAAGATAAGGATGA<br>TGATATTAAGATCGTAAATAGATTCAAGGGATTTACCACATATTTTTACGCCTTTCATAA<br>AAATAGGGAAAATATGTATGTCTCGGAAGAGAAATCGACTGCAATACCATATCGAATT<br>GTGAATCAAAATCTCGTCAAGTATTTTGACAACTACAAGACGTTCAAAGAGAAGGTAAT<br>GCCTCTTCTGAAAGACAAGAATATAGTCGAAAGCATAGAGAGAGACTTCAAAGACATC<br>TTGAACGAAAAATCAATAGAGGATGTTTTTGGCCTTGCCAACTTCACTCATACTTTATGT<br>CAGGCTGACATCGAGAAATACAATACGTTGATAGGTGGCCTTGTCGTCAAAAACGAAA<br>AAAAAGAGATTAAAGGTATTAATCAGTACATTAACGAACATAACCAAACGAGTAAAAA<br>AGGGAATGGAATTCCGAAACTAAAGCCGTTATTCAATCAGATTTTGAGCGATAGAAAA<br>TCGTTATCGTTTACCTTAGACGATATCAAAAAAACGTCGGAGGCTATTCGCACCATTAA<br>GGATGAGTATGAAAATCTCCGAGACAAGTTGGCGACCATCGAAAGGCTTATTAAGTCT<br>ATCAAGGAGTATGATCTTGCAGGTATTTACATCAAGATGGGAGAGGATACTTCGACAA<br>TATCGCAGCATTGGTTTGGTGCGTATTATAAAATCATCGAAGCGATAGCAGATGCATG<br>GGAACGACGAAATCCGAAGAAAAACAGAGAATCCAAGGCATATAGCAAGTATCTATC<br>GTCCCTAAAAAGCATCAGTCTCCAAGAAATAGATGACCTCAAAATCGGAGAGCCTATA<br>GAGAACTACTTCGCAACTTTTGGCACGACTTGTTCAGACCGAACAAGTGGAGTTTCTTC<br>GCTCAATAGGATAGAAGCTGCTTATACCGAGTTCGTGAACAAATTTCCTGAAGGATTTG<br>AAGATGGCGATGACTGTAACGATGCCTACTTTAAGGCTAATGTGGAAGTCGTCAAAAA<br>TCTGCTGGATTCAATTAAAGATTTTCAGCGTTTTGTGAAGCCTTTGCTTGGCAATGAGG<br>ACGAAAGAGACAAAGACGAGGCTTTCTATGGAGAGTTTGTCCCGACATACACAGATAT<br>GGATAACATCATAACCCCTCTATACAACCGTGTACGCAATTTTGCCACCAAGAAACCAT<br>ACTCTACAGACAAGATAAAAATCAACTTTGAAAAATCCACACTGCTTACCGGATGGGCA<br>AATTACAAGCAATATGGCGGTGTCTTGTTCTGTAAAAATGATAGTGATTTCTATCTTGG<br>CATTGTAAAATCGTCCAAGACAGAAATCCATACAGTCGATGATAGCGCCTCGGATATAT<br>ATAGAATTGATTATGCTCTGATTCCGAACCCGGGCAAAACCATTCCTTGTTTAATGTTTA<br>GGGATGAGGTGAAGGCTGAAAAGGTAAACGGGCGTAAAGATAAACGTACAGGTGAA<br>AATTTGAGATTGGAAGAAGAAAAGGATAAGTATCTTCCTGCAGAGATTAATAGGATAC<br>GTAAATCCAGGTCTTATCTGAAGAGTTCGGAATGTTATTGCAACCAAGATATGGTTGCA<br>TACATCGACTATTACAAAAAATGTTGTATTAGTTATTATGACAAACTATCCTTTACTTTCA<br>AGGATAGTAGTATGTACTCGGACTGGAACGATTTTATCGCTGACGTCGATGGTCAGGG<br>ATATCAATTGAACAGGATACCCGTGTCTATGCAGGAGCTAGAGAACTTGGTAGACAAT<br>GGCAATATGCTTCTATTCCGTATCGCGAATAAAGATTTTTCGCCTAACAGCAAGGGCCG<br>GCCCAATCTTCATACCATATATTGGCGAATGCTTTTCGACCCGGCCAACCTGAAAGATG<br>TTGTATATCAGCTCAATGGTAATGCCGAAATATTCTTCCGTAAGGCAAGCATTACGAGG<br>ACGGAGCCTACACATCCGGCTAACGTTGCCATCAAAAACAAGAGCGAATATAACAAAC<br>AGAATAAGCCGTATAGTACATTCAAGTACGGTTTAATCAAGGATAGGCGCTACACTACC<br>GACCAGTTCGAGTTTCATGTACCCATCACTATGAACTTCAAGCAACCAGAGTCGTCTAA<br>ACTACAGGACAAGCTCAACAAGCAAGTACTTGACTTCTTGAAACAGGACGGCGTACGC<br>CATATTATAGGCATTGATCGGGGCGAACGTAATCTGCTATACTTGGTGATGGTAGATAT<br>GGAGGGCAAAATCAAAAAACAAATATCACTCAACGAGATAGCCGGTAATCCGAAGAAT<br>TCCGAGTTCAAACAAGACTTCCATGCACTGCTGCGCGAGCGCGAAGGAGACCGTCTGG<br>AGTCCCGTCGCAGTTGGAACACCATTCAGAGCATTAAGGACCTCAAAGAAGGTTACAT<br>GAGCTTGGTGGTTCATGAAATAGCGAATATGATGCTTGAGAATGATGCTATAGTAGTG<br>CTCGAAAACCTGAATCGCTCGTTTATGCAAAAGCTCGGCGGCAGAGAAAAGTCTGTAT<br>ACCAAAAGTTCGAAAAGATGCTTATCGACAAGTTGGGATACATCGTGGATAAGACTAA<br>AGATGTGTCCGACAACGGAGGCGCACTACATGCTGTACAGCTTGCTGATACGTTTGAA<br>AACTTCAATAAGACCCAAAAAGGAGCTATTCGTCAATGTGGATTCATATTCTATATTCCT<br>GCATGGCGTACCAGCAAGATTGACCCCGTTACCGGCTTTGTGCCAATGCTTAGGTGTCA<br>ATATGAAAGCATCGTAGCATCCAAAGACTTCTTTGGAAAGTTCGACAGTATATACTACG<br>ATGCGACAGGAAAGTATTTTGTCTTCCAAACTGACTTTACCAAATTCAATACCGAGAGC<br>AAAGGAGGAATTCAAAAATGGGATATATGCACCTATGGAGACAGAATATATACTCCTC<br>GCACCAAAGACCGGAATAATAGCCCTGTTTCGGAACGTGTAAACCTTACTGAGGCGAT<br>GAAATCACTGTTTGTATTGCATAATATCAATATTCAAGGCGATATCAAAGCCGGAATTA<br>TGCAGCAGACAGACAAGGCGTTCTTCGAGTCACTGCATCGATTGCTTCGACTTACGTTG<br>CAAATACGCAATAGCAAAAAATCTACAGGCGAAAACTATGAAGACTATATCATATCGCC<br>GGTGATGGGCAAGGACGGTCGTTTCTTCGATTCACGTAACGCGGATGCTACACAACCT<br>AAGGATGCAGATGCCAATGGCGCGTACAATATTGCGCGCAAAGGCTTGATGCTGCTTC<br>GCCAGATTCAAGCCCAAGAGAAGCAAGACCTATCCAACGGAAAATGGCTTGAATTTGC<br>CCAAAGGTGA |
| 489 | 447 | ATGATAATTTATAATTGTTATATCGGAGGCAGTTTTATGAAAAAAATAGATAGCTTTACT<br>AACTGTTATTCTCTTAGCAAAACCTTGAGATTCAAGCTGATACCTATTGGCGCTACGCAA<br>AGTAATTTTGATTTAAACAAAATGCTTGACGAAGATAAAAAAAGGGCAGAAAACTATT<br>CTAAGGCAAAAAGCATTATTGATAAATATCATCGCTTTTTTATTGAGAAAGCTTTATCTT<br>CAGTTACCGAGAATAAGGTTTTTGACAGTTTTCTCGAAGATATCAGAGCATACGCTGAG<br>CTTTATTACAGATCAAATAAAGATGACAGCGACAAGGCTTCAATGAAAACACTTGAAA<br>GCAAAATGCGTAAGTTCATTGCTTTAGCTTTACAGTCGGATGAAGGTTTTAAAGATTTG<br>TTCGGACAGAATTTAATCAAAAAGACTCTTCCCGAATTTCTTGAAAGTGATGCGGACAA<br>GGGAGATAATTGCGGAATTCGATGGTTTCTCAACATATTTTACCGGTTTCTTCAATAATCG<br>CAAAAACATGTACAGCGCAGACGATCAATCAACGGCAATTTCCCACCGTTGCATTAATG<br>ATAACCTTCCAAAGTTCCTTGACAATGTCAGAACATTTAAAAATTCTGATGTTGCCAACA<br>TTCTCAACAATAACCTTAAAATTCTCAATGAAGATTTTGACGGTATTTACGGAACCTCTG<br>CCGAAGATGTATTCAATGTTGATTATTTTCCGTTTGTGCTTTCACAGAAAGGAATTGAA |

TABLE S14C-continued

Native Nucleotide Sequences Group X

| SEQ ID NO | Corresponding AA | Sequence |
|---|---|---|
| | | GCATATAATTCTATACTCGGTGGCTATACAAACTCTGACGGCAGTAAGATTAAAGGATT<br>AAACGAATATATCTATCTTTACAACCAAAAGAACGGGAACATACATCGTATTCCAAAAA<br>TGAAACAGTTGTTTAAACAGATTTTAAGCGAAAGGGAAAGTGTTTCATTCATACCCGAA<br>AAATTTGATTCGGATGATGATGTCCTTTCTTCAATTAATGATTATTATCTTGAAAGAGAC<br>GGAGGAAAAGTTCTTTCAATTGAAAAAACGGTTGAAAGATTGAGAAACTATTCAGCG<br>CTGTTACGGATTACTGCACCGACGGAATATTTGTTAAGAATGCCGCAGAACTTACAGCT<br>GTCTGCTCGGGAGCATTCGGTTATTGGGGCACTGTTCAAAATGCCTGGAACAACGAGT<br>ATGATGCTCTTAACGGTTATAAAGAAACCGAAAATATATCGATAAAAGAAAAAAGC<br>GTATAAATCGGTTGAAAGCTTTTCTCTTGCTGATATTCAAAGTATGCCGATGTTTCTGA<br>ATCTTCCGAAACAAACGCTGAAGTTACGGAATGGCTTCGGAATGAAATAAAAGAAAAA<br>TGCAATTTGGCGGTTCAGGGATATGAATCTTCCAAGGACCTGATTTCAAAACCTTATAC<br>TGAGTCAAAAAAACTATTTAATAATGATAATGCGGTAGAATTGATTAAAAATGCCCTCG<br>ACTCCGTGAAGGAACTTGAAATGTTCTTCGGCTGTTGCTCGGCACAGGTAAAGAAGA<br>ATCAAAGGATGAAAATTTCTACGGCGAATTTCTTCCTTGCTATGAGCGTATCTGTGAAG<br>TTGATTCACTTTATGACAAGGTCCGTAATTATATGACACAGAATGCTGTATAAGACGGAT<br>AAGATTAAGATTAATTTCAGCAACAGCCATTTTTTAAGCGGGTGGGCGCAGACTTATTC<br>AACCAAAGGTGCTTTAATTGTAAAAAAAGAGAATAATTATTATTTAGTGATTGTTGATA<br>AAAAGCTTTCAAATGATGACATAGTGTTCCTGGGTACAAATACTCAACTAAGTCCTGCA<br>GAAAGGATTGTATATGATTTTCAAAAGCCTGATAACAAAAACACCCCAAGGCTGTTTAT<br>TCGTTCAAAAGGAACAAGCTATGCTCCGGCAGTAAAAGAGTATGATTTGCCTATATCG<br>GATATTATTGAGATATATGATAACGAATACTTTAAAACTGAATACCGAAAAATTAATCC<br>TAAGGGATATAAAGAAGCCCTCATAAAACTTATAGATTATTTTAAGCTTGGCTTCAGCA<br>GGCATGAATCATATCGTTGTTTTAATTTCAAATGGAAAGAAAGCGAACAATATAGCGAT<br>ATTTCCGAGTTCTACAATGATGTTGTCAAATCCTGTTATCAATTAAAGAGCGAATCGATC<br>AATTTTGACAGTTTATTAAAACTTGTAGATGAGGGCAAACTCTATCTGTTTCAGCTGTAC<br>AACAAGGATTTTTCCGAACACAGTAAGGGCACTCCTAATCTCCATACTCTTTATTTCAAA<br>ATGCTGTTTGATGAAAGGAACCTTGAAAATGTTGTATTCAAACTCAACGGTGAAGCCG<br>AAATGTTCTATCGTGAAGCAAGTATCAGTAAGGATGATATGATTGTTCACCCAAAAAAT<br>CAGCCCATCAAAAACAAGAATGAGCAAAACAGCAGAAAGCAAAGCACATTTAAATATG<br>ACATTGTTAAAGACAGACGCTATACTGTTGACCAGTTTATGCTTCATATACCGATAACG<br>CTCAATTTTACCGCAAATGGCGGCACAAATATAAACAATGAAGTCCGCAAGGCTCTCAA<br>GGACTGTGATAAGAACTATGTTATAGGTATTGACCGTGGCGAGAGAAATCTTCTTTATA<br>TCTGTGTGGTTGATTCGGAAGGCAGAATTATTGAACAGTATTCATTAAACGAGATTATC<br>AATGAATATAACGGCAATACTTATTCAACCGACTATCACGCTCTTCTCGACAAGAAGGA<br>GAAAGAGCGTCTGGAATCCCGCAAAGCTTGGAAAACCGTTGAAAATATTAAGGAACTG<br>AAAGAGGGATATATCAGTCAGGTTGTTCATAAAATTTGCGAGCTTGTTGAAAAATATG<br>ATGCTGTTATCGTTATGGAAGATTTGAACTTTGGCTTTAAACAGGGCCGTAGCGGAAA<br>GTTTGAAAAATCCGTTTATCAGAAGTTTGAAAAAATGCTTATTGATAAGCTCAATTACTT<br>TGCTGATAAGAAAAAATCTCCCGAAGAAATCGGAAGCGTTCTGAACGCATATCAGCTT<br>ACTAATGCTTTTGAAAGCTTTGAGAAGATGGGAAAGCAGAATGGGTTTATCTTCTATGT<br>TCCTGCGTATCTTACGAGTAAAATTGACCCGACGACAGGCTTTGCGGACCTGCTTCATC<br>CGTCGTCAAAGCAAAGCAAGGAATCTATGCGTGATTTTGTAGGCCGCTTTGACTCAATC<br>ACATTCAACAAAACAGAAAACTACTTTGAATTTGAACTTGATTATAACAAGTTCCCGAG<br>ATGTAATACGGATTACAGAAAGAAGTGGACCGTCTGTACTTACGGCAGCCGTATAAAA<br>ACCTTCAGGAATCCTGAGAAAAACAGTGAATGGGACAATAAAACGGTTGAATTAACGC<br>CTGCTTTCATGGCTCTTTTTGAAAAATATTCAATAGATGTTAACGGAGATATTAAGGCG<br>CAGATAATGTCCGTTGACAAAAAAGATTTCTTTGTTGAGCTTATTGGCCTTCTGAGGCTT<br>ACTCTTCAAATGAGAAACAGCGAAACAGGCAAGGTCGATAGAGATTATCTTATATCAC<br>CCGTTAAAAACAGCGAGGGCGTATTCTATAACAGCGATGATTACAAGGGTATTGAAAA<br>CGCTTCGTTACCAAAGACGCAGATGCAAACGGTGCATACAATATTGCAAGAAAAGGC<br>TTGTGGATTATTGAGCAGATTAAAGCTTGTGAAAATGATGCGGAGCTTAACAAAATTC<br>GCCTTGCTATGTCTAACGCCGAATGGCTTGAATACGCACAGAAAAAATGA |
| 490 | 448 | TTGCTCCCTGCCCGCCGGTGCAACGGAGCGGTTCCGCACATCCGGCACACGGACAACC<br>ACGCAACACCAGGACATTCCATGAGCCTCGATTCCTTCACCCGCAAATACAAACTCGCC<br>AAAACCCTCCGCTTCGAGCTCCGTCCCGTGGGGCGGACCCTCGAAACGTTCCGTTCGAA<br>GTTCCTGCCGGGCGACGAACGCCGCCGCCGCCTATCCCGGCCGCAAAGGAGATGCTG<br>GACAACGAGCACAAGGCGCTTCTCGAACGGGCGCTCGCCAATCCGCCGGCGGGGTTG<br>GATTGGAGCGGGCTGGCACAGGCCCACGACACCTACCGAACAAGCGACAAGTCGAAA<br>GCGGCGAAAGGCGCCTTGGCCGCCCGGCAGGCGGTATTCCGGAAGGCACTGGCGGAC<br>CACCTGACGAAAGACCCCGTCATACAAAACCCTGACGGCCGCCACGCCGAAAGACCTTT<br>TCAAGGCGCTGAAGGCACGGTGCGAAGAGGCCGGACAGCCGGTTCCCGGCGACTTGC<br>AGACGTTCCTGCGCTTTTCCTGCTATTTCAAGGGCTACCAGGAAAACCGCCGCAACATC<br>TATTCGGACAAGGCGCAGGCGACGGCGGCGGCGAACCGGGCCGTCAACGGGAATTTC<br>CCCCGTTTCCTCGAAGCAGTCCGCATCTTCCGGCACATCCGCGAACGGTATCCGCAGAT<br>TCCCGCCGATGCGGCGCGCGAACTCGCTCCGCTGCTCGAAGGGCGGACGCTCGATTCC<br>ATTTTCACCCCCGCCGCCTACAACGGCTTCCTCGCCCAGTCGCGCATCGACTTTTTCAAT<br>TCGGTTCTCGGCGGATTCGTTCCCGCCGAAGGCGAAAAGACCCGCGGCATCAACGAAT<br>TCGTCAACCTCTACCGGCAACGGCACGAAGACGCCCGCGAAGACCGCGCGCCCTCGCCCG<br>GCTCCGCCCCCTCCACAAGCAAATCCTCAGCGACCGCGAATCGCATTCCTCGTTCCCC<br>GCATGTTCGAAAACGACGGCGCCGTCGTGTCGGCCATCCGGGAGATGCTCGACAAGC<br>GGCTTCTCGCCCTGGAGACGGAGAACGGGACCGAAAACGTTCCCGACGCGCTCCAATC<br>CCTTCTGGCGACGCTTTCCCCGTCGCCCGCCATCTGGATCGACGGCGCGGAAATCACCC<br>GCGTTTCGAAAGACCTGCTCCGGTTCGTGGAACGCGCTCTCCATCCTCATGGAGGCCGCC |

TABLE S14C-continued

Native Nucleotide Sequences Group X

| SEQ ID NO | Corresponding AA | Sequence |
|---|---|---|
| | | GCCGAAATCCGGTTCGCTTCGGAAAGCACGGAGAAAAAACGCGACGCCGCCGTCGCG<br>AACTGGATGAAAAAGCCGGTGTTTTCCCTCGCGGAAATGGGCGGGCTTCCGCGTGGATA<br>CGGACAACGGGGCGAACCCCGTCGACGTGTCGGGACTCTGGAAAGGGCCCGTTGCGG<br>CCGCGCGTTTCGACGCCGTCCGCAAGGCCGTCGCCGAAGTGCGCCCGGTCCTCGATTC<br>CGCCCCGTCCGGGGAGGGGACGCCCCTCCGCGAACGCCAGGAGGACATCGCCCGGAT<br>CAAGGCGGCGCTCGACGCCATCCTCGACCTGCTCCGTTTCGTCAAACCGCTCCGCGCGG<br>GCGGCGAACTCGACCGCGACGAGGCTTTCTACGGCGCGTTCGACCCGCTTTTCGACGC<br>CCTCGACGGCTTCGTTCCGCTTTACAACAAGGTCCGCAACTACCTCACGCGGAAACCGG<br>GCGAAACCGGGAGCGTCAAGCTGATGTTCGACAATCCTAGTTTTCTTGAAGGATGGGA<br>ACAGAACCTTGAGACGAAAAGAACCAGCATATTGTTTTTCCGAGATGGATTCTACTATC<br>TCGGCGTAATGGCTCCAGACGCAAAGATTAACTTTTCGGCGTTTGCCGTTTCAGCGGCT<br>TCCGGTTGCTACCGGAAGGTGGTTTACAAGGCAATTTCAAAAGCGGCCCAATACTTCA<br>GCATCAAACAAATCAAGCCACAGAACCCTCCGCAATTCGTTTTGGACTGGCTTGCCAAA<br>GGTTTTGACAAGAAAACCCTGCATCGAGATCAACTCACTCGTTTGATTTCGTATGTCAT<br>GGATGATTTCATACCAAATTATCCCCATTGAAGGATGGAAGCGGGCGAGTCGCCTTT<br>GATTTTTCTTTCCGCAAACCATCCGAATACGGAAGTTGGAAAGAATTCACGGACCATAT<br>TGCTTCCATGGCCTACAAGATTTCCTTCGAGGACATTCCCGCGGAAGCCGTCGACCGCC<br>TCGTCGAAGAAGGGAAGCTGTGCCTCTTCCTCCTCGGAACAAGGATTTCTCGCAAGCG<br>TCCAACGGCCGTCCGAACCTGCACACGATGTATTGGAAGGCGGTGTTCTCCCCGGAAA<br>ACCTCCGCGACGTCGTCATCAAGCTCAACGGCGAAGCCGAGGTGTTCTACCGCCCGAA<br>AAGCATCCGCACGCCCTTCCGCCACAAGGTCGGCGAGAAAATGGTCAACCGCCGGGGC<br>CGCGACGGCGCGCCCGTTCCCGAAGCCATCCACGGCGAACTCTTCCGCCACGCCAACG<br>GGGACACCGCGCCCCTTTCCGGCGCCGCGGCAGTGGCTCGAGTCCGGCAACCTCGT<br>GGTCAAGGAGGTGACGCACGAAATCGTCAAGGACGCGCGCTTCGCCGCGGACAAGTT<br>CTCGTTCCACGTCCCGGTCACGATCAATTTCAAGCAACCGGACGTGTCCGCCCGGTTCA<br>ACGACCAGGTCCGCGCCTTCCTCCGCGCCAACCCGGACGTGAAGGTCATCGGCATCGA<br>CCGCGGCGAACGGAACCTGCTCTACCTCGCGCTCGTGGACCGCGAGGGCAACCTGCTC<br>GAACAGCGTTCCTTCAACACCGTGTCCCGGACGCGAAAGGACGGCGTCGTGACGCCCA<br>CCGACTACCAGGCCAAGCTCGTCCAGTCCGAGAAAGACCGCGCCGAGGCCCGCGCTTC<br>GTGGGCGGAAATCGGCGCCATCAAGGACCTCAAGGCGGGATACCTTTCCGCCGTCGTC<br>CACGAAATCGCGGAGATGATGGTCAAGCACAACGCCATCGTCGTGCTCGAAGACCTCA<br>ACTTCGGGTTCAAGCGCGGCCGTTTCCGCATCGAGCGGCAGGTCTACCAGAAGTTCGA<br>GAAGGCGCTCATCGACAAGCTCAACTACCTTGTTTTCAAGGACCGCGGCATGGAGGAG<br>CCGGGGGGGACGTTGCGCGGCTACCAGCTCACGGATGCATTCGAGAGTTTCGAGAAA<br>ATCGGGAAGCAGACCGGGTTTCTCTTCTACGTCCCCGCCGGCTACACCTCCAAAATCGA<br>CCCGACGACCGGATTCACGAACCTCTTCAACACCAAGAAGTGCACCAACGCCGCCGGC<br>ATCCGCGACTTCTTCGCCGCGTTCGACGCGATCCGTTGGGATGCCGCCCGCCGTGTCTT<br>CGCCTTCTCCTTCGACTACAGGAACTTCAAGACGAGCCAGGAAAGCCATCGGACGAAA<br>TGGACCGTTTATTCCGCAGACCGCCGCCTTGCATTCGACAAGGAGTCCCGCAGCGAGA<br>GGGAAATCAACCCCACCGCCATCCTCCTCGGGGCGCTGGAAGAGAGGGGCATCGCCG<br>TCGCGGATGGATTCGACCTCAAGGCCCTGCTTCTCGCCACGGAACCCTCCAAGGCAAAC<br>GCCGCCTTCTTCCGCTCCGTCTTTTACGCCTTCGACCGGACGCTCCAGATGCGGAACAG<br>CCGCGCGGAAGAGGACTACATCCACTCTCCTGTCCTGAACGCCCGCGGCGGGTTCTTC<br>GACTCCCGCGAAGCGGGCGACGCGCTGCCCCGGGAGGCGGATGCCAACGGCGCCTAC<br>CACATCGCCCTCAAAGGCGTCCAGCTCCTGGAAGAAAACCTCGCCGCGGAAACGCCAA<br>ACCTCAAGATCGAACACAAGGACTGGTTCCGCTTCGCGCAGGAACTCGCGGAGCGCAA<br>GTTCCGTTGA |
| 492 | 450 | ATGACATCTTTATATCCAACAAGTAAAACTATCCGTTTTAAGTTGGAACCTATTGGAAAA<br>ACTTCTGAGAATATAAACAAAATGGCATACTCAGCGCAGATGAATGCAAAGCGAAAG<br>ACTATTTAAAGATAAAAGAAACGATAGACGCCTATCACAAATATTTCATAGATCAACAA<br>CTTCGACTTGTAAAAACAGAAACAATAAATAAGCAAAAAACAGGTACAAAATTCTTTCT<br>GATTGATGGCGTACAGAATGTCTACAACATATACAATAATCTGAAAAAAGACAGGAAA<br>GATGAAAAAAATCGCAGGCTTTTTTTAGATAAATGCACTGCTCTGCGCAAAAAACTCGT<br>CAGTGAGGCTTTTCCATCTGAAGTAATCAAAAAACTGACCAGCGGAAAACTATTCACTG<br>ACATTTTGCCAGAGTGGGTGGCTCAAGAGAATACTACCAGATCCAACGAAAAAAACT<br>TTTTTGGTCTGATACGTTTAAGCGATTCTCAACATATTTTAGTGGTTTTCACGAAAACCG<br>GGAAAATATGTATTCTGGCGAAGAAAAATCTACAGCCATTGCCTATAGGTTGATTAACG<br>AAAACCTCCCTCGTTTTTTGATAATGTAGAAAATTTCGGAAAATACAAATACTCTGA<br>AAGAATGGACAAGTATTTTTAGCGATAAAGAAAAACAACTTTTTAATGAAAAAACAATT<br>AAATCAACTTTTGTATTAGAAAACTATGCAAATTGCCTTACGCAGAGTGATATAACATG<br>CTATAATAATTTAATTTGTGGGTATACATCTGAAAACAAAGAAAAAGTTCGAGGATTAA<br>ACGAGTTTATCAATCTCCACAATCAAAAAATTAAGGATAAAAAGAAAAACTCCGCTCG<br>TTTAAGTTATTATATAAACAAATACTCAGCGATCGCGAAACGGTTTCATTTATCCCATAT<br>CAGTTTACTTCAATAAATAAGTTGTATGATGCTATTAATAATTTTTATTTAGTTTGCATCG<br>TAAATGAAAAGATGATGGAGGAGAAAATTGTAATGTTTTTGAAGCTATTGAGAAGCA<br>TTTAAAAAAATAAAGATGGTAACTATGATTTAAAGCATATTTATATATCTCATAGATC<br>TGTTTCATCTATTTCACAAAAGTTTTTGGTAGGTATTCATTTATAAAAGATGCTTTAGA<br>ATATTATTATTGTACAGATATAAGACCAAAGTATGAAGAAGAAATACAAAAAGCAAAA<br>CCATCTAAACGAGAAAAAATTGAAAAGAACTAGATAATTATGTAAATCAACAATATTT<br>ACCTATTGAGTTAGTTGATAAAGCTTGTGAAAAATATTCAAAAACATTAGAAGATAATT<br>TTAAACATTCTGAATCTTCAGCAATAACAGATTATTGCGCTCATTTTTTGACCAAAATTA<br>TATCCTCTAAAACTTATTCAGCTGGAAAATATGAAGATGAGCGCTACTCTTGCATAAAG<br>GGTGAACTGAATACCCAGCACGATGAAAACTACCATCCTTCAACAGAAGTGGTGAACA |

TABLE S14C-continued

Native Nucleotide Sequences Group X

| SEQ ID NO | Corresponding AA | Sequence |
|---|---|---|
| | | ATATTAAACTCTTCATGGACACTATCCTAGAGTCTATTCACAGGCTACGGGATTTCATCA<br>TTCGACGCGATGAAGAAAATATTTGTGAGAAAGATGAACATTTTTATGAATTTATTGAT<br>AAACTTTGGGAAAAGTTGTCAGCGTTTATAAATCTCTATGATAAAACTCGCAACTATCT<br>AACAGGAAAACCATATAGCACTGATAAAATTCGCCTTACATTCAACATTCCTGCTCTTGC<br>CGACGGTTGGGATGAAAACAAAGAAAAAGATTGCAGAGCTTTCATTTTTAAAAAAAGC<br>GAACAGTATTATCTTGGAATTGCAGCAAAATCTGGTTTACATTTCGTTTACAATGATAAA<br>GAACATAATCTCTCTTCATGTTACTGGAAAATGATCTACAAGTATTTCCCTGATCCCAGT<br>AAAATGATCCCGAAATGCACAATTACAACAAAAGATGTAAAAACTCATTTTGCATCTAG<br>TGATGATAACTATGAACTTTTTGACCCTAAAAAATTTGTCAAACCAATAATTATATCGAA<br>AGATATATATGATATTTACTTCAACGCAGGTCCGAAGCCTGCCTTTACGGGAGAATTTA<br>TTAAAAATGGAGGCGACCAAAAAGAGTATAAAAATGCATTAACAAAATGGATTGATTT<br>TTCTAAACAATTTCTTTCTTCTTATTCAAGTACAGCTGTTTATAACTTCGATAGCTTGCGA<br>CCGTCAAATAGTTATCAAATATCAGTGAGTTTTATTCTGAAATAGCTGCTTTAACTTAT<br>AAAATAAATTTTAAACCTATTCTATCAAAATATATTGATGATCTTGTTCAAAAGGTGAT<br>TTATATCTTTTTAGAATTACTACGAAAGATTTTAATTCAACTCATGGAATGCCGAATCTT<br>CATACTTTGTATTGGAGATCCCTTTTTTCTGAAGAAAATCTCGTTAAAACGTGTATAAAA<br>TTAAATGGACAAGCAAATATTTTTTATAGAGTTCCATCAATAACTAGTCCAGTTATTCAC<br>AAAAAAGGGAGTATTCTTGTCGGAAGAACAGCAACCAATGGTAAAAACATCCCTGAAC<br>ACATTTATACTGAATTATGCTTAATCAAAAACGGAAAAAAAGCAGAAAAGGATGCCGA<br>TACTGAAACACGTGAATACCTTACAAAAATTAAAATCAGGGAAGCTCAGTACGATATCA<br>TCAAGGATCGTCGCTTCACACAGAGTACTTTTCTTTTTCATGTTCCACTGACTTTTAATTT<br>TGGAATAAAGCCAAGTAAAACTTTCGAATTCAATAACAAAATAAACGATTTTTTAAAGA<br>AACATGATGATGTCAATATTATCGGTATTGATCGTGGAGAACGGCATCTCCTCTATGTA<br>TCTGTCATAAATAGACAAGGGGATATTCTTGAACAGACTACTCTCAACATTTTAAATGG<br>TGTTGACTATCACAGTAAACTTGATAACCGCGAAAAGGAGCGCGCCGGAGCTCGAAAA<br>AACTGGGGTACTATCGGTCGAATTGCCGACTTAAAAGAAGGGTATCTTTCCATTGTCAT<br>TCATACTTTAGTCGAGATGATGATTCGATATAATGCTATAATTGTAATGGAAGATCTCA<br>ATACGGGCTTCAAGCGTGGCCGCTTCAAAGTTGAAAAACAGGTTTATCAAAAATTTGA<br>AAAAGCATTAATCACGAAATTAAATTATCTTTGTCTTAAAGATATTGCAATAGATAAAT<br>TGGAGGCATATTGCACGGTTGGCAGCTCACAAATCCATTTGAAAGCTTTAAAAAAAATG<br>GGACATCAGAATGGTATTATTTTTTATATTCCAGCTTGGAATACAAGTAAAATTGACCCT<br>ATAACTGGATTTGTAAACGTAATAAAACATAAATATACAAACAGAGAGTCTGCGAATA<br>AATTTTTTGAAAACTTTAAAGAAATCTCTTATAAATCAAAAGATGATGCTTTTGATTTCG<br>TATATATTGATAAATTTTCGGGAAAAAACTGGATTATCACAACAGGAGGAAAGGTAAG<br>GTACTTCTGGTTGAAAGATCCGTCAGGGCACGGAGGTTCAACACAGAAGGTTGATATT<br>ACTCAAAAATTAAAAAATTGTTTCACTAAAAACAACATACCTTGGGAAAATGGTGAAAA<br>TATAGTTGAGACTCTTACAACCTCAGTCAATGCCTCGGTTCTGAAAGAAGTGATCTGGT<br>GTCTGCAGCGTGTTCTCGCCATGCGAAACAGTTCTGCAGAAGATGGTGTGGATTTTATT<br>TTATCACCTGTCAGGATGCCTGATGGTCGGACATTCTGTAGTAATAACGCTGGTGAAAA<br>ACTTCCTTGCGATGCCAATGGCGCATATAATATTGCCAGAAAAGGCATCTTGGTTATGG<br>AAAAAATAAAAGCCGGCGATAAAAATCCGACTTTAATTAAAAATGAGGATTGGCTCAA<br>TTATGCACAAAGTGAAGTCGTCGTCGCAATGCAAATGAAAAAATATAAGTAG |
| 494 | 451 | TTGTCTCAATCAGAGATTGATTCCTACAATTCAAAAGTTGGCAACCTGAATTATTTGGTT<br>AATCTGTATTATCAGCAAACCAAAAATAACCTTCCCAAATTTAAAAGCTTATTCAAGCAA<br>ATTGGTTGCGGAGAAAAAAAAGATTTTTTAAAAAACCATAAAAGATAACGATGAACTTA<br>ATGATGTTTTAACAAAAGCAAAAAATCTTGGCGACAAATATTTTACGGGTGGAAAAGA<br>TAAAGAAACCGTCAAAGCCTTTACAGATTATCTTTTGAATTTGGATAATTTTGAAAATAT<br>CTATTGGTCGGACAAGGCAATTAACACAATCTCCGGAAAATATTTTGGTAATTTCGGCA<br>ATTTAAAAGAAAAATTGATAAAAGCAAAATTTTCAATGAAGATAAAAACAGCGGTGA<br>AGCAAAAGTTCCGCGGGCAGTCCAGCTTTCTGATTTGTTTGAAGTTTTGGACGGGCAA<br>GATGATTGGGACAAAGAAGGCGTTTTATTTCGTGAAAATTTTAAGGATAATAACAAGG<br>CAAAGCAAGACATTATTAAGAACGCCCAGACGCCGCACGAAGCATTGTTGAAAATGAT<br>CTGCAATGACATTGAGGATTTATCTAAAAAATTTATTAAGGGGGGGACGAAGTTCTA<br>AAAATCGAGAAAGGAGATTATCAAAAAGACGAAAGCAAGATTGCGATCAAGGCTTGG<br>CTTGACGACGCGCTTTTTGCGGGGCAAATTTTGAAATATTGGAGAGTTAAAGCGAAAT<br>ATTCTATTGATGGAAATTTTACAGAAATCCTCGATAAAGTTAAGGTTTTTGAAGTCGTTA<br>AAGACTATGATGTCGTTAGAAATTATTTAACTCAAAAGCCGCAAAACAAACTGGGAAA<br>ATTAAAATTGAATTTTGAAATTCATCGCTAGCGGCTGGCTGGGATATAAATAAAGAAA<br>AAGACAATTCTTGCGTAATATTGCAAAATGAACATGGAAAACAATATCTTGCGATAATG<br>AAATATGAAGAAACGAGTGTTTTTGAACAAAACAAGAAAAATGAACTTTATATGTCTGA<br>TAATTCCGGGTGGAAAAAAATTAATTATAAACTTTTACCTGGACCAAACAAGATGTTGC<br>CAAAAGTTCTATTTTCTTCAAAATGGGTTACTAACAATCCAACACCTGCCAATATAAAGA<br>AAATTTATGGCAAAGGAACATTTAAAAAAGGCGATAATTTTAATAAGAATGATTTGCAC<br>ATATTGCTTGATTTTTATAAAAATCAACTAAAAAAAATATCCATCTGAAAAAGAAAGCTG<br>GGATAAAATTTTTAATTTTGATTTTCTAATACGAAAAGCTACGAAAGCGTTGATCGGTT<br>CTATGCAGAGGTTGAAAAACAGGGCTATAAACTTGAATTTATACCTGTAAAAAAGAAT<br>AAGATTGAAGAATTGGTGGAAAACGGAAAAATTTATCTTTTTGAAATTAAAAGCAAAG<br>ATAGCAATTTGAAAAACGGCAAAGAGAAAACCTCGGCAAAGGACCTGCAAACAATTTA<br>CTGGAACAGGATTTTTAGTGATATTGAAAACAAACCAAAGTTAAATGGGGAGGCGGA<br>GATTTTCTACCGTCCGGCCTTGGAGGGAAAAAATCTAAAAAGGAAAAAGTGGAAGAAT<br>AAGGAAATTATTGAAAATTTTCGTTTTAGTAAGGAAAAATTTATTTTCCATTGCCCAATT<br>ACATTGAATCCTTGCCTGAAAAATAAAAGAATTAATGATTTAGTGAATCAAGTTATTGT<br>AGAAACCAAAAACCAGCTATTTCTCGGAATTGACAGAGGCGAAAAAAACCTTGCTTAC |

TABLE S14C-continued

Native Nucleotide Sequences Group X

| SEQ ID NO | Corresponding AA | Sequence |
|---|---|---|
| | | TATTCTCTTGTAAATCAAAGGGGAGAAATTTTAGAGCAGGGTAGTTTTAATATAATAAA
TAAGCAAAATTATTGGGAAAAGTTGGACATAAAACAAGGCGATCGCGACTTGGCGCGC
AAAAATTGGACGACAATCGGCAATATAAAGATTTAAAAGATGGATATATTTCGCAAG
TTGTAAGAAAAATTGTCGATTTGGCGGTTTACAACGAGGGCGACAGGAAAAAAGGTTT
TCGCGAAACTCCCGCGCTTATTATTCTTGAGGATTTAAATATCGGCTTCAAGCGCGGGC
GGCAGAAAATTGAAAAACAGGTTTACCAAAAACTTGAACTTGCCTTGGCTAAAAAATT
GAATTTTCTTGTTGATAAAAGCGCTAAAGATGGGGAAATGGCTTCGGTTGATAATGCCT
TGCAGTTTACTCCGCCAGTTCATGATTTTAACGATATTAAAGGCAAGCAATTTGGGATT
ATGTTTTATACTAATCCAAGCTTTACCTCAGCCACTGATCCAATTACGGGCTGGCACAA
ACAATATCTATTAAAAAGGGGTCAGAAATTAAAGAGCAAATTTTTGATTTATTCAGTGA
TTTTGGTTTTGATGGTAAGGATTATTATTTCAAATATAAAGACGCGAATATTGGTAAAG
AATGGATTTTATATTCCGGAAAAAATGGTGCGGAATTGGATAGATATCGCGATAAATTT
TCAGAAAAGAGGGTAAGAAGCATTGGAGCCCGGATAGAATTGATATCGTTAAAAATT
TAGAAAATATTTTTAAGGGATTTGATAAAAATAAATCTTTCAAAGAGCAGATTAAAGAT
GGTAAAGAATTGAATAAATTCGACAAAGAACGAACAGCTTGGGAAAGCTTAAGATTTG
TTATTGATGTTATTCAACAGATCCGCAACACCGGAGAAGATGAAAAAGACAACGACTTT
ATTCTTTCTCCCGTTAGGGGTGCGAGTGGTGACTTTTTTGACTCTCGTAAGATCAAAAT
GGTGCAAAACTCCCGCAAATGGCGATGCTAACGGCGCGTATAATATTGCCCGCAAGG
GAATTATTATGAGCGAACATATTAAAAGAAACGCGGATTTGTTTGTGCGAAATGAAGA
GTGGGATGCTTGGCTTGCGGGAGAAAAAAATTGGGTAGATTATATGGCGAACAATCTT
AAAATAAGGCAGAAAACTGTTTAA |
| 495 | 452 | ATGAATACCATGACCCAGAGATCGCCTGTGTCCGGTGGAAAGAATCCCGAAGGACAAA
AGTCCGTGTTTGACAGCTTTACTCACAAATACGCATTGTCGAAGACATTGCGGTTTGAG
TTGGTGCCGCAAGGCAAAACTTCCGAATCCTTAAAAGCTGTTTTTGAAGAAGATAAAAA
AGTCGAGGAAAACTATCAAAAGACCAAGGTGCGATTGGACCAATTACATCGTTTGTTT
GTGCAAGCGTCTTTTACAGAATCAAAAGTCAGTGCGTTAAAACTTGCAAGTTTTGTACG
TGCATATAACGCCCTTATCGGTGTTGCCAAAAAGACACAAACGAAAGAACAGAAGAGC
GCATATGAGAAAGAAAGAAAAGCTCTTTTGTACGAGGTCGCAGGTCTCTTTGATGAGA
TGGGCGATGAGTGGAAGGCACAATATGAAGAAATAGAATCCGTTGGGCGCACAGGCA
AGCAAAAGAAAATCAAGTTCTCATCTACAGGCTGTAAAATTCTCACTGACGAAGCGGT
GTTGAATATCCTAATGGATAAGTTTGCTGAAGATACACAAGTGTTTTCGACATTCTTTG
GATTCTTCACATATTTTGGAAAGTTTAACGAGACGCGAGAGAATTTCTACAAGAGTGAC
GGTACGAGCACGGCGGTGGCTACACGTGTAGTCGAAAATCTCGAAAAGTTTTTGCGCA
ATAAACACATCGTTGAATCCGAGTATAAGAAAGTAAAAACCGCTATCGGACTCACTGAT
TCCGAGATTCTTGCGCTGACCGATGTTGAGGCCTATCATCGTCGTTGTTTTTTGCAAGCCGG
AATCGATGTTTACAATACTGTTCTTGGAGGCAGTACCGAGCTTGAGCAAAGTGTGAATA
AAAAAGTAAACGAATACCGTCAGAAAACTGGAAACAAAATCAGTTTTTTGGCAAAATT
ACACAATCAAATTTTGAGTGAAAAAGACGTGTTTGAGATGCTCGTGATAAAAGGTGAT
GCCCAACTCTGGGAGAAACTAAAGGTATTTTCTGAAGAAAATGTCGCCTACTGCACGA
AGATGTTGGCGCTCATTCGTGACGCACTTACTATGCCAGAAAAAAGTGGGTATGAGTG
GTCAAAAATATATTTCTCCAGTGGTGCGATCAATACGATTTCGAGTAAGTACTTCACAA
ACTGGAGTGTACTCAAGGGCGCACTTCTCGATGCGGTTGGCACGGCGAAGGGTGGAG
GTGGGGAGTTACCTGATTTTGTGTCCCTTCAACACGTACAGAATGCTCTCGATGTGAAC
GAAATAAATAAAGGGAAGAAACCGAGTGAGTTGTTCAGGTCAGAGATATTGAAACAT
GCAGCATTTGTCGAGAGTGTCGGGCACTTTACAAACCTCATTACAATACTCTTGAGTGA
ACTTGATGCGCGTGTTGCCGAAAGTGCAGTTGATTTGGCGGACCTCAAAAAAGATTCCT
TTTGGACAACGGGCGCACTTTCGCAGAGGCGTAAGGAAAAAGAAGATGAGGGGACAA
TTCAGATCAATCGTATCAGCGCGTACCTTAATAGCTGTCGCGATGCGCATCGTATGATC
AAATACTTTGCGACGGAAAACAGGAGAGATTGGGTTGAGCCAGAAGAGGGTTACGAC
CCAAAATTCTACGATGCCTATCGCGAAGAATATGCGAAAGACATTTTCTTTCCGCTCTAC
AATGTAGCGCGCAATTTTCTCACTCAAAAACCATCCGATGAAAACAAAGTCAAACTCAA
CTTCGAATGTGGCACCCTTCTTTCCGGGTGGGACAAAAACAAAGAGCAAGAGAAGCTG
GGCATTATTCTGCGAAAAGACGGCGCTTATTATCTTGCGATAATGCGTAAACAGTTTAG
TGACATACTGGAGGAGAAGAAACACCCCGAAGCGTATCGAGCAGGTGATAATGGATA
TTCAAAAATGGAATACAAACTGTTTCCAGATCCAAAGCGCATGATTCCCAAGGTGGCTT
TCGCGGAAACCAACAAAAAAACGTTTGGATGGACACCAGAAGTGCAGGCGATTAAAG
ATGAGTATGCCAAGTTCCAAGAGTCAAAAAAGGAAGATCAGAGTGCGTGGAAAAATC
AGTTTGATGCGAATAAAACTGCCAGACTAATTGCGTACTATCAAAACTGTCTCGCCAAA
GGTGGTTACCAAGAGACGTTTGGACTCACATGGAAGAAACCAGAGGAATATGTGGGT
ATCGGTGAATTTAATGACCACATTGCACAGCAAAATTACAAGATAAAGTTTGTTCCAGT
AGATGCGGACTACATTGATGAGCATGTTGCAAAAGGAGAGATGTATTTGTTCAAAATT
AAAAGCAAAGACTTTGCGAGCGGATCAACGGGTACTAAAAATGTGCATTCACTCTACTT
CTCACAACTCTTTTCCGAAGCAAATCTCGCACAGACACCGACTGTGGTACAACTCGCCG
GAAATGCGGAGATTTTTACCGCGAGGCATCGGTGGAGCCGGAAAAAGAAAAACGCA
ACTTCCCGCGAGACATCACCAAATACAAACGTTTTACCGAAGACAAGGTATTCTTCCAT
GTGCCAATCAAGATCAACGCGGGACGGATGCAATGCGTAGCCAATATCAATTCAATA
AGATACTCAATGCCGAGCTTATCGCGAAGCGCGCAAAAGACTTTTGCATCATCGGCATT
GATCGCGGGGAAAAGCATCTCGCATACTATTCAGTGATCAATCAAAAAGGTGTGATTG
TCGACGAAGGGGAGTCTAAATGAGATTAGCGGCACCGACTATCAAGCTTCTTGATGG
CAAGGAGAAAGAACGTACTGCCAATCGCCAAGCATGGTTACCGGTGCGCCAGATCAAA
GACCTCAAGCGTGGATATGTATCGCATGCTGTCAAAAAGATTTGCGACCTCGCCATAGA
ACACAACGCGATTATCGTGCTCGAAAATCTCAACATGCGTTTCAAACAATTCGTAGTG
GTATTGAAAAGAGTGTATACCAACAGCTCGAAAAGCAACTCGTAGACAAGCTCGGTCA |

TABLE S14C-continued

Native Nucleotide Sequences Group X

| SEQ ID NO | Corresponding AA | Sequence |
|---|---|---|
| | | CATGGTGTTCAAAGACAGGCCGGAGCTTGAAATAGGCGGTGTCCTAAACGGTTATCAA CTCGCCGCGCCGTTTGAGTCGTTCAAAGACATGGGTAATCAGACCGGTATCGTCTTCTA CACTGAAGCAGCATACACGTCGACGACAGATCCTGTCACCGGATTCCGTAAGAATGTG TATGTCAGTAACTCAGCTACCAAAGAGAAGTTAGAAAAAGCAATTAAATCTTTCGATGC TATTGGTTGGAACGAAGAAAGGCAAAGCTACTTTATCACTTACGATCCAGTTAGACTTG TAGATAAGAAGGAGAAAACTAAAACGATATCGAAATTATGGACGGTATATGCAGATGT GCCACGTATTCGTCGCGAGAGAAACGAACAAGGTGTTTGGAATGCTCGGAATGTAAAT CCGAACGATATGTTCAAGTCTCTGTTTGAGGCGTGGAATTTTGAGGACAAAATAGCGA CCGACCTAAAAAGTAAGATCGAGGAAAAGATGAAAAATGGAGAACTCAGCAGCTATA AGATGATTGACGGGCGAGAAAGGAACTTCTTCCAGGCATTCATCTATATCTTCAATATC ATTCTCGATATCCGAAATTCGTCTGATAAGACCGACTTCATTGCATCACCCGTTGCTCCA TTCTTCACAACCCTCAATGCGCCAAAGCCAAATCCATGTGACATCAATCTGGCGAATGG CGACTCTCTCGGCGCCTACAACATTGCTCGAAAGGGTATTATCACCATTGGCCGTATAA ATGATAATCCAGAAAAACCGGATTTATACATCAGTAAAGAACAGTGGGACGAATGGGC AACTAAACACGGAATACAACTATGA |

TABLE S14D

Direct Repeat Group 14

| SEQ ID NO | Direct Repeat (Variant #1) | SEQ ID NO | Direct Repeat (Variant #2) |
|---|---|---|---|
| 500 | ATCTACAACAGTAGAAATTCCCTATAACGAT TTGGC | 501 | CTACAACAGTAGAAATTCCCTATAACGATTTGG C |
| 502 | GGCTATAAGCCCTCAATAATTTCTACTATCG TAGAT | 503 | GGCTATAAGCCCTCAATAATTTCTACTATCGTA GAT |
| 504 | GTCTAGTAAAGACATGTAATTTCTACTATTG TAGAT | 505 | GTCTAGTAAAGACATGTAATTTCTACTATTGTA GAT |
| 506 | ATCTACAATAGTAGAAATTAATAGTATCTCT TAAAG | 507 | ATCTACAATAGTAGAAATTAATAGTATCTCTTA AAG |
| 508 | ATCTACAATAGTAGAAATTAAATTAGTCTTA TAGAC | 509 | ATCTACAATAGTAGAAATTAAATTAGTCTTATA GAC |
| 510 | ATCTACAATAGTAGAAATTAAATGTGTCTTT TAGAC | 511 | ATCTACGATAGTAGAAATTATATATTCTTATTA AAC |
| 512 | GGCTACTAAGCCTTTATAATTTCTACTATTG TAGAT | 513 | GCTACTAAGCCTTTATAATTTCTACTATTGTAG AT |
| 514 | GTCTATATGACTAAGTAATTTCTACTATGTG TAGAT | 515 | GTCTATATGACTAAGTAATTTCTACTATGTGTA GAT |
| 516 | GGCTAAAGCTCTTTAAGAATTTCTACTGTTG TAGAT | 517 | GGCTAAAGCTCTTTAAGAATTTCTACTGTTGTA GAT |
| 518 | ATCTACAATAGTAGAAATTATTTGAGCCTCT TAGGC | 519 | ATCTACAATAGTAGAAATTATTTGAGCCTCTTA GGC |
| 520 | GAATAATAATCCCTTTAAATTTCTACTATTGT AGAT | 521 | GAATAATAATCCCTTTAAATTTCTACTATTGTA GAT |
| 522 | ATCTACAACAGTAGAAATTGAGGTTCGTTG GTCAAC | 523 | ATCTACAACAGTAGAAATTGAGGTTCGTTGGT CAAC |
| 524 | ATCTACACACAGTAGAAATTATTTAGGTTAC TTAAC | 525 | ATCTACACACAGTAGAAATTATTTAGGTTACTT AAC |
| 526 | ATCTACATAAGTAGAAATTCTTATAAGTTGT TAGCC | 527 | ATCTACATAAGTAGAAATTCTTATAAGTTGTTA GCC |
| 528 | CTCTAATAGGCATATTCAATTTCTACTTTTGT AGAT | 529 | TCTAATAGGCATATTCAATTTCTACTTTTGTAG AT |
| 530 | GTTTTAAGGACTTAGAGAATTTCTACTGTTG TAGAT | 531 | GTTTTAAGGACTTAGAGAATTTCTACTGTTGTA GAT |

TABLE S14D-continued

Direct Repeat Group 14

| SEQ ID NO | Direct Repeat (Variant #1) | SEQ ID NO | Direct Repeat (Variant #2) |
|---|---|---|---|
| 532 | ATCTACAAAAGTAGAAATTAGATATTATGTTTAAAC | 533 | ATCTACAACTAGTAGAAATTTTATTATTTTAATCA |
| 534 | ATCTACAAAAGTAGAAATTAGATATTATGTTTAAAC | 535 | ATCTACAACTAGTAGAAATTTTATTATTTTAATCA |
| 536 | GTCTAACGACCTTTTAAATTTCTACTGTTTGTAGAT | 537 | CTAACGACCTTTTAAATTTCTACTGTTTGTAGATAT |
| 538 | CTCAAAACTCATTCGAATCTCTACTCTTTGTAGAT | 539 | TCAAAACTCATTCGAATCTCTACTCTTTGTAGAT |
| 540 | ATCTACAATAGTAGAAATTCAATGAGGCTGTTAGCC | 541 | ATCTACAATAGTAGAAATTCAATGAGGCTGTTAGCC |

TABLE S14E crRNA Sequences Group 14

Figure 14A:
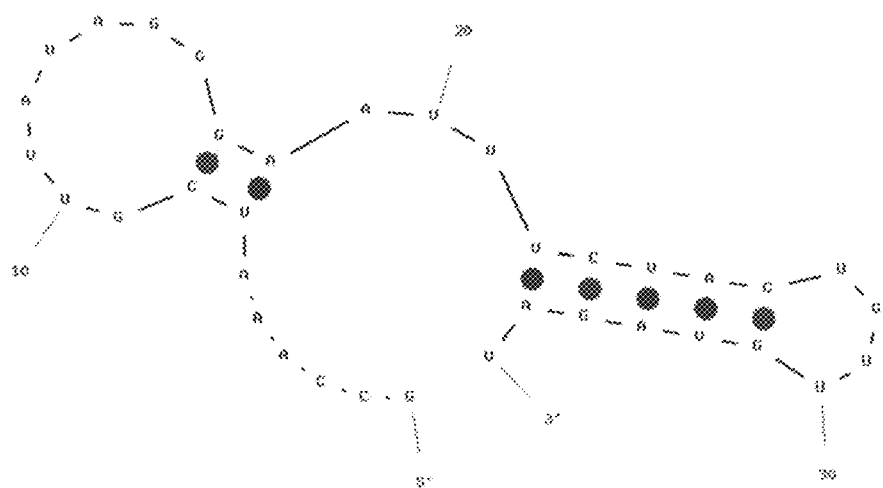
FIG. 14A-14V (SEQ ID NOs:542-563) are schemes depicting the predicted stem loop structures of crRNA sequences of the present disclosure corresponding to Group 14 sequences.
Figure 14B:
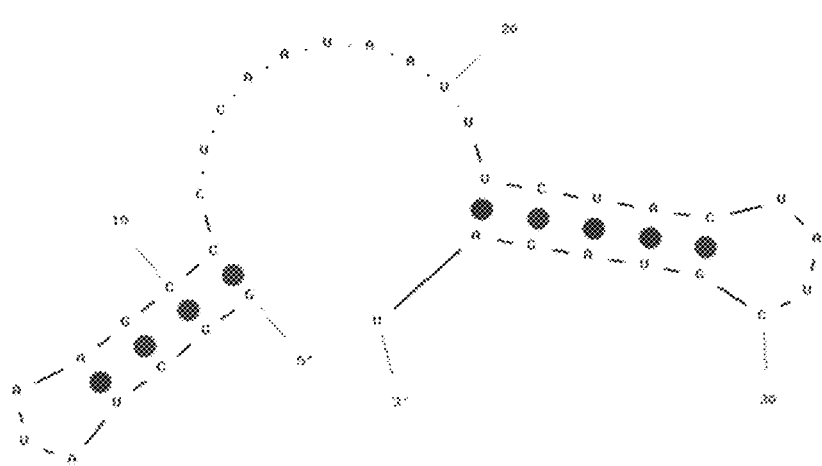
Figure 14C:
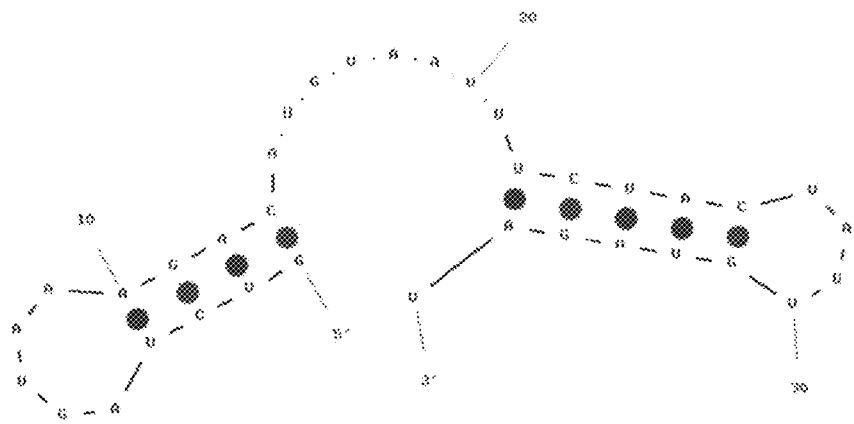
Figure 14D:
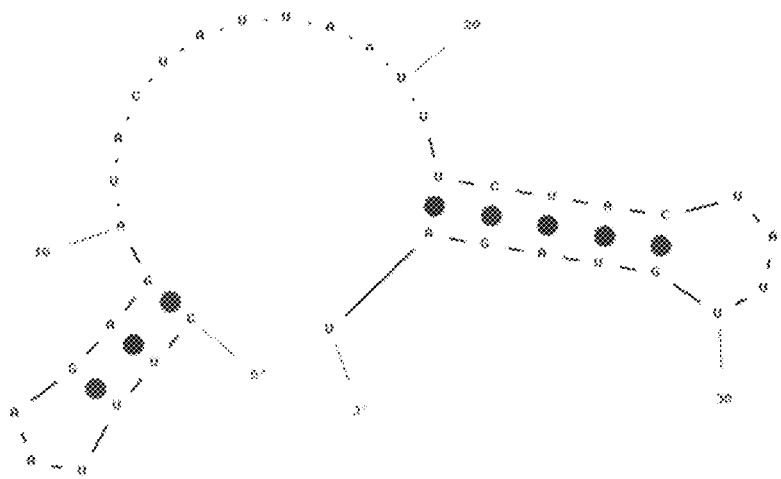
Figure 14E:
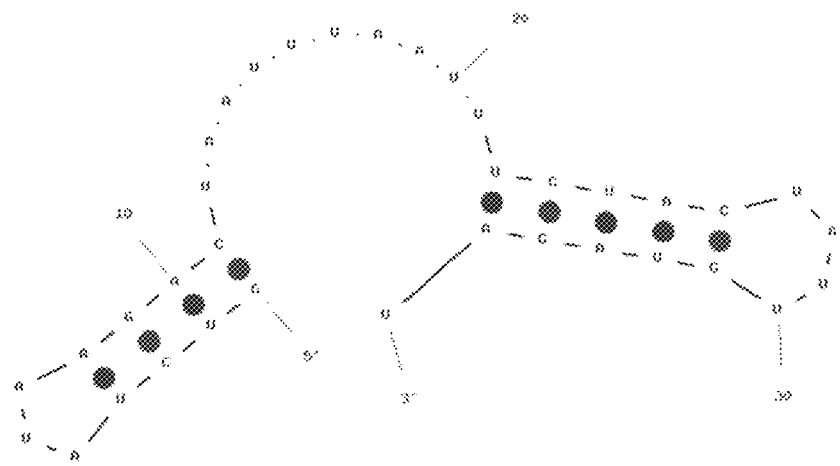
Figure 14F:
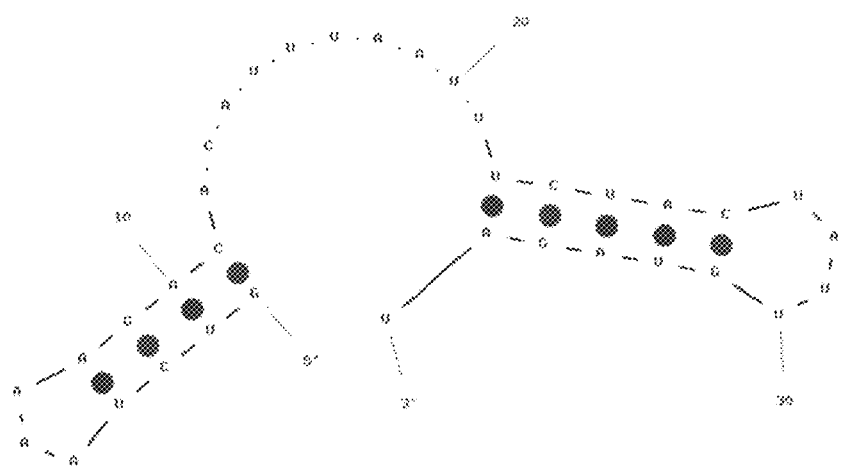
Figure 14G:
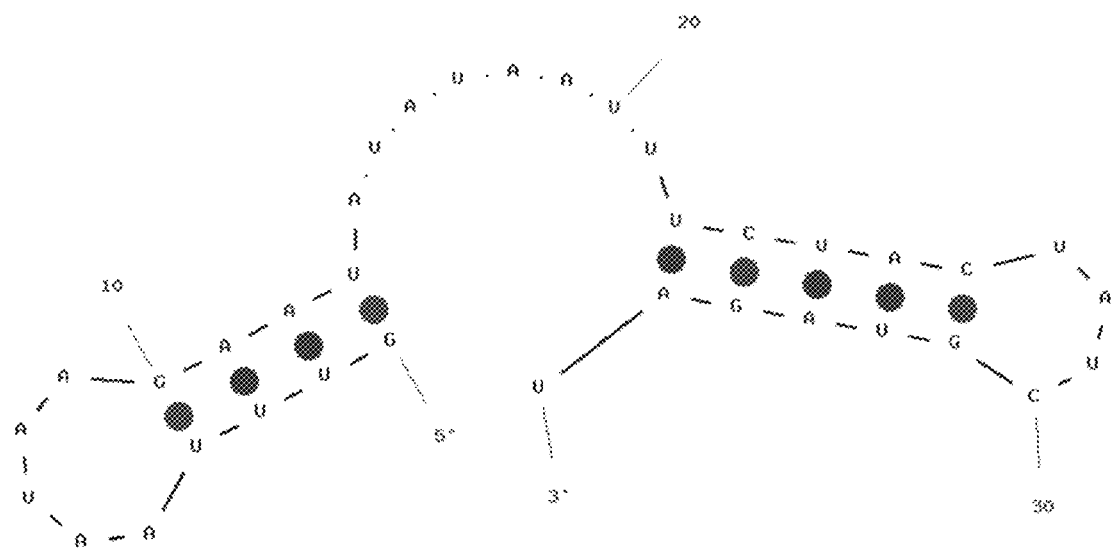
Figure 14H:
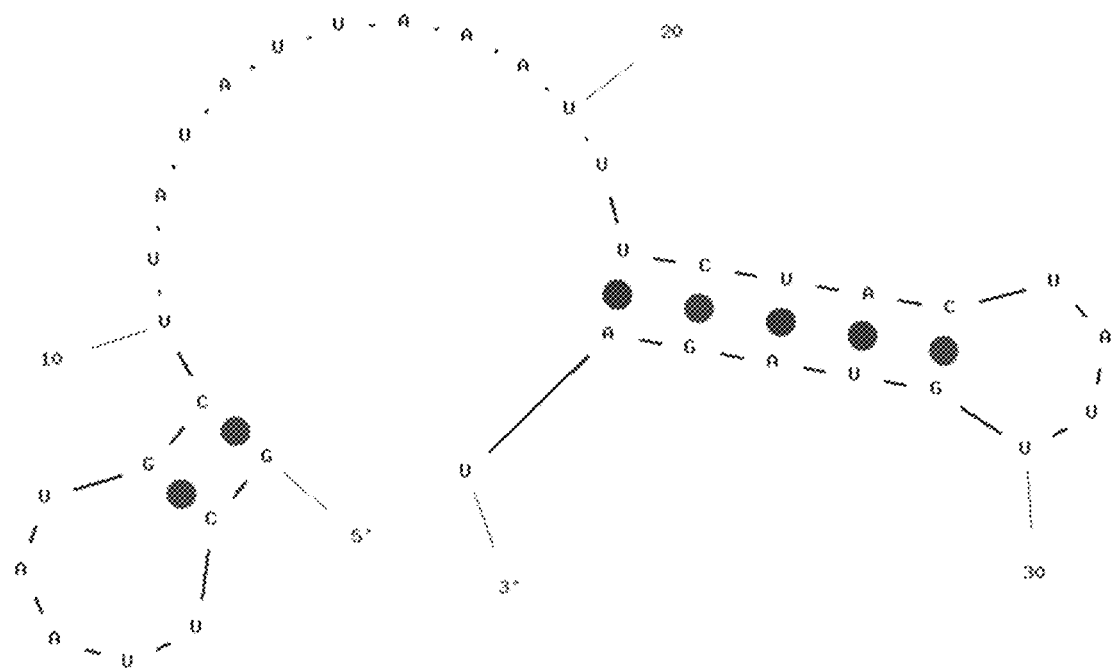
Figure 14I:
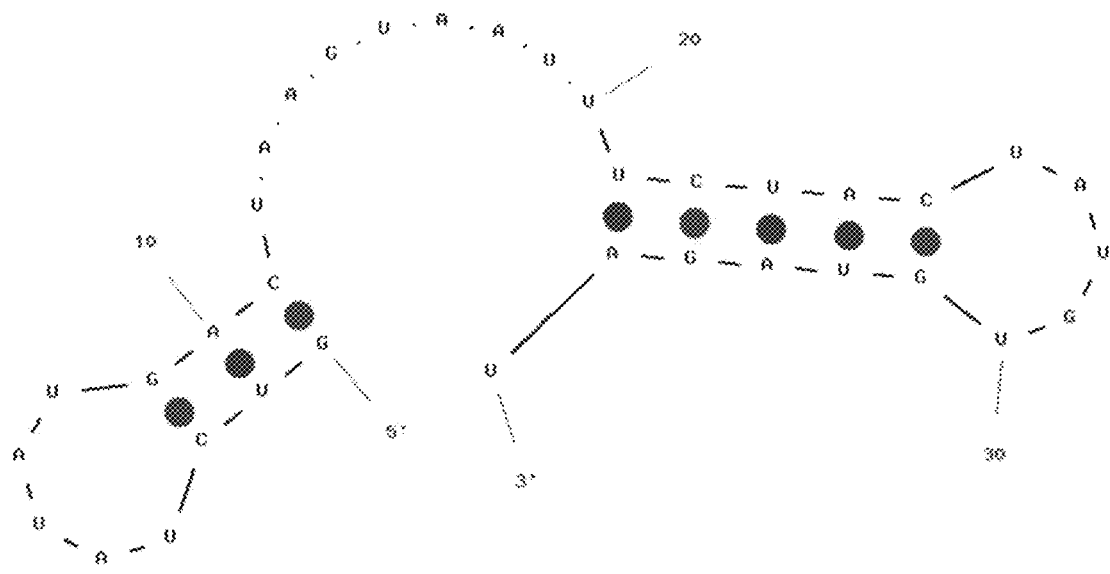
Figure 14J:
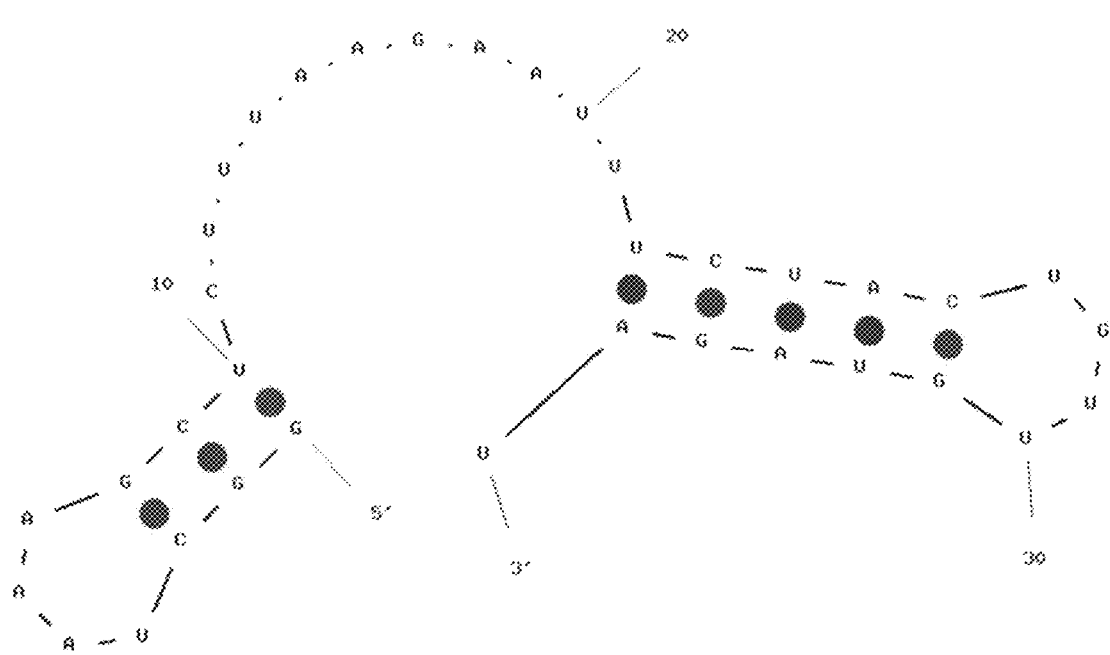
Figure 14K:
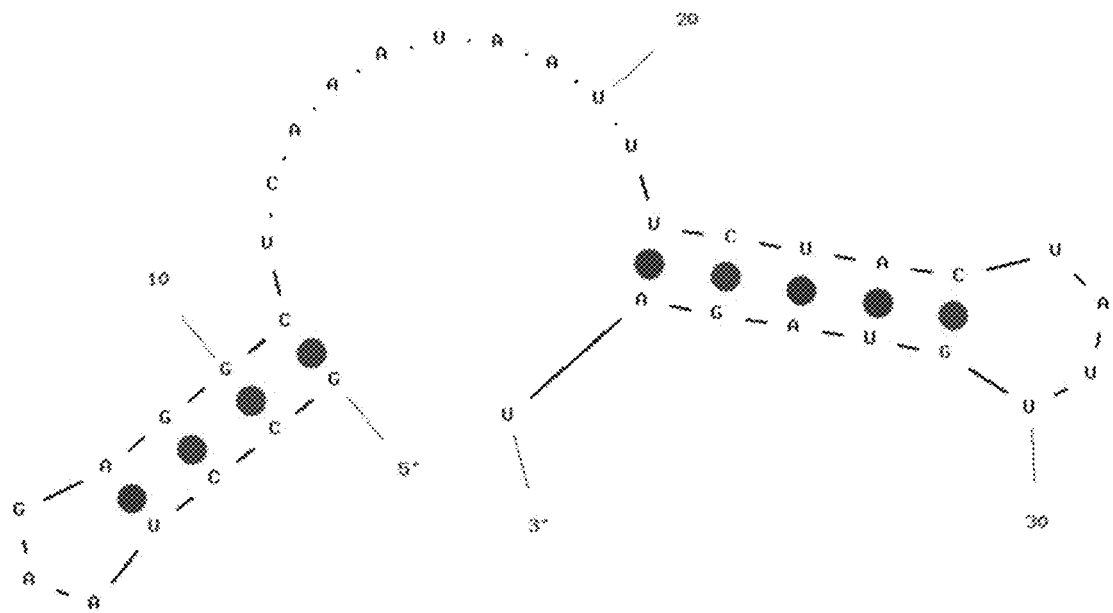
Figure 14L:
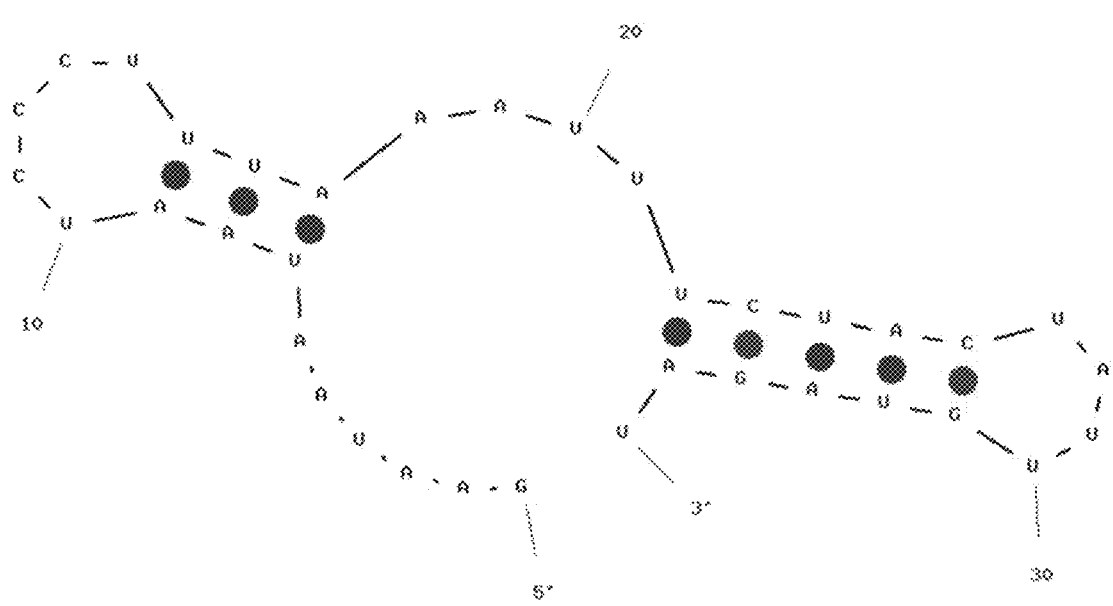
Figure 14M:
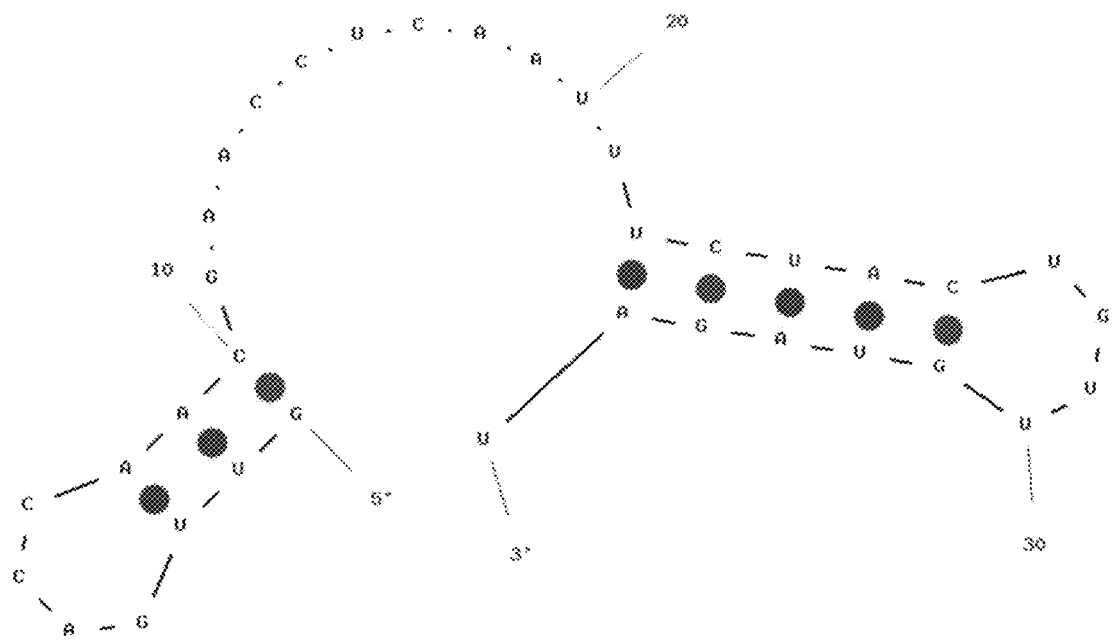
Figure 14N:
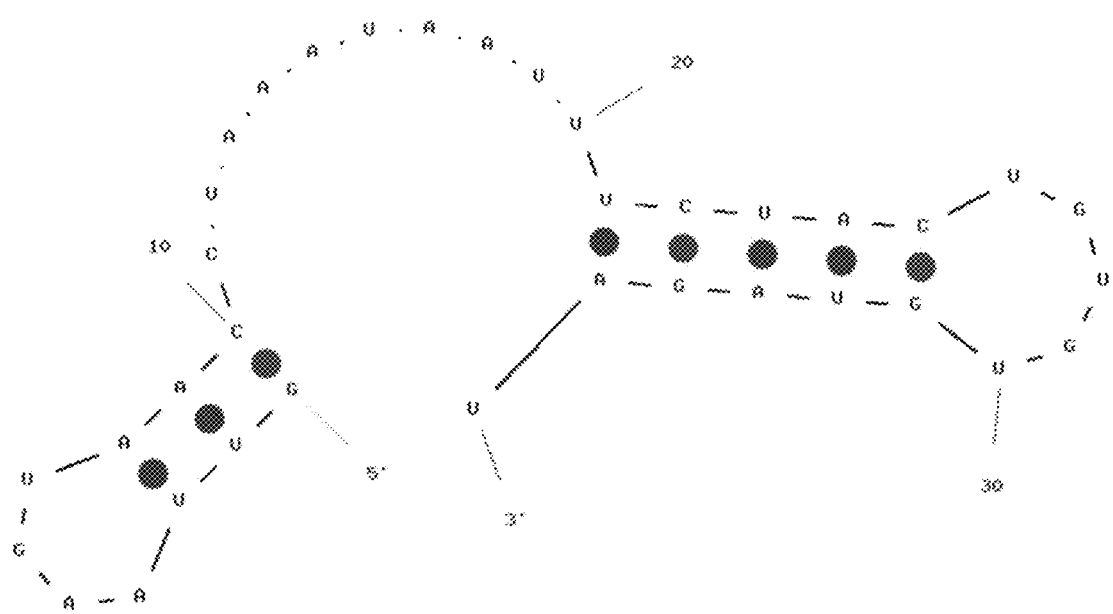
Figure 14O:
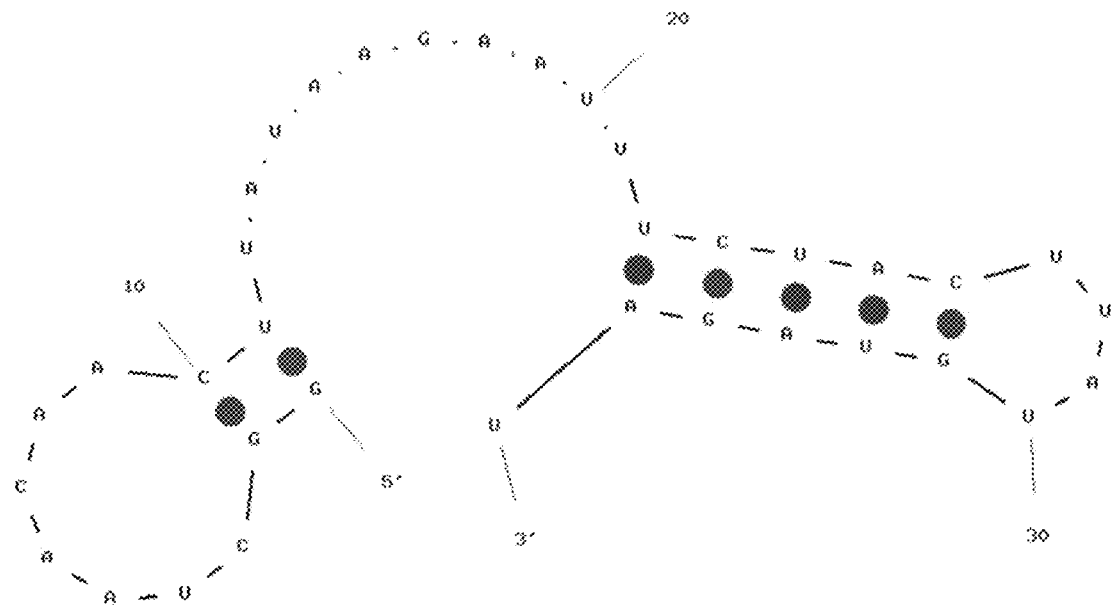
Figure 14P:
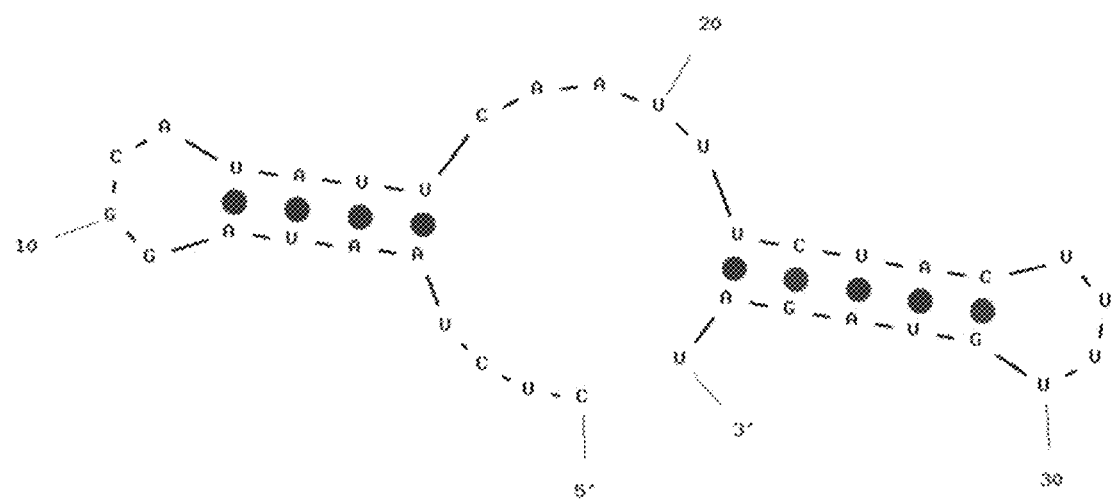
Figure 14Q:
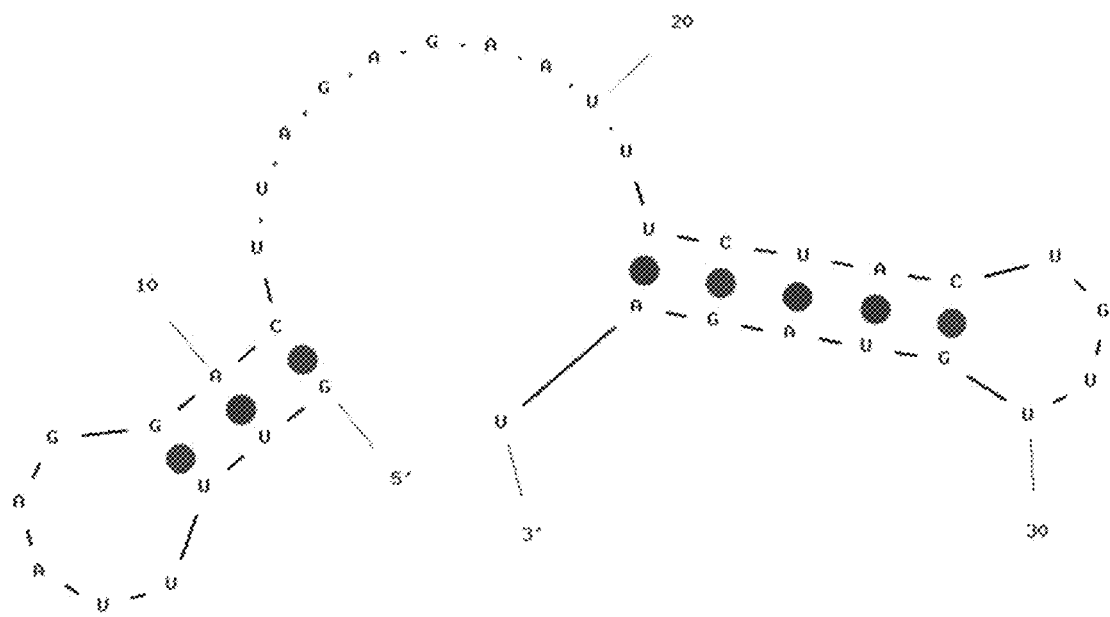
Figure 14R:
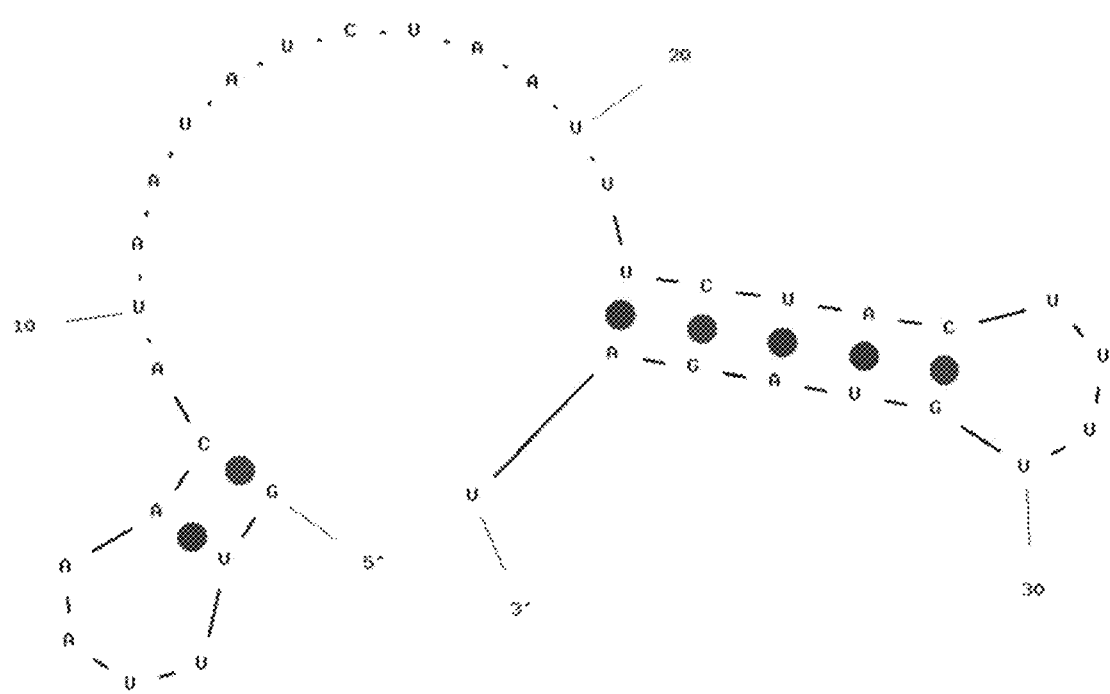
Figure 14S:
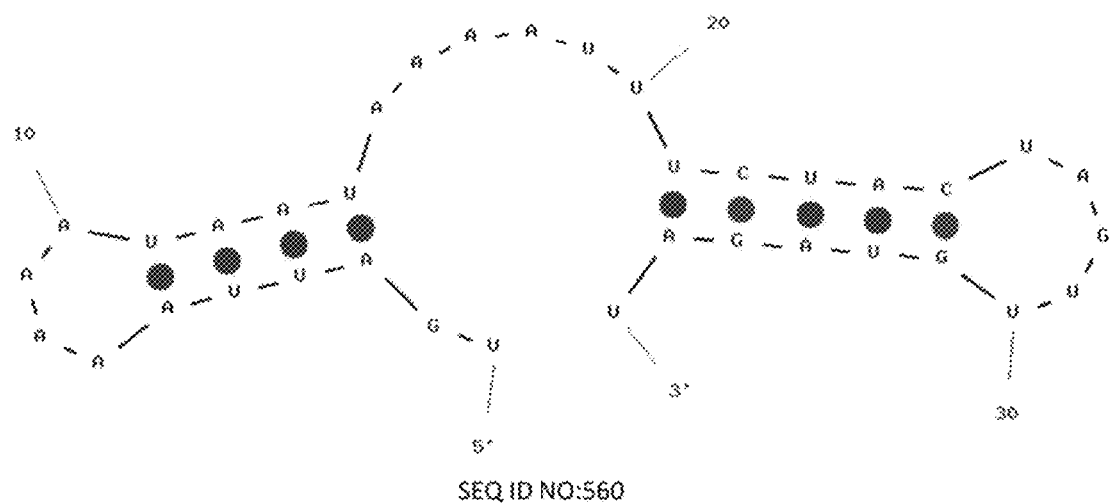
Figure 14T:
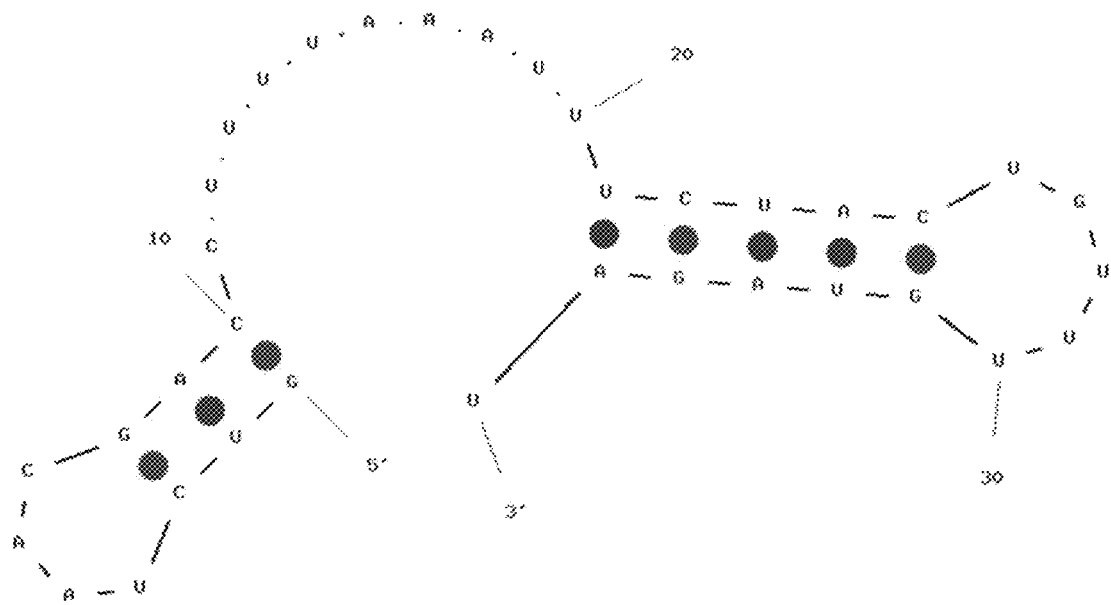
Figure 14U:
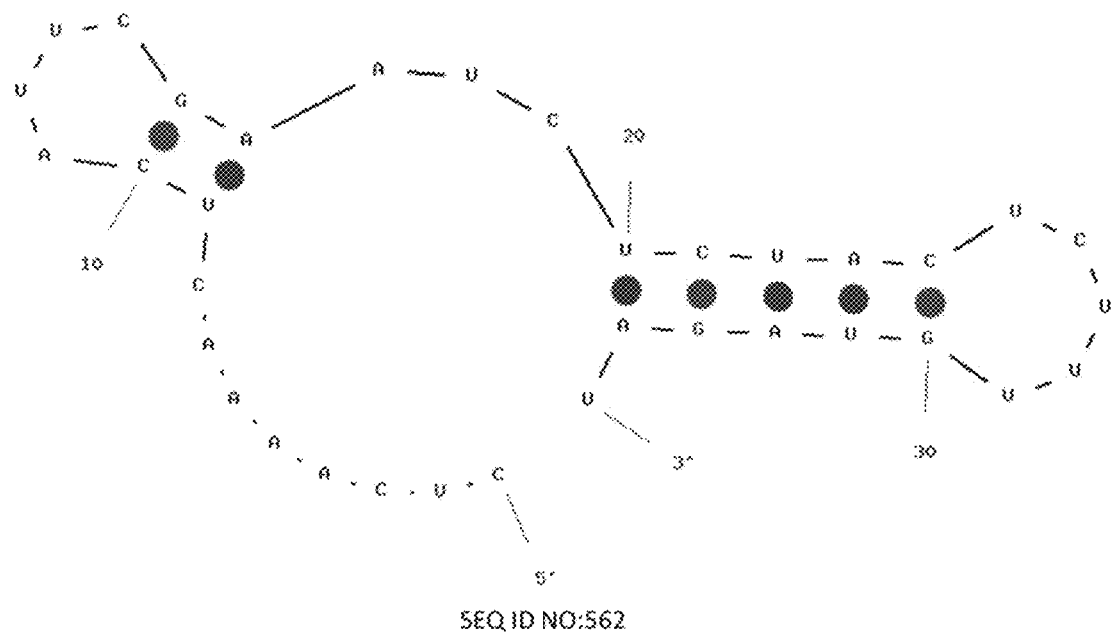
Figure 14V:
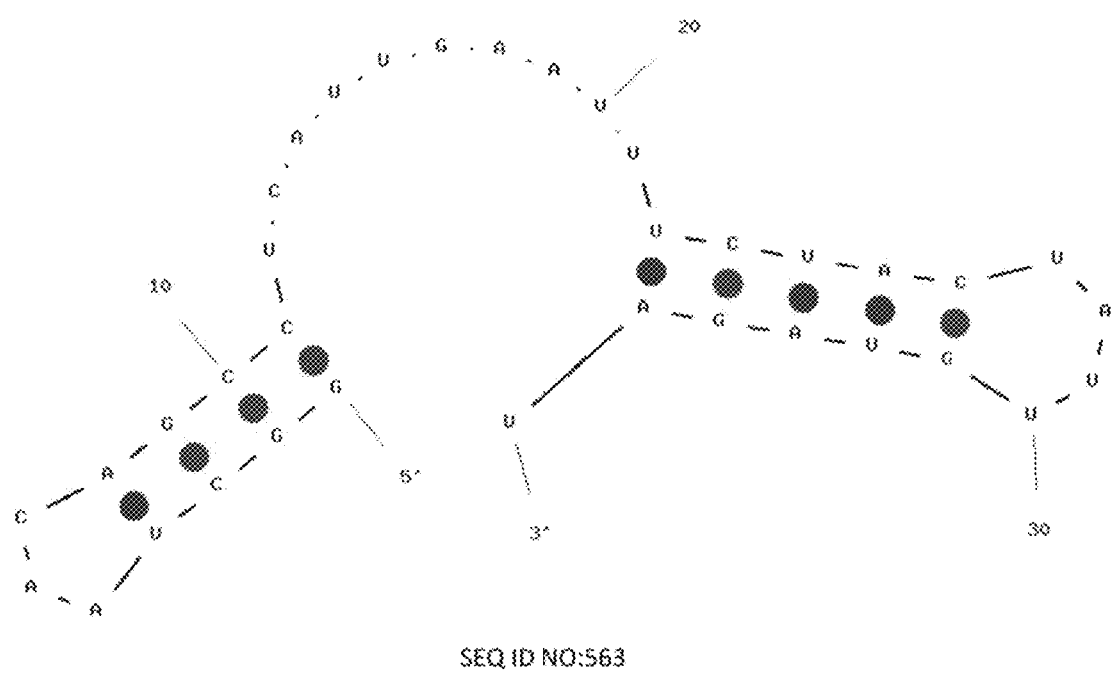

| SEQ ID NO | Sequence | FIG |
|---|---|---|
| 542 | GCCAAAUCGUUAUAGGGAAUUUCUACUGUUGUAGAU | FIG. 14A |
| 543 | GGCUAUAAGCCCUCAAUAAUUUCUACUAUCGUAGAU | FIG. 14B |
| 544 | GUCUAGUAAAGACAUGUAAUUUCUACUAUUGUAGAU | FIG. 14C |
| 545 | CUUUAAGAGAUACUAUUAAUUUCUACUAUUGUAGAU | FIG. 14D |
| 546 | GUCUAUAAGACUAAUUAAUUUCUACUAUUGUAGAU | FIG. 14E |
| 547 | GUCUAAAAGACACAUUUAAUUUCUACUAUUGUAGAU | FIG. 14F |
| 548 | GUUUAAUAAGAAUAUAAUUUCUACUAUCGUAGAU | FIG. 14G |
| 549 | GCUUAAUGCUUAUAUUAAAUUUCUACUAUUGUAGAU | FIG. 14H |
| 550 | GUCUAUAUGACUAAGUAAUUUCUACUAUGUGUAGAU | FIG. 14I |
| 551 | GGCUAAAGCUCUUUAAGAAUUUCUACUGUUGUAGAU | FIG. 14J |
| 552 | GCCUAAGAGGCUCAAAUAAUUUCUACUAUUGUAGAU | FIG. 14K |
| 553 | GAAUAAUAAUCCCUUUAAAUUUCUACUAUUGUAGAU | FIG. 14L |
| 554 | GUUGACCAACGAACCUCAAUUUCUACUGUUGUAGAU | FIG. 14M |
| 555 | GUUUAAGUAACCUAAAUAAUUUCUACUGUGUGUAGAU | FIG. 14N |
| 556 | GGCUAACAACUUUAUAAGAAUUUCUACUUAUGUAGAU | FIG. 14O |
| 557 | CUCUAAUAGGCAUAUUCAAUUUCUACUUUUGUAGAU | FIG. 14P |
| 558 | GUUUUAAGGACUUAGAGAAUUUCUACUGUUGUAGAU | FIG. 14Q |
| 559 | GUUUAAACAUAAUAUCUAAUUUCUACUUUUGUAGAU | FIG. 14R |
| 560 | UGAUUAAAAAUAAUAAAAUUUCUACUAGUUGUAGAU | FIG. 14S |
| 561 | GUCUAACGACCUUUUAAAUUUCUACUGUUGUAGAU | FIG. 14T |
| 562 | CUCAAAACUCAUUCGAAUCUCUACUCUUUGUAGAU | FIG. 14U |
| 563 | GGCUAACAGCCUCAUUGAAUUUCUACUAUUGUAGAU | FIG. 14V |

O. Group 15 Select Type V Nucleases from Groups 1-14

TABLE S15A

Enzyme Sequences Group 15

| SEQ ID NO | Ref. | Group | Sequence |
|---|---|---|---|
| 436 | ID400 | 14 | MNTMTQRSPVSGGKNPEGQKSVFDSFTHKYALSKTLRFELVPQGKTSESLKAVFEEDKKVEENYQKTKVRLDQLHRLFVQASFTESKVSALKLASFVRAYNALIGVAKKTQTKEQKSAYEKERKALLYEVAGLFDEMGDEWKAQYEEIESVGRTGKQKKIKFSSTGCKILTDEAVLNILMDKFAEDTQVFSTFFGFFTYFGKFNETRENFYKSDGTSTAVATRVVENLEKFLRNKHIVESEYKKVKTAIGLTDSEILALTDVEAYHRCFLQAGIDVYNTVLGGSTELEQSVNKKVNEYRQKTGNKISFLAKLHNQILSEKDVFEMLVIKGDAQLWEKLKVFSEENVAYCTKMLALIRDALTMPEKSGYEWSKIYFSSGAINTISSKYFTNWSVLKGALLDAVGTAKGGGGELPDFVSLQHVQNALDVNEINKGKKPSELFRSEILKHAAFVESVGHFTNLITILLSELDARVAESAVDLADLKKDSFWTTGALSQRRKEKEDEGTIQINRISAYLNSCRDAHRMIKYFATENRRDWVEPEEGYDPKFYDAYREEYAKDIFFPLYNVARNFLTQKPSDENKVKLNFECGTLLSGWDKNKEQEKLGIILRKDGAYYLAIMRKQFSDILEEKKHPEAYRAGDNGYSKMEYKLFPDPKRMIPKVAFAETNKKTFGWTPEVQAIKDEYAKFQESKKEDQSAWKNQFDANKTARLIAYYQNCLAKGGYQETFGLTWKKPEEYVGIGEFNDHIAQQNYKIKFVPVDADYIDEHVAKGEMYLFKISKDFASGSTGTKNVHSLYFSQLFSEANLAQTPTVVQLAGNAEIFYREASVEPEKEKRNFPPRDITKYKRFTEDKVFFHVPIKINAGTDAMRSQYQFNKILNAELIAKRAKDFCIIGIDRGEKHLAYYSVINQKGVIVDEGSLNEISGTDYHKLLDGKEKERTANRQ |

TABLE S15A-continued

Enzyme Sequences Group 15

| SEQ ID NO | Ref. | Group | Sequence |
|---|---|---|---|
| | | | AWLPVRQIKDLKRGYVSHAVKKICDLAIEHNAIIVLENLNMRFKQIRSGIEKSVYQQLEK QLVDKLGHMVFKDRPELEIGGVLNGYQLAAPFESFKDMGNQTGIVFYTEAAYTSTTD PVTGFRKNVYVSNSATKEKLEKAIKSFDAIGWNEERQSYFITYDPVRLVDKKEKTKTISKL WTVYADVPRIRRERNEQGVWNARNVNPNDMFKSLFEAWNFEDKIATDLKSKIEEKM KNGELSSYKMIDGRERNFFQAFIYIFNIILDIRNSSDKTDFIASPVAPFFTTLNAPKPNPC DINLANGDSLGAYNIARKGIITIGRINDNPEKPDLYISKEQWDEWATKHGIQL |
| 333 | ID401 | 10 | MKTIDSFCGQNEGYSRSITLRNKLIPIGETEKNIKEFLEKDVERSEAYPQIKKLIDDIHRGFI EECLSNVSFPWEPLFDQFELYQNEKEKIKKNAKKKELIVLQVAARKRIVKAFKDNKDFEK LFKEELFKELLPQLIKSAPVTEIADKEKALSVFTRFSTYFNGFHENRKNMYSEEEISTGIAY RIVNENFPKFFSNIKLFEYLKDNFPEIIKETEISLKDTLKGKKLCDIFKVEAFNNVLSQSGID FYNTIISGVAGEGGTQKIKGMNEIINLAKQQLPKEEKDKLHGKMVVLFKQILSDRETAS FIPTGFEKNEEVYASIKEFNNIIVKDSVTETRNLFALNSDIKLNEIIVPAKSITAFSLTIFGN WVIISEGLYLLEKDKITKALSEKQEEQLHKDIDKKDCNLEEIQSAYERWCSENGEIVRTSV RKYFNLIETQSSSSENTSTKKEVCILDEITKSFSQIDFENEKDLQQEKEAATPIKIYLDEVQ NLYHHLKLVDYRGEEQKDSNFYSKFDEIIEKLSEIISIYNKVRNFVTKKPGEVKKVKLNFD CPTLANGWDENKEKDNDAILLLKDGNYYLGIYNPKNKPKFDFEESKASDCYKKVVYKLL PGPNKMLPKVFFSAKGQKEFLPPKELLLGYEEGKHKKGENFDKEFMYKLIDWFKDAIN RHEDWKKFDFKFSDTRSYEDMSAFYKEVELQGYKISFKKVSTEIINEFVNSSKLFLFQIYN KDFAVKATGKKNLHTLYWENLFSEENLKDICFKLNGEAELFWRKASLIKEKVTVHKKNS ILINRTKKDGSTIPENLYQEIYQYKNNMISDISENAKDLLNSGKVICKKATHDITKDKHFT EDAYLFHCPITMNFKAPEITGRKFNDKVLEALKENPEIKIIGLDRGERHLIYLSLINQKGEI ELQKTLNLVDQIRNDKTVQINYQEKLVQNEGDRDKARKNWQTIGNIKELKEGYLSAIIH EIATLMIENNAIVVMEDLNFGFKHGRFAVERQVYQKFENMLIEKLNYLVFKDRSIKEPG GVLNAYQLTDKAANVSDVYKQCGWLFYIPAGYTSKIDPKTGFANLFVTKGLTNVEKKK DFFSKFDSIYYDEKEACFVFAFDYSKFGDNADFKKKWEVYTKGERLVYSKQERKSITVSP TEELKKIFNEFSINWNNSESVLDQIKTIPAEKLNAKFFDTLLRAFNATLQMRNSVPNSSR QEDDYLISPVKARDGTFYDSRIEAEKGIDKNGRWVSKLPVDADANGAYHIALKGLYLLE NNFNRNEKGVIQNISNVEWFKFAQTK |
| 386 | ID402 | 12 | LRSKMAKNTIFSKFTELYPVSKTLRFELKPIGKTLEKIKENGIIDHDKNKADNYVDAKKIID EYHKYFISEALKGINLDWSPLRDAFIDSLTNRTQDSKKKLEDLQKTFRKKIAEKLAAHPH FKELTATTPKDLFKNILPDHFGNDESIESFKGFSTYFKGFQENRQNIYSAEAISTGVPYRI VHDNPPKFLSNIETFQNIQKHCLSVLTDAETELKKLLNGQKLVEIFNIDFFNNVTQEGI DFFNQIIGGYTIENNTKIRGINEFANLYRQQNPEFAKLRIATRMIPLYKQILSDRDSMSFI LEPFKDASQVQSAVKDFFEDHILHYTTDGSQINVLDKIANLVASLNNFDSEKIFIARESLS QISQKIFGNWNSINDAFFEYCEKQFGSAQKTANKKKIDAKLKEDCYSIKEINCVIKKIDSS KQILDYWKEFDSLKNNIESGDIYKKYVDFISLKFEPDEKLEKDDNIQGLKAFLDAINEFLH YVKPLIVNHENGDTAFYNELMPLYDQLSNIIPLYNKTRDFATQKPSDSAKFKLNFENPTL ADGWDQNNEAKNTSIILKKEGNYYLGIMNAKDKPKIDTYKVNSNEPHYDKMVYKLIPS PHMSLPKAFFSKKGLALYKPSMQILDGYNANKHKKGSSFDKKYCHQLIDFFKEAISAHP DWKNPKFNFSETASYDDTSAFYNEISNQGYMLSFTSIPDSQIDTWIDEGKLFLFQIYNK DFAPGAKGKPNLHTLYWKATFSPENLKDVVFKLNGEAELFYRPCSIKKPYSHKIGEKMV NRITKDGRPIPDAIFGELFHYFNNSTKPSLSDDAKKYLDFVIVKDVKHEITKDKRYTEDF EFHVPLTMNFKSSDGSRYINDRVKDFLKNNPDVNIIGIDRGERNLIYMTLINQKGEILIQ KSFNLVGNTNYHEKLSIREQERDAARRSWRSIGKIKELKEGYLSLVIHEIAKTMIENNAII VLEDLNFGFKRGRFCVEKQVYQKFEKMLIDKLNYLVFKDCSDSEYGGILKGYQLTQKFT SFKDIRKQNGFLFYIPAAYTSKIDPTTGFVNLFNFTDLTNAEKKKDFLTNFDDITFDSKTN SFAFTFDYSKFKVFQTDFQKTWTVFTNGKRIVYDRESKKYNTIEPTTIIQEALEKQGVQC VDQLNVLAEIEKIETKNASFFNSICYAFEKSLQMRNSNSETDDDYILSPVKNKNGVFFNS NEADDKLPKDADANGAFHIALKGLYLLQHISETDEKLKIPHEKWFEFVQSRNK |
| 403 | ID403 | 13 | MKDLKQFIGIYPVSKTLRFELKPIGKTLEWIKKNKVLESDEQKAEDYPKVKTLIDEYHKVC ICESLKGVNFDWNPLRLALKEYQSSKSDESKAVLEKEQALMRKQIATVIKDFRHYKELTT PTPQKLIDNVFPSIYESDALKSFNRFAVYFKGFQENRNNIYSSDAISTGVPYRLVHDNFP KFLADIEVFENIKTNCPEVIEQAATELQPFLEGVMIEDIFTIDFYNSLLTQDGIDFFNQVL GGVAEEGKQKYRGINEFSNLYRQQHPEQTAKKKTLTMIPLFKQILSDRDTLSYIPQQIES EQQLIELLNQFYSHITAFDYNGKTVDVLKELTKLTGNINKYNPDGIYLSAKSLTDVSQKLF SKWNVITERLSEEAIKRFGDVSITKNKKKIDAYLSKDAYALSEIPLDNDHSLSMFFAEFPK TIENVGSNWLQFMEWCKGESKQLFLNNADGTEIVKNFLDSIMEILHRCSVLVVSVEHD LDKDFYNDFLPLYAELENAVMVYNRVRNFLTKKPSDTKKFKLNFGVPSLGDGWDQNK ERDNKAIILFKDGKSYLGIMNAKDMPIIKERDESTPSSYKKMIYKLLADPAKDFPHTFFSK KGIDTYHPSRYILDGREQGKYKKGETFDKKFMRDFIDFYKDAVAKHPIWSKFNFVYSPT ESYEDIGAFFNEVSKQAYKIRFSYIEESQINEWTEKGQLYLFQLYNKDYAEGAHGRKNL HTLYWESLFSPENLSNIVLKLNGQAELFYRPQSIKQPFSHKTGSKMLNRRDKSGMPIPE AIYRSLYQYFNGRKAESELTLVEKSYIDQVVVKDVTHEIVKDRRYTKPEFFFHVPITFNVN ADGNEYINEQVMEYLKDNPDVNIIGIDRGERHLIYLTLINQRGEILKQKTFNIVGNYNYH AKLEQREQERDQARKSWQSVGKIKELKEGFLSAVIHEIAMMMIKYNAIVVLEDLNFGF KRGRPFKVERQVYQKFEKMLIDKLNYLSFKDRKPDEAGGILRGYQLTQQFTSFQRLGKQ SGFLFYIPAAYTSKIDPVTGFVNHFNFNDITNAEKRKAFFMKMERIEMRNGDIEFEFDY RKYKTYQTDYQNIWTVNSSGKRIVMRIDENGRKQMTDYFPTKEIVKAFSDKNITLCEG TDLKALMAVIDTSPKNASLYGTLFYAFQKTLQMRNSDSATEEDYILSPVTQNGKQFNT KDEADKGQDSAGNWVSKFPVDADANGAYHIALKGLFLLMNQQTKKIENQKWLQFM VQKPYKS |

TABLE S15A-continued

Enzyme Sequences Group 15

| SEQ ID NO | Ref. | Group | Sequence |
|---|---|---|---|
| 387 | ID404 | 12 | LSLFVAKKGYIKKNTILRSKMAKNTIFSKFTGLYPVSKTLRFELKPIGQTLEKIKENGIIDHD KNKADNYVNAKKIIDEYHKYFISEALKGVKLDWSPLRDAFIDSLTNRTQDSKKKLEDLQK TFRKKIAEKLAAHPHFKELTASTPKELFEKILPNHFGKEESVEAFKRFSTYFKGFQENRKN IYSADAISTGVPYRIVHDNFPKFLSNIETFQNIQKHCPSVLTNAETELKELLNGQKLAEIF NIVFFNSIITQEGIDFFNQIIGGYTIENNKKIRGINEFTNLYRQQNPEFAKQRIATRMIPLY KQILSDRESMSFILEPFKDASQVQSAVKDFFEDHILHYSTDGSQINVLDKISNLITSLNNF EPDKIFIARESLSQISQKFFGSWNSINDAFFEYCEKQFGSAQKAANKKKIDAKLKEDCYSI NEINHVIKQIDPSKQISDYWKELESFKNNIESGDLYKKYEDFISLKFEPDAKLEKDDNIQG LKDFLDAINEFLHYVKPLTANHENGDTAFYNELMPLFDQLSNVIPLYNKTRDFATQKPS DSAKFKLNFENPTLADGWDQNKEDANTSIILKKGENYYLGIMNAKDKPKIDTYKVTPD EPHYDKMVYKLLPGPNKMLPKVFFSAKGKEIYNPSKEIQDGYAAEKHKKGPSFDKRFC HQLIDFFKEGISNHPDWKNFNFNFSETSSYEDISAFYNEVSDQGYKLSFTPIPDSQIDT WIDEGKLFLFQIYNKDFAPGAKGKPNLHTLYWKATFSPDNLQDIVFKLNGEAELFYRPC SIKKPYSHKIGEKMVNRITKDGRPIPDAIFGEIFHYFNNSTKPSLSDDAKKYLDFVIVKDV KHEIIKDKRYTEDKFEFHVPLTINFKADDGSKRLNDQIKDFLKNNPDVNIIGIDRGERNLI YMTLINQKGEILIQKSFNLVGNTNYHEKLSIREQERDAARKSWRSIGKIKELKEGYLSLVI HEIAKTMIENNAIIVLEDLNFGFKRGRFCVEKQVYQKFEKMLIDKLNYLVFKDCSDSECG GILKGFQLTQKFESFQKMGKQNGFLFYVPAAYTSKIDPTTGFVNLFNFTDLTNAEKKKA FLTNFDDITYDSKTSTFALTFDYSKFKVFQTDYQKTWTIFTNGKRIVYDRESKTHNTIEPT TIIQEALEKQGIQCVDQLNVLTEIEKIEPTRENARFFDSICYAFEKTLQLRNSNSETGDDYI LSPVKNKNGIFFNSNEADDKLPKDADANGAFHIALKGLYLLQHISETDEKLKIPHEKWF EFVQSRNK |
| 334 | ID405 | 10 | MARIIDEFCGQMNGYSRSITLRNRLVPIGKTEENLKQFLEKDLERATAYPDIKNLIDAIH RNVIEDTLSKVALNWNEIFNILATYQNEKDKKKAAIKKDLEKLQSGARKKIVEAFKKNP DFEKLFKEGLFKELLPELIKSAPVDEIAVKTKALECFNRFSTYFTGFHDNRKNMYSEEAKS TAISYRIVNENFPKFFANIKLFNYLKEHFPRIIIDTEESLKDYLKGKKLDSVFSIDGFNSVLA QSGIDFYNTVIGGISGEAGTKKTQGLNEKINLARQQLSKEEKNKLRGKMVVLFKQILSD RETSSFIPVGFANKEEVYSTVKEFNNSIAEKAVSKVRDLFLHREEFTLNEIFVPAKSLTDFS QAIFGSWSILSEGLFLLEKDSMKKALSESQEEKINKEIAKKDCSFTELQLAYERYCTEHNL PVEKFCKDYFDIVDYRGNGAKSEKTKVSILSEILETFLQLDFDHIQDLQQEKNAAIPIKAY LDEVQNLYHHLKLVDYRGEEQKDSTFYSKHDEILTDLSQIVPLYNKVRNFVTKKLGESKK IKLNFDCPTLANGWDENQESSNDAIILRKDGKYYLGIYNPNNKPKFAKKDSIVGDCYEK MAYKQIALPMGLGAFVRKCFGTAQKYGWGCPENCLNSEGKIIIKDEEAKGNLEAIIDC YKDFLNKYEKDGFKYKDYNFSFLDSASYEKLSDFFNDVKPQGYKLSFTSIPLSEIDKMIDE GKLFLFQIYNKDFAKKATGKKNLHTLYWENLFSVENLQDVVLKLNGEAELFWREASIKK DKVIVHKKGSILVNRTTTDGKSIPEAIYQEIYQLKNKMADSISDEAKRLLESGTVVCKVAT HDIVKDKHFTENTYLFHCPITMNFKAKDRTNKEFNNHVLEVLNKNPDIKVIGLDRGER HLLYLSLINQKGEIECQKTLNLVEQVRNDKTVSVNYHEKLVHKEGSRDAARKNWQTIG NIKELKEGYLSAVVHEIASLMVKHNAIVVMEDLNFGFKRGRFAVERQIYQKFENMLIEK LNYLVFKDRKVTEPGGVLNAYQLANKSAKVTDVYKQCGWLFYIPAAYTSKIDPRTGFA NLFITKGLTNVEKKKEFFGKFDSIRYDATESCFVFSFDYAKICDNADYKKKWDVYTRGTR LVYNKTERKNVSVNPTEELQCVFDEFGIKWNTGEDLIESISLIPAEKSNAKFFDVLLRMF NATLQMRNSVPNTDTDYLVSPVKAEDGSFFDSREEFKKGGDARLPIDCDANGAYHIAL KGLYLLLNDFNRDNKGVIQNISNKDWFKFVQEKVYKD |
| 335 | ID406 | 10 | MATIENFCGQENGYSRSITLRNKLIPIGKTANNLKQFLEKDQERADVYPEIKKLIDEIHRG FIEDTLSKFSFVWEPLFDDFELYQNEKDKSKKATKKKDLEKFQSGARKKIVEAFKKHPDY DKLFKDGLFKELLPALIKNSSDSEISNKEEALKVFDRFSTYFVGFHENRKNMYSEEDKST AISYRIVNENFPKFYANVKLYNYIKENFPKIISETEESLKNHLNGKRLDEIFNAESFNDVLA QSGIDFYNTVIGGISTETEKVQGLNEKINLARQKLPAEEKNKLRGKMVVLFKQILSDRGT SSFIPVGFNNKEEVYSSVKSFNDEFVNISVCETKELFKQVAEFNLSEIYVPAKSLTNFSQN IFGSWSILTEGLFLLEKDKVKKALSENKEEKINKEIAKKDYSLDELQVAYERYCNEHNFSV EKNCKDYFDVVDYRSENEKSDKKKISILSAITESYSKIDFENIHDLQQEKEAATPIKTYLDE VQNLYHHLKLVDYRGEEQKDSNFYSKLDEIITQLSEIIPLYNKVRNFVTKKPGEMKKIKL NFDCPTLANGWDENKESSNDAIILRKDGKYYLGIFNPNNKPKFSKIENISESYYEKMVYK LLPGPNKMLPKVFFSTKGQETFLPPKDLLLGYDAGKHKKGDAFDKEFMYKLIDWFKDA INRHEDWKKFNFVFSPTKSYEDMSGFYREVELQGYKVSFQKISDTEINSFVSNGKLFLF QIYNKDFALKASGKKNLHTLYWENLFSEENLKDVCLKLNGEAELFWRKPSLNKEKVTV HEKGSILVNRTTNDGKSIPEDIYQEIYQFKNKMKDKISDNISIQNDDGKVITITVTLENKQ KEEKFTENYKVVYKTATHYITKDNRFTEDTYLFHCPITMNFKAPDKSNKEFNNHVLEVLS GNPNVKIIGLDRGERHLIYLSLINQKGEIELQKTLNLVEQVRNDKTVKVNYQEKLVHKED DRDKARKSWQTIGNIKELKEGYLSNVVHEIAKMMVEHNAIVVMEDLNFGFKRGRFAV ERQIYQKFENMLIEKLNYLVFKDKKVTEPGGVLNAYQLTNKSANVSDVYRQCGWLFYI PAAYTSKIDPKTGFANLFITKGLTNVEKKKEFFDKLDSIRYDSKEDCFVFGFDYKICDNA DFKKKWEVYTKGERLVYNKTERKNININPTEELKSIFDDFGINWNNEENFIDSVHTIQA EKSNAKFFDTLLRMFNATLQMRNSIPNTEIDYLISPVKSEDGTFFDSREELKKGENAKLP IDADANGAYHIALKGLYLLENDFNRDNKGVIQNISNADWFKFVQEKEYRD |
| 32 | ID407 | 3 | MKNLKEFHNLYPVQKTLRFKLEPIGKTEEFIERAQILENDERRADEYLKVKEYIDRYHREF IENALSQPLLKVESEGKQDSLEDFADCYNNDNSEKRSDNLEKIQDKLRTQIVKGFSKLPA FARIAKKELIKEDLPKFLKDKNEKEIVSHFDEFTTYFTGFHQNRMMMYTAEAKSTSIAFR LINQNLVKFVDNSNILEKVVPVLGKDIIAQLDKDFEPFLNVDSALDLFKIDNYNEVLTQL |

TABLE S15A-continued

Enzyme Sequences Group 15

| SEQ ID NO | Ref. | Group | Sequence |
|---|---|---|---|
| | | | QIELYNAIIGGRVDEGNKVEIKGLNQYINEFNQTHEKSLRIPKLKPLFKQILSENVGVSFR MEQFTDASQVQTAIKEEYIKLESSVFDKLKEMIKSLPTFNLNGIYLANDLGLTDICQRYY GAWDKLNNALVAEFDAVVPRKKTQSQEKRDNQVKKYLKSVKSISLGKIDSLLADVTEK SIVDYFTNLGAIDNETTQRENLFALIQNRYISLKEVLDCPTPSDELLRKNIEGIKDLLDAIK DLQRFIKPLCGCGEELDKDEMFYSDFSPLYETLDDIITPLYNKVRSYLTKKPYKLDKFKLN FETPTLLQSWPNYQAYSCAIFKEDDNHYYLAILDKNNRSCLNTIVPPISKNDIIGLVKHL QGGDMGKNVQNLMRIDGKTRKVNGRKETSGPNAGQNIRLEESKKTYLPHEINEIRIEK SFSLNSPNYRRECLNKYIDFYKPLVEEYYSEFDFEFKEASEYRDFSQFTNHINQQSYQLKII PFSKKYLKTLVDNGQVFLFRILNKDFSPYSKGRPNLHTIYWKMLFDDNNLKDVIYKLNG KAEMFFRRSSITNPVIHAANKEIANKSAYNKQHKAVSKFDYDIIKDRRFTRNQYEFHVPI TMNFKSAGSVRFNQEVLSFIKEKGIKHIIGIDRGERHLLYLTMINMKGEIVEQFSLNDVA SNPNNPEYKQDYNELLSIKEGDRLSARRNWSTIENIKELKSGYLSQIVHLLSKMMIEND AILVLENLNTGFMRGRQKVEKSVYLKFEKMLIDKLNYVVDKTAAPNEPSGALKALQLT DTYDNFNKYQKGNVRQCGFVFYIPAWNTSKTDPVTGYVNLFDTRLSTIGEIKSFFSKFD RIKYNSKNDAFEFTFDYNNFTTRAEGTRTCWTISSQGERIFTHRSKEQNNQFVSETVHP TQIFKDVFKMAGCEINGNLKEGIASIESLEPLKQLLHAFKLVIQMRNSITGTEVDFLLSPA IDAKGTNFDSRKGISTLPENADANGAYNIARKGLMIVEQIQNADDIANIKYSVSNNDW LKFAQG |
| 401 | ID408 | 13 | MKDLKQFIGIYPVSKTLRFELRPVGKTQEWIEKNRVLENDESKAADYPVVKKLIDEYHK VCIRESMKDVHLDWAPLKEAMEEYQKKSSDDAKKRLEAEQTMMRKRIATAIKDFRHY KELTAATPSDLITSVLPEFSDNEALKSFRGFASYFIGFQENRNNIYSPDAISTGVPYRLVH DNFPKFLSNLEVYDKIKATCPEVIQQASEEIQPFLEGVMIDDIFSLDFYNSLLTQDGIDFF NRVIGGVSEEDKQKYRGINEFSNLYRQQHKELAGSKKALTMIPLFKQILSDRDTLSYIPA QIETENELMTSISQFYKHITYFERDGKTINVLNELVALLSKIDTYNPDGICVTANKLTDISQ KVFGKWSIIEENLKEKAVQQFCDISVAKNKKKVDAYLSRKAYCLSDLCFDDEFHISQYFS DLPQTLNAIEGYWLQPFNEWCKNDEKQFLNNPAGTEVVKSLLDAMMELSHKCSVLV MPEEYEVDKSFYNEFIPLYEELDTLFLLYNKVRNYLTRKPSDVKKFKLNFETPSLADGWD QNKERANKAILLFKDGLSYLGIMNAQNMPNLNQKWSADESHYSKMVYKLIPGPNKM LPKVFFSKKGLDIFNPSRHILRIKEEETFKKGSPNFKLADLHDLIDFYKDGINRHPDWSKF NFQFADTKAYEDIAGFYRDIANQAYKITFSDIPVWQINDWIDNGQLYLFQLYNKDYAE GAHGRKNLHTLYWENLFTDENLSNLVLKLNGQAELFCRPQSIKKPVSHKMGSKMLNR RDKSGMPIPESIYRSLYQFYNGKKKESELTAAEKQYMDQVIVKDVTHEIIKDRRYTRQE YFFHVPLTFNANAEGNEYINENVLNYLKDNPDVNIIGIDRGERHLIYLTLINQRGEILMQ KTFNVVNSYNYQAKLEQREKERDEARKSWDSVGKIKDLKEGFLSAVIHEICKMMIENN AIVVLEDLNFGFKRGRFKVERQVYQKFEKMLIDKLNYLSFKDREAEEDGGILRGYQMA QKFVSFQRLGKQSGFLFYIPAAYTSKIDPITGFVNHFNFNDITNAEKRKEFLMKMERIE MRNGNIEFEFDYRKFKTFQTDYQNLWTVSTYGKRIVMRIDDKGYKQMVDYEPTKDIV NTFKNKGIQLTEGSDLKALIADIEANATNAGFFNTLLYAFQKTLQMRNSNAATEEDFIF SPVARDGRYFCSMDEANKGRDAQGNWVSKLPIDADANGAYHIALKGLYLLRNPETKK IENEKWLQFMVEKPYLE |
| 399 | ID409 | 13 | MKDLKQFIGLYPVSKTLRFELRPVGRTQEWMEKNHVLEHDGKRAEDYPRVKELIDAY HKICISNSLKVSDINWTPLRDAIEKNRQEKSDESKKALEEEQTKMRLEICKKLAKFEHYQ ELVKADTPSKLINGILPHDKALDTFNKFAVYFEGFQENRRNIYSSEAISTGVAYRLVHDN FPKFLANIEVFENIKEICPEVIQQVATEMAPFLEGVMIEDVFTVSYYNAVLTQNGIDYYN QILGGVAKDDQKYRGINEFINLYRQAHPELATKKKSLTMVPLFKQILSDRETLSDIVRPV ESEKQLIEVINNFYQRITNFDINGKNVNVVKELTDLVLSIDTYNPEGIFISAKSITDVHSL YDHWNRINEKLYDKAVEAIGGVQTVKNKKKVEAYLKKDAYTLSELSFGDDVSISQYFSA LTNSTDSINSLWLQFQSWCKSAEKPQFVHNEVGTEYVKMLLDAIMLVLHKCGALLVSL ENELDSDFYNKFLPLYAELENVILVYTRVRNFLTKKLSDTGKIKLKFDTPSLGAGWGINKE KTNKAVLLFKDGLSYLGIMNVKGTLDFNCKIEADEPTFKKMVCRNYSKPYMDLPNSFF SQNGISKFHPSERIQKIYFAFKENSKNVDIKKVHELIDYYKDAISRHEDWGSFGFKYSPTE SYETINDFYTEVAAQSYKLRFIEVPQKQVDEWVEEGKLYLFQLYNKDYAEGAHGRKNL HTMYWECLFSEENLSNLFIKLGGQAELFYRPQSIKKPVSHKVGTKMLNRRAKDGKPIP DAIYRSLYQYFNGKKAEAELTTEEKAYISQVIVKDVHHEIIKDRRYTKQFFYQFHVPIVFN ANAPQRPKINERVLEYIKENPDVNIIGIDRGERHLVYLTLINQRGEILKQKTFNVVGDYN YQEKLKQRENERDQARKSWQSVGKIKDLKEGFLSAVVHEIAKMMIENNAIVVLEDLN WGFKRGRFKVERQVYQKFEKMLIDKLNYLSFKDVDTSDEGGILRGYQLTEPVANYTDI GKQTGFLFYIPAAYTSKIDPATGFVNHFNFNDITNAEKRKEFFMKMERIEMKNGNVEF EFDYRKFKTYQTDFQNVWTVNTSGKRIVFDTEKREHKAVYPTQEFVQAFGNKGITLEE GMDIKAFIGGIEADIKNASFFSSLFYAFKTTLQMRNSNADTREDYILSPVVHDGRQFCS TDEVNKGKDADGNWISKLPVDADANGAYHIALKGLYLLMNPQTKKIENEKWLQFMA EKPYKE |
| 331 | ID411 | 10 | LLFIIEFEEKIMKTIENFCGQKNGYSRSITLRNRLIPIGKTEENIEKLQLLDNDIKRSKAYVE VKSMIDDFHRAFIEEVLSKAKLEWGPLYDLFDLFQNEKDKHKKSKIKKELETIQGVMRK QIVKKFKDDDRFDKLFKKEILTEFVPTVIKADESGTISDKRAALDVFKGFATYFTGFHQN RQNMYSEEAKATAISNRIVNENFPKFYANVKVFECLQKEYPAIITETEEALSEILNGKKLA DIFSADGFNSVLSQSGIDFYNTIIGGIAGEEAGTQKLQGINEKINLARQQLPTEEKNKLKR KMSVLYKQILSDRSTASFIPIGFESSSDEVYESVKQFKEQSLDNVISAAKELFEKSDYDLSQI YVPAKEVTDFSLKLFGNWSILHDGLFLIEKDNSKKTFTEKQIENLRKEIAKTDCSLADLQN AYERWAKENDVKAEKTVKNYFKIAELRADGKSREKTSVEILNKIESTFEKIDFEKRDNLIK EKETATPIKEFLDEVQNLYHYLKLVDYRGEEQKDTDFYSKYDEILQTLSEIVPLYNKVRNF |

TABLE S15A-continued

Enzyme Sequences Group 15

| SEQ ID NO | Ref. | Group | Sequence |
|---|---|---|---|
| | | | VTKKPNEVKKVKLNFDNVSLAKGWDVNKESDYTCILLRRSGLYYLGVLNPKDKPKFDSE<br>NNGETSINKNDCYEKLVYKYFKDVTTMIPKCSTQLNDVKQHFKNSNEDYILENNNFIKP<br>LVISKRIFDLNNKTFDEKKMFQIDYYRNTGDLKGYTEAVKDWISFCMTFVHSYKSTCIY<br>DFSSLGDCSQFKQVDQFYKEINLLLYKIWFVNVTAEKINSLVDSGKLFLFQIYNKDYSTG<br>KDGGNGSTGKKNLHTMYWENLFSEENLRDVCLKLNGDAELFWRDANPDVKDVCHK<br>KGSVLVNRTTSDGETIPEEIYQEIYKFKNPNKQEKSFKLSDTAKELLDSGKVGFKEAKFDII<br>KDRHFTQKTYLFHCPITMNFKAPEITGRKFNEKVQQVLKNNPDVKVIGLDRGERHLIYL<br>SLINQKGEIELQKTLNLVEQVRNDKTVSVNYQEKLVQKEGERGKARKNWQTISNIKELK<br>EGYLSNIVHEIAKLMVENNAIVVMEDLNFGFKRGRFAVERQVYQKFENMLIEKLNYLV<br>FKDKKVAEPGGVLNAYQLTDKVANVSDVGKQCGWIFYIPAAYTSKIDPKTGFANLFYT<br>AGLTNIEKKKDFFDKFDSIRYDRKTDSFVFTFDYSDFGDNADFKKKWELYSRGERLVFS<br>KAEKSVVHVNPTENLKALFDKQGINWSSEDNIIDQIQAVQAERENCAFYDGLYRSFTAI<br>LQMRNSVPNSSKGEDDYLISPVMAEDGSFYDSREEAEKGKTTDGKWISKLPVDADAN<br>GAYHIALKGLYLLQNNFNLNENGYIENISNADWFKFVQEKEYAK |
| 440 | ID412 | 13 | LFNLYSCLTEYILMQITIFTNKNKRNKNNMENSNLFTNKYQVSKTLRFRLEPTGGTDDLL<br>RQAQIIEGDERRNKEAITMKQILDNCHKQIIERVLSDFNFKEHSLEEFFKVYTRNDDDRE<br>KDIENLQSKMRKEIADAFTKQDVTKLFSSKFKDFVERGLIKYASNEKERNIVSRFKGFAT<br>YFTGFNTNRLNMYSEEAKSTAISFRLINQNLIKFIDNILVYKKVSQTLPSDMLSNIYIDFK<br>AIINTSSLEEFFSINNYNNILTQKQIEIFNAVIGGKKDKDEKIITKGFNQYINEYNQTNKNI<br>RLPKMMRLFNQILSDREGVSARPEPFNNANETISSVRDCFTNEISKQITILSETTSKIESF<br>DIDRIYIKGGEDLRALSNSIYGYFNYIHDRIADKWKHNNPQGKKSPESYQKNLNAYLKGI<br>KSVSLHSIANICGDNKVIEYFRNLGAENTVDFQRENVVSLIDNKYNCASNLLSDAQITDE<br>ELRTNSRSIKDLLDAVKSAQRFFRLLCGSGNEPDKDHSFYDEYTPAFEALENSINPLYNK<br>VRSFVTKKDFSTDKFKLNFDSSSFLSGWATKSEYEKSSAFIFIRDNQYYLGINRCLSKEDI<br>AYLEDSTSSSDAKRAVYLFQKVDAKNIPRIFIRSKGSNLAPAVNEFQLPIETILDIYDNKFF<br>TTSYQKKDRTKWKESLTKLIDYYKLGFSQHKSYADFDLKWKASSEYNDINDFLADVQKS<br>CYRIEFININWDKLIEFTEDGKFYLFRIANKDLSGNSTGLPNLHTIYWKMLFDESNLKDIV<br>YKMSGNAEVFMRYNSLKNPIVHKAGVEIKNKCPFTEKKTSIFDYDIIKDRRYTKDQLELH<br>VPILMNFKSPSAAKGNVFNKECLEYIKNNGIKHIIGIDRGERNLLYMVITDLDGNIVEQK<br>SLNQIASNPKLPLFRQDYNKLLKTKADANAQARRDWETINTVKEIKFGFLSQIVHEIAM<br>SIIKYDAIVVLENLNRGFMQKRGLENNVYQKFEQMLLDKLSYYVDKTKHPEEAGGALH<br>AYQLSDTYANFNSLSKNAMVRQSGFVFYIPAWLTSKIDPVTGFASFLKFHRDDSMATI<br>KSTISKFDCFKYDKECDMFHIRIDYNKFSTSCSGGQRKWDLFTFGDRILAERNTMQNS<br>RYVYQTVNLTSEFKNLFATKDIDFSGNLKDSICKIEDVGFFRKLSQLLSLTLQLRNSNAET<br>GEDFLISPVADKDGNFFDSRNCPDSLPKDADANGAYNIARKGLMLVEQLKRCKDVSKF<br>KPAIKNEDWLDYVQR |
| 118 | ID413 | 8 | MNSIEQFTGLYSLSKTLRFELKPIGKTQENIEKNGILERDNERAVAYKSVKKYIDEYHKAF<br>IERVMNSFPHNLSDEEQDIWEEALNNYYTSYHLPATNPQRKETLTEAQDTLRTLISNSF<br>LRDRQYKRLFGKELFQEDLAEFVNTALFETYIRSQKGNNNLTEEEVRQIQENTIREISLFR<br>NFTVYFSGYNENRKNMYVADDKATSIANRMITENLPKFVDNMEVFGKIAASEVANHF<br>ETLYKSMEAYLNVISIDEMFKLDYYPILLTQKQIDVYNTIIGGKVLEDGSKIQGLNEYVNL<br>YNQQQKDKANRLPKLKPLFKQILSEHNAISWLPDTFSTDNEMLESIEKCYQNLRTQVFE<br>GEISLKKLLDNLGDYDLEHIYIPNDLQLTNIVQKVYGDWSMVKKAMEEDVKAKNPQR<br>KNETGEKYEERIVKILKSDESFSIAQINNLLKPYLGEKYVPLEKYFITKGAEDNNNVQKPN<br>LFIRIENAYIEAKSLLNTQYPKDRTMSQDKQNVERIKILLDAIKDLQHFVKPLLGKGSEG<br>QKDNTFYGEFIPLWEALDQITPLYNMVRNRMTQKPYSDDKIKLFFENNGSFLNGWVD<br>SKTESDNATQYGGYLFRRKNSIGEYDYYLGISSATKLFRSFNHVSESDKSIFERLDYYQLK<br>GKTFYGALYKGDYEKESSAIKLAIDKFITNNGNTIIREKINTEKRKRQPKVSTAIGYLKFLR<br>QQGVELFDSLLKDGCFEESNQAMITSIKATLASMARIPNAQDYAHKDYSLFSDAMDD<br>VEELLQDVIFSYFPISQKEMDKVLEREEKPMYLFKITNKDLSFAETHEKGLRKSRGTDNL<br>HTMYFKALMSGTQNVFDIGSGTVFFRERKIVYSEEQLGKGHHHEMLKDKFDYPIISNK<br>RYAYDKFQFHLSININYKADHKHKDINLLVNEYLKESKVTHIIGIDRGERHLLYLSVIDLQG<br>NIVEQYSLNEIVNEYNDCNYRTNYHDLLDIREKQRDEARRSWLTIESIKELKEGYMSQV<br>VHLIAQLIVKYNAIVVLEDLNTGFIRGRQKVEKQVYQKFEKMLIDKLNYLVDKKKDIYDL<br>GGALNALQLTNKFESFQKIGKQCGFLFYVPAWNTSKMDPTTGFVNMLDTRYENMDK<br>AKAFFAKFRSIRQNVSKGWFEFAIDYNDFTSKAAGTKTQWTLCTYGTRIETKRDTKQN<br>NNFVSDEFDLTDKFKVLFNKYNIDVNGNLMEQICSQNDATFFKELLHMLHLTLQMRN<br>SITGTEVDYLISPVMNASGKFYDSRTCENNLPKNADANGAYNIARKGLWIVEQIKHSD<br>NISKLKIAISNKEWLRYTQGLVD |
| 58 | ID414 | 5 | MKEQFINCYPLSKTLRFSLIPVGKTEDNFNKKLLLESDKQRAENYENVKSYIDRFHKEYIK<br>SALANARIEKINEYAALYWKNNKDDSDAKAMESLEDDIRKQISKQLTSTANFKRLFGKE<br>LICEDLPAFLTDENEKETVECFRSFTTYFNGFNTNRKNMYSSEKKSTAIAYRCVNDNLPR<br>FLDNIKTFQKIFDNLSDETITKLNTDLYNIFGRKIEDIFSVDYFDFVLTQSGIDIYNYMIGG<br>YTCSDGTKIQGLNECINLYNQQVAKNEKSKRLPLMKPLRKQILSEKDSVSFIPEKFNSDN<br>EVLLAIEEYYNNHISDIDSLTELLQSLNTYNANGIFIKSGAAVSDISNAAFNSWNVLRLA<br>WNEKYEALHPVTSTTKIDKYIEKRDKVYKSIKSFSLFELQELGAENGNEITDWYISSINEC<br>NRKIKETYLQARELLESDYEKDYDKRLYKNEKATELVKNLLDAIKEFQQLVKLINGTGKE<br>ENKDELFYGKFTSLYDSVADIDRLYDKVRNYITQRPYSKDKIKLNFDNPQLLGGWDKNK<br>ESDYRTVILRKNDFYYLAVMDKSHSKVFVNAPEITSEDEDYYEKMEYKLLPGPNKMLPK<br>VFFASRNIDKFQPSDRILDIRKRESFKKGATFNKSECHEFIDYFKESIKKHDDWSKFGFEF<br>SPTESYNDISEFYREVSDQGYYISFSKISKNYIDKLVENGYLYLFKIYNKDFSKYSKGTPNL |

TABLE S15A-continued

Enzyme Sequences Group 15

| SEQ ID NO | Ref. | Group | Sequence |
|---|---|---|---|
| | | | HTLYFKMLFDERNLSNVVYKLNGEAEMFYREASINDKEKITHHANQPIKNKNPDNEKK<br>ESVFEYDIVKDKRFTKRQFSLHVSVTINFKAHGQEFLNYDVRKAVKYKDDNYVIGIDRG<br>ERNLIYISVINSNGEIVEQMSLNEIIGDNGYSVDYQKLLDKKEKERDKARKNWTSVENIK<br>ELKEGYISQVVHKICELVVKYDAVIAMEDLNFGFKRGRFPVEKQVYQKFENMLISKLNL<br>LIDKKAEPTETGGLLRAYQLTNKFDGVNKAKQNGIIFYVPAWDTSKIDPVTGFVNLLKP<br>KYTSVREAKKLFETIDDIKYNTNTDMFEFCIDYGKFPRCNSDFKKTWTVCTNSSRILSFR<br>NEKKNNEWDNKQIVLTDEFKSLFNEFGIDYTSDLKASILSISNADFYNRLIRLLSLTLQMR<br>NSIIGSTLPEDDYLISPVANDRGEFYDSRNYKGSNAALPCDADANGAYNIARKALWAIN<br>VLKDTPDDMLQKAKLSITNAEWLEYTQR |
| 20 | ID415 | 2 | MEMRLMVVFEDFTKQYQVSKTLRFELIPQGKTLENMERAGIVKGDCQRSEDYQEAKK<br>IIDKIYKHILNSSMAKVEIDWSTLAEATKEFRKNKDKKKYENVQVRVRKKLLEDIKNQTIT<br>VEKGAKDLYKAMFEKEIVTGEVCAAFPEIDLTDEEKAILDKFKKFTTYFTGFFENRKNIFT<br>DEGISTSFTYRLVNDNFIKFYDNCNLYKDIIASVPGLKGEFKKCFKDLQLFSKCRLEEIFET<br>SFYNHILTQDGIDEFNQLLGGISAKEGEKKKQGLNEVINLAMQKDEGIRNKLRYRAHKF<br>TPLFKQILNDRSTLSFIPETFENDRKVLESIEAYKLYLSEQNILEKAQELLCSMNRYDSRKL<br>SIDGKYISKLSQAIFNSWSKIHDGIKDYKKSLLPKETKKALKGIDMELKQGVSVQDILDAL<br>PEEENFHEVIVDYTHNLVQKCQAVLSGSLPGNIETDKDKTDIKLVMDPLLDLYRFLEIFSH<br>DNSQGVKTAFEEQLMEILADMKEIIPLYNKVRNFATKKAYSVEKFKLNFNVATLASGW<br>DQNKENANCAIILRKKDMYYLGIYNSSNQPFFEIVEQDDDGFEKMIYKQFPDFNKMLP<br>KCTVSRKNDVAVHFNKSDADFLLNVNTFSKPLLITKEVYDLGTKTVQGKKKFQIDYKRN<br>TGDEAGYKAALKAWIDFGKEFIKAYESTAIYDISLLRKSEDYPDIQSFYKDVDNICYKIAF<br>QKISDEAVNQCVENGSLYLFKLHAKDFSPGASGKPNLHTLYWKYVFEEENLKDVVVKL<br>NGQAELFYRPRSLTQPVVHKKGEKILNKTTRSGEPVPDDVYVELSHFIKNGSTGNLSNE<br>AKKWQAKVSVRNVPHEITKDRRFTQDKFFFHVPLTLNYKSANTPRRFNDLVKAYIKKN<br>PDVHVIGIDRGERNLIYAVVIDGKGKIVEQRSFNIVGGYNYQEKLWQKENERQAARRD<br>WTAVTTIKDLKQGYLSAVVHELSKMIVKYKAIVVLENLNAGFKRMRGGIAERSVYQQF<br>EKALIDKLNYLVFKDAVPAVPGGVLNAYQLTDKFDSFSKMNQQTGFLFYVPAAYTSKI<br>DPLTGFVDCFNWKQIKKNTESRKAFIGLFESLCYDANTNNFVLHYRHKANRYVRGGNL<br>DITEWDILIQENKEVVSKTGKSYRQGKRIIYRKGSGNHGEASPYYPHEELQSLLEEHGISY<br>KAGKNILPKIKAANDNALVEKLHYIIKAVLQLRSNSETGEDYISSPVEGRKDWCFDSRA<br>ADDALPQDADANGAFHIAMKGLLLMKRIRNDEKLAISNEDWLNYIQGLRS |
| 442 | ID416 | 14 | MNIYENFTNMYQVNKTIRMGLKPICKTDENIAKFLEEDKERSEKYKIAKKIIDKENRAFIE<br>DRLKDFSISGLDEYLELLKQKKDITKIQKKMRDEISKQLKGFPQFDSKYKFQYITDKEDTEI<br>LEYFKKFTTFFTGFNSNRENVYSKEDISTSIGHRIIHENLPKFISNFRILNKAIEALGTGKIN<br>EDFKNNEINVTVEELNKIDYFNKVLTQSGIDLYNNLIGILNQNINLYNQQQKVKKNIGK<br>LETLHKQILSEKDKVSFIEEFAEDNQLLKCIDEYFKEKSCLINVDLKNLLENIDTYSLNGIFI<br>KNDKSLKNISIYLYKDWGYISNLINEEYDYKHKNKVKDDKYYEKRKKAIDKIKYFSIGYIDE<br>LLKDKNVPMVECYFKEKINLVVKEFNASLNKFNEYKFTNELKTDEIAVEIIKNLCDSIKKI<br>QGIIKPLIITGNDKDDDFYVEINYIWDELNKFDKIYNMVRNYLTKKDYIEEKIRMMFSKS<br>SFMDGWGKDYGTKEAHIVYHDKNYYLVIVDEKLKLEDIDKLYKPGGDTVHYIYNYQSID<br>YRNIPRKFIYSKGNRFAPSVERYNLPIEDVIEVYNNKYYRTEYEEKNPKIYKKSLTSLIDYFK<br>IGVNRDMDFEKFDIKLKDSNEYKNINEFYYNLETCCYKLQEEKVNFSVLEEFSYSGKIYLF<br>KIYNKDFSKYSKGTPNLHTLYFKMLFDKENLENPIYKLSGNAEMFFRKGNLDLDKTTIH<br>HANQPINNKNPNNRKRQSVFKYDIIKNRRYTVDKFALHMSITTNPQVYKNKNVNETV<br>NRALKYCDDIYAIGIDRGERNLLYACVVNSRGEIVKQVPLNFVGNTDYHQLLAKREEER<br>MNSRKNWKIIDNIKNLKEGYLSQAIHIITDFMVEYNAVLVLEDLNFRFKEKRMKFEKSV<br>YQKFEKMLIDKLNFLVDKKLDKNANGGLFNAYQLTEKFTSFKDMKNQNGIVFYIPAW<br>MTSKIDPVTGFTNLFYIKYESIEKAKEFFGKFKSIKFNKVDNYFEFEFDYNDFTDRAQGT<br>RSKWTVCSFGPRIEGFRNPEKNNNWDGREIDITEEIKKLLDDYKVSLDEDIKAQIMDIN<br>TKDFFEKLIKYFKLVLQMRNSKTGTDIDYIISPVRNKQNEFFDSRKKNEKLPMDADANG<br>AYNIARKGLMFIDIIKETEDKDLKMPKLFIKNKDWLNYVQKSDL |
| 336 | ID417 | 10 | MTTINKFCGQGNGYSRAITLRNKLIPIEKTADNLKQFLEKDQERADSYPEIKKLIDEVHR<br>GFIEDTLTKFSFVWEPLFDDFELYQNEKDKSKKAAKKKDLEKFQSGARKKIVEAFKKHP<br>DYDKLFKDGLFKELLPALIKNSSDSEISNKEEALKVFDRFSTYFVGFHENRKNMYSEEEKF<br>TAISYRIVNENFPKFYANVKLYNYLKENFPQIISETEESLKNHLNEKKLDEIFNVESFNDVL<br>AQSGIDFYNTVIGGISTETEKVQGLNEKINLARQKLPAEEKNKLRGKMVVLFKQILSDR<br>GTSSFILVDFNNKEEVYSSVKSFNDEFVNLSVCETKELFKQVAEFNLSEIYVPAKSLTNFS<br>QNIFGSWSILTEGLFLLEKDKMKKALSENQEEKINKEIAKKDYSLDELQVAYERYCNEHN<br>FSVEKNCKDYFDVVDYRSENEKSDKKKVSILSAITESYSKIDFENIHDLQQEKEAATPIKT<br>YLDEVQNLYHHLKLVDYRGEEQKDSNFYSKLDEIITQLSEIIPLYNKVRNFVTKKPGEMK<br>KIKMMFDCSSLLGGWGTDYGTKEAHIFIDSGKYYLGIINEKLSKDDVELLKKSSERMVT<br>KVIYDFPQKPDNKNTPRLFIRSKGTNYAPAVSQYNLPIESIIDIYDRGLFKTEYRKINPEVYK<br>ESLIKMIDYFKLGFERHESYKHYPFCWKESSKYNDIGEFYKDVINSCYQLHFEKVNYDNL<br>LKLVENNKIFLFQIYNKDFAEKKSGKKNLHTLYWENLFSEENLKDVCLKLNGEAELFWR<br>KPSLNKEKVTVHKKGSILVNRTTNDGKSIPEDIYQEIYQFKNKMIDNLSENAKSLLDSGV<br>VVCKEATHNITKDNRFTEDTYLFHCPITMNFKAPDKSNKEFNNQVLEVLSDNPDVKIIG<br>LDRGERHLIYLSLINQKGEIELQKTLNLVDQVRNDKTVKVNYQEKLVHKEGDRDKARK<br>NWQTIGNIKELKEGYLSNVVHEIAKMMVEHNAIVVMEDLNFGFKRGRFAVERQIYQK<br>FENMLIEKLNYLVFKDKKVTEPGGVLNAYQLTNKSANVSDVYRQCGWLFYIPAAYTSKI<br>DPKTGFANLFITKGLTNVEKKKEFFDKFDSIRYDSKEDCFVFGFDYGKICDNADFKKKW<br>EVYTKGERLVYNKTERKNISINPTEELKSIFDDFGINWNNEDNFIDSVHTIQAEKSNAKF |

TABLE S15A-continued

Enzyme Sequences Group 15

| SEQ ID NO | Ref. | Group | Sequence |
|---|---|---|---|
| | | | FDTLLRMFNATLQMRNSIPNTEIDYLISPVKSEDGTFFDSREELKKGENAKLPIDADAN<br>GAYHIALKGLYLLENDFNRNDKGVIQNISNADWFKFVQGKEYEK |
| 564 | ID418 | N/A | MKAELFKTFVDEYPVSKTLRFSLIPVGRTLENIEKDGILDCDEKRSEEYKRVKKLLDEYYK<br>TFIEHALTNVELDINSLEEYERLYNIKNKSDKEKADFDSVQKNLRKQIVKALKEDEKYKFL<br>FKKEIIEKELVDFLNGRDSDVELVKSFKGYATMFQGFWDARKNIFSDEEKSTAIAYRIIN<br>ENLPKFISNKNIYFTKIQPEMDAELDQLTLSNNSNEIRDIFKLEYFSKTITQTGIEIYNGILG<br>GYTIDEQVKLQGINEIVLNHQKNKDSGKIPKLKMLYKQILSDTNTLSFIAEGFETDDEV<br>LESLNIFYDVFNENILDEDLGIINLLRNIDKFSYDGIYIKNDKALIDISNYLFGDWHYIKNAI<br>NKKYEIDNPGKNTEKYIVKRNKFIKSFDSFSLKYLQDCTGSKFNEHILIKINNLIDDVKKAY<br>NSVALLIKNKYEGTNLINDKDAIEKIKQFLDSMKSLVSFIRCFEGTGQEPDRDEIFYGEFD<br>TGKKTFYYLNNIYNKTRNYVTKKPYSIEKYKLNFDNAELLTGWDLNKETSKASIILKKDNL<br>YYLGIMKKSDRRVFLNVPETESTYNCYEKMEYKLLPGPNKMLPKVFFAKSNIDYYDPSP<br>EIMRIYKEGTFKKGDNFNIDDCHDLIDYFKESLDKNDDWKIFDFDFSETSSYKDIGEFYK<br>EVQQQGYKISFKNIASSYVDELVENGKLYLFQIYNKDFSKNSKGTENLHTMYWRALFD<br>EENLENVIYKLNGDAEIFFRRKSISENEKIVHPAHVEIENKNDETRKEKKTSIFNYDIIKDK<br>RFTVDKFQFHVPITLNFQAIDRKSDINLRMRQEIKKNKDMHIIGIDRGERNLLYISIIDLD<br>GNIVKQESLNTITNEYDGKIYTTDYHKLLDKKEEKRKVARQTWNTIENIKELKAGYMSQ<br>VVHKITQLMMEYNAIVVLEDLNTGFKRGRQKVEKQIYQAFEKALINKLNYYVDKKVDK<br>NEISGLYKPLQLTKEFESFKKLGKQSGAIFYVPAWNTSKMDPTTGFVNLLSVKYENMEK<br>SKEFINKIKDINFKEDDCGKYYEFHIDFNEFTDKGKDTKTDWNICSFGKRIDNARNQKG<br>DFESKMIDLTNEFHNLFKKYGINDNSNLKEDILNVKEAKFYKEFINLFKLMLQIRNSESN<br>EKVDFLQSPVKNNKGEFFNSNNVNGNEAPENADANGAYNIARKGLWIVNQIKTMPD<br>SQMHKIKLAMKNQEWLLFAQKGNV |
| 445 | ID419 | 14 | MPNISEFSEHFQKTLTLRNELVPVGKTLENIISSNVLINDEKRSEDYKKAKEIIDSYHQEFI<br>EKSLSSVTVDWNDLFSFLSRKEPEDYEEKQKFLEELESIQLEKRKSIVNQFEQYDFGSYTD<br>LKGKKTKELSFESLFKSELFDFLLPNFIKNNEDKKIISSFNKFTSYFTGFYENRKNLYTSAPL<br>PTAVAYRIVNDNFPKFISNQKIFRVWKDNVPKFVEIAKTKLREKGISDLNLEFQPELSNF<br>NSCLNQTGIDSYNELIGQLNFAINLECQQDKNLSELLRKKRSLKMIPLYKQILSDKDSSFC<br>IDEFENDESAINDVISFYKKAVCENGPQRKLSELLRDLSSHDLDKIFIQGKNLNSISKNLF<br>GGKNWSLLRDAIIAEKSKDKSYKKAIKTNPSSDDLDRILSKDEFSISYLSKVCGKDLCEEID<br>KFIKNQDELLIKINSQAWPSSLKNSDEKNLIKSPLDFLLNFYRFAQAFSSNNTDKDMSLY<br>ADYDVSLSLLVSVIGLYNKVRNYATKKPYSLEKIKLNFENPNLATGWSENKENDCLSVIL<br>LKNQIYYLGILNKSNKPNFSNGISQQPSSESCYKKMRYLLFKGFNKMLPKCAFTGEVKE<br>HFKESSEDYHLYNKDTFVYPLVINKEIFDLACSTEKVKKFQKAYEKVNYAEYRQSLIKWIS<br>FGLEFLSAYKTTSQFDLSNLRKPEEYSDLKEFYEDVDNLTYKIELVDLKEEYVDSLVENGQ<br>LFLFEIRNKDFAKKSSGTPNLHTLYFKSIFDPRNLKNCIVKLNGEAEIFYRKKSLKIDDITVH<br>QKGSCLVNKVFFNPDSGKSEQIPDKIYNNIYAYVNGKSTTLSKEDEFFYTKATIKKATHEI<br>VKDKRFTVDKFFFHCPITINYKSKDKPTKFNDRVLDFLRKNEDINIIGIDRGERNLIYATVI<br>NQKGEIIDCRSFNTIKHQSSSVNYDVDYHNKLQERENNRKEEKRSWNSISKIADLKEGY<br>LSAVIHEIALMMVKYNAIVVMENLNQGFKRIRGGIAERSVYQKFEKMLIDKLNYFVIKN<br>ENWTNPGGVLNGYQLTNKVSTIKEIGNQCGFLFYVPAAYTSKIDPSTGFVNLLNFNKY<br>NNSDKRRELICKFYEICYVQNENLFKFSIDYKLCPDSKIPVKKWDIFSYGKRIVKEDLKT<br>GYMKENPEYDPTEELKNLFTLMRVEYKKGENILETISIRDMSREFWNSLFKIFKAILQM<br>RNSLTNSPVDRLLSPVKGKDATFFDTDKVDGTKFEKLKDADANGAYNIALKGLLILKNN<br>DSVKTDKELKNVKKVSLEDWLKFVQISLRG |
| 446 | ID420 | 14 | MKRLIDFTNIYQRSKTLRFRLEPIGKTADYIKVSQYLETDERLAKESKKVKELADEYHKEFI<br>GDVLSSLELPLSKINELWDIYMSNDTDREIKFKKLQENLRKVIAEAFSKDKRFGSLFKKEII<br>TDILPKFLQDKDDDIKIVNRFKGFTTYFAFHKNRENMYVSEEKSTAIPYRIVNQNLVKY<br>FDNYKTFKEKVMPLLKDKNIVESIERDFKDILNEKSIEDVFGLANFTHTLCQADIEKYNTL<br>IGGLVVKNEKKEIKGINQYINEHNQTSKKGNGIPKLKPLFNQILSDRKSLSFTLDDIKKTS<br>EAIRTIKDEYENLRDKLATIERLIKSIKEYDLAGIYIKMGEDTSTISQHWFGAYYKIIEAIAD<br>AWERRNPKKNRESKAYSKYLSSLKSISLQEIDDLKIGEPIENYFATFGTTCSDRTSGVSSL<br>NRIEAAYTEFVNKFPEGFEDGDDCNDAYFKANVEVVKNLLDSIKDFQRFVKPLLGNED<br>ERDKDEAFYGEFVPTYTDMDNIITPLYNRVRNFATKKPYSTDKIKINFEKSTLLTGWANY<br>KQYGGVLFCKNDSDFYLGIVKSSKTEIHTVDDSASDIYRIDYALIPNPGKTIPCLMFRDEV<br>KAEKVNGRKDKRTGENLRLEEEKDKYLPAEINRIRKSRSYLKSSECYCNQDMVAYIDYYK<br>KCCISYYDKLSFTFKDSSMYSDWNDFIADVDGQGYQLNRIPVSMQELENLVDNGNML<br>LFRIANKDFSPNSKGRPNLHTIYWRMLFDPANLKDVVYQLNGNAEIFFRKASITRTEPT<br>HPANVAIKNKSEYNKQNKPYSTFKYGLIKDRRYTTDQFEFHVPITMNFKQPESSKLQDK<br>LNKQVLDFLKQDGVRHIIGIDRGERNLLYLVMVDMEGKIKKQISLNEIAGNPKNSEFKQ<br>DFHALLREREGDRLESRRSWNTIQSIKDLKEGYMSLVVHEIANMMLENDAIVVLENLN<br>RSFMQKLGGREKSVYQKFEKMLIDKLGYIVDKTKDVSDNGGALHAVQLADTFENFNK<br>TQKGAIRQCGFIFYIPAWRTSKIDPVTGFVPMLRCQYESIVASKDFFGKFDSIYYDATGK<br>YFVFQTDFTKFNTESKGGIQKWDICTYGDRIYTPRTKDRNNSPVSERVNLTEAMKSLFV<br>LHNINIQGDIKAGIMQQTDKAFFESLHRLRLTLQIRNSKKSTGENYEDYIISPVMGKDG<br>RFFDSRNADATQPKDADANGAYNIARKGLMLRQIQAQEKQDLSNGKWLEFAQR<br>MNDLSQFTNLYSLSKTLRFELKPIGKTLENIEKNGILERDNRRSIGYKSIKKVIDEYHKAFI |
| 119 | ID421 | 8 | DRVLNDYERKLDETGRIVWRDSLNELYRLYHLSSTEAKRNEEIRKTQEILRKQISECFKKD<br>RQYSRLFGKELIREDLTEFVNTPLFEQYILSQKGNEDLSIDDVRHIQEDVIEDIAQFRDFT<br>TYFSGFYENRRNMYVADDKATSIANRLIMENLPKFIDNIDVFERIAQSEVSGNLETLCKE |

TABLE S15A-continued

Enzyme Sequences Group 15

| SEQ ID NO | Ref. | Group | Sequence |
|---|---|---|---|
| | | | MEAYLNVNSIAEIFCLDYFSMVLTQKQIDVYNAIIGGMSLEDGTKIKGLNVYVNLYNKK QKEKTCRLPKLKPLFKQILSERNAISWLPDEFTSDKELLESIEKCYQDLKNSVFEGKDSLM VLLKELGEYDLEHIYLHNDSQLTNIAQKQYGDWATIKRAFEESVKAATPAKRNETTEKY AARIEKILKATDSLSLSQINRMLKAYMGDDFKTIESYFTAMGAEDTVDGQKPNLFIRIEN AYADVQPLLNTPYPEDKKLSQDKANVAKIKNLLDTIKDLLHFVKPLLGNGTKGEKDNRF YGEFIPLWELLDQITPLYNMVRNRLTKKECSDEKIKLFFENNNGRFLSGWTDNQTESD NGTQYGGYLFRKRNGIGEYDYYLGVSDAKKLFRSFKSVPDSDKSDYERLDYYQLKGKTF YGALYKGDYESESANIKRSIDYFISHNGNSEIKGKINTERRKQQPRISTAIGYLKFIRQHDF GLYKLLLQDAEFEKSNQEMIASIRETLLSLVRIPSAHEYADKTYTLFSNMMDDVEILLKSK VFSYFPTVSQSELDEVLVREEKPLYLFKITNKDLSYAETHEKGLRKTRGTDNLHTLYFKAL MSGNQSVFDIGSGAIFFREKKINYTDEQMRKGHHHEMLKDKFNYPIISNKRYAFDKFQ FHLSISINYNADKNKDINPMVNAYLKESNSTHIIGIDRGERHLLYLSLIDLQGDIVEQYTL NEIGNTNYHDLLGIKEKQRKEARPNWMEIENIRELKEGYMSQVIHIIAQLMVKYNAIV VLEDLNMGFMRGRQKVEKQVYQKFEKMLIDKLNYLVDKQCNATELGGVLNAYQLTN THKKFLEQYGNQKNALGKQCGFIFYIPAWNTSKMDPTTGFVNLLDTHYENMEKAKAF FGKFKSIRNNAAKGWFEFEFDYDNFTTKAADTRTPWTLYTHGTRIETKRDPKQKNNFV SEEFDLTSKFKELFVKYKIDLNDNLMEQICLQNDASFFKELLHLLQLTLQMRNSKIGTDV DYLISPVMNDKGKFYDSRNCGKNLPENADANGAYNIARKGLWIIDQIKRTDDLSRLRL AISNKEWLQYAQKMV |
| 1 | ID422 | 1 | MEELMTNFSDFTGLFSLSKTLRFELKPVGKTKETFKQWLENMNSTNEEGNLLAKDKKI KDAYLALKPVMNSLHEQFIEMSLLSGKAKEIDFSKYYEAYKEKNVSSKLEEELRAKIGETY EIAGNYFYKEISNVLGKEIKPKKDKPYECLTDAKMLKYLSAKVQELAEQNGVDEQTLKG HLEQFKGFWGYLDGYNQNRENYYEYEKEASTAVATRIVHENLPTFCSNVLRFENRKDE YLGIYQYLKDKNRETKIKNSKGEEVDAKAISESVFQIKHFNECLTQPQIEEYNRIIGNYNL LINLYNQARREEAGFKKIDEFETLYKQIGCGKKKSMFETLQNDSDVKDLLQNAKNAGD VMFKNTLPAFIRFLKECDNWDGIYMSSAAVNKISNQYFANWHSIKDKLKDAKANACIT YDKNREEQIKLRDAVELSGLFAVLDTEHSEHFFKDSLFKDNETNEYRGILDKDLPPSKNLI NLLCFDIERNIKAFLQESDRIAALEKYKDENIQAGEEDQTIKKIKEWFDAATDAMRIVRY FAVRKSKMKGNLPNVTMEQALSNLLYNDDVQWFKWYDLVRNYFTKKPQDDAKENK LKLNFGKGTLLNGFVDSHSDSDNGTQYGGYIFRKKHEKCNEYEYFLGVSKNAQLFRCH LKNEVPSNDKSAFERLEYYQMKSTTPYPNDYGNKKEEIIDVVRKLAEDNEELVEWIDKK NEDKKLTPTELFKRLENTNDPILKNKELLNKVDETISIIKSNLKNFTRINAINDLQNDDQN HGGIDGFKKLVDELKKITAATKLFDFFPVSSSEFNAHNGEDLFLFKISNKDLSYCETFAEG KRKEKTNQKENLHTLIFRALMREDLFGDIVDIGKGEVFLREKVREYDYDDSVRKYGHHY NDLKDRFTYPIISNKRFSEDKILLHLSVILNYKSDNKKNVGVEINDALQQSDNLQFIGIDR GEKHLVYSCTIDKNAKIIKCNHHDNINGTDYVKKLEDVADERIIAKKNWQAQNKIKDLK TGYISHVVHRLVEETIKDGEKIAPHAYIVLEDLNTEMKRGRQKIEKQIYQNLETALAKKL NFVVDKDAKEGELGSVSKALQLTPPISNYQDIEGKKQFGVMLYTRANYTSVTDPATG WRKTIYIKNGKEEDIMNQIFKEFSDFGFDGKDYYFEYTEANAGHTWRLYSGKDGKPLP RFQNKKQIQQDKNIWVPEQINVVKILDEIFADFDKAKSFKTQIEEGIELKKAGGRTETA WQSLRYALELIQQIRNSGEKDSKDDNFLYSPVRNENGEHFDTRHPEKNGDLSKIVDAD ANGAYNIARKGLIMDAHIKHWIESGRPKTKKDGKEKSDLDLFISDKEWDLWLLDREQ WKKDLPAFASLSAKDDADKSKAGRGRKKQ |
| 404 | ID423 | 13 | MKDLKQFIGIYSVSKTLRFELRPIGKTQEWIEKNKILESDEQKAEDYPKVKTLIDDYHKVC IRESLRGVHLDWSPLRQALEEYQQTKSDESKAVLEKEQTSMRKQIAAAIKDFRHFRELT APTPQKLIDDVFPGIYEDEALKSFNRFALYFRGFQDNRNNIYSAEAISTGVPYRLVHDNF PKFLADIEVYENIKATCPEVIEQVAVEMQPPFLEGVMIDDIFTLDFYNSLLTQDGIDFFNQ VLGGVAEEGKQKYRGINEFVNLYRQQHPELTGKKKALTMVPLFKQILSDRETLSYIPQQ IESEQQLIDVLSQFYAHITDYEYNGKTINVLKELSNLTNRIGDYNPAGIFLSAKTLTDVSQ KLFGRWSAINDKLYEKAVSQFGDPAIVKDKKKIDAYLAKDAFALSEINLDSEHHLSTYFS EMALVVEQVGSSWLQFKEWCKGSDKQLFLNNADGTEIVKNLLDAMMDILHRCAVLV VPIEYDLDKDFYNDFLPLYAELENVIFVYNRTRNYLTKKPSDTKKFKLNFGTPTLGDGW GVNNERKNKAILLFKEGLSYLGIMNVKGTLKFEETKDASLHSYKKMTCRYLSKPFMDLP HTFFSEKGISTFHPSERIMDIYKNGTFKKDSPSYSIAALHDLIDFYKDAINKHEDWVKYG FSFSPTESYEDISSFYSEIAKQAYKISFTNVSEQQVNDWVENGQLYLFQLYNKDYAEGA HGRKNLHTLYWENLFSEENLNNLVLKLGGQAELFYRPQSINKPAKHVVGSKMLNRRD KSGMPIPEPIYRSLYQYFNGKKQEDELTAAEKAYIDQVVVKDTNHEIVKDRRYTKPEYFF HVPIVFNANADGNEYINERVLDYLKDNPEVNIIGIDRGERHLIYLTLINQRGEILKQKTEN MVGNYNYHAKLELREKERDDARKSWKSVGKIKELKEGFLSAVIHEIAVMMVENNAIV VLEDLNFGFKRGRFKVERQVYQKFEKMLIDKLNYLSFKDRMADEEGGILRGYQLALQF TSFQRLGKQSGFLFYIPAAYTSKIDPVTGFVNHFNLNDITNAEKRKAFLMNNMERIEVKN GNVEFEFDYRKFKTYQTDYQNIWTVNTSGKRIVFDSETRKAKDVYPTQEIIAAFKEKGI NLNDGTDLKPLIADIEANAKNASFYYAIFDAFKRTLQMRNSNAATEEDYILSPVVCNGK QFCTTDEVNKGKDADGNWLSKLPVADANGAYHIALKGLYLLNNPQTKKIENEKWF QFMVEKPYLE |
| 3 | ID424 | 1 | MKEFTNLYQLSKTLRFELKPIGKTAKTFQRWLEEMNKAELVGDNDGNLFLKDKKIKNA YLAIKPIMDKLHEQLIEMALLSKEAKQIDFSEYFEAYKNKAVRVEMENGLRKAFAKPFQ YAGLYFVEEISKSQKNGKEIKTKKDKQYECLTDAKMYNYLSAHVRDLAEQNGIDEQKLK KHIEQFKGFWGYLDGYNQNRENYYEVDKEASTAVATRIVHENLPTFCSNAMRFEKRK DEYLCIHRYLKDNSRETKIKNTKGEEIDVEAISDNIFQIKHFNECLAQSQIEEYNRIIGNYN MLINLYNQLRRGEKDFKKIDEFEKLKKQIGCGKKKSMFETLQGDSDVKKLLLKASEAGK |

TABLE S15A-continued

Enzyme Sequences Group 15

| SEQ ID NO | Ref. | Group | Sequence |
|---|---|---|---|
| | | | QMFKDVADFSEIKTVPDFIEFLRECDNWDGIYMSKTAIDKISSLYFANWHSIKDKLKEA<br>KADACITYEKKREEPIKLRDAVELSGLFAVLDSEQSEHFFKDDSLFKDDDTNDYRGVLNKT<br>LTPSKNLIQLLCFDIERNTNAFLSKSNNIVKLEKYKDENDQAGEEDQTIRKIKEWFDAAT<br>DAMRIVRYFSVRKSKMKGNIPNATIEQALSNLLYNDDAQWFKWYDLIRNYLTKKPQD<br>DAKENKLKLNFGTSSLLGGWSDGQEKTKVATLLKYHDEIYLCVLKTKNIFDTSKDNNPIY<br>DITESEASRLLLRNLKFQTLAGKGFLGEYEISYGDMGKENPTKAIKCLQKIIKERYVNKYP<br>LLEKFARNTYTDKAQFDAEITETLKECYVCQFVPIDWNVVTEKQDNEELFLFKILCKDYR<br>PKSVGKKDLQTMYWEDVLSDGSKHQLCAGAEIFMREPVAKESPIIHRIGSKFVNKRDK<br>DGDTIPEQIYREIYSYANGKKKTISAESRKYIDEQKVIIKDVKHKIIKDNRFYGETKYMFHC<br>PIKLQFEAKDPKYAYSEVNTTVSNALQQSDNLQFIGIDRGEKHLVYSCIVDKDCKILKCG<br>HHDVINGTDYVQKLEAVADERIVAKKNWQQQNKIRDLKNGYISHVVHRLVEETIKDN<br>GKIAPHAYIVLEDLNTEMKRGRQKIEKQVYQNLETALAKKLNFVVDKDTKKGEIGSVSK<br>ALQLTPPINNYQDIEGKKQFGVMLYTRANYTSVTDPATGWRKTIYIKNGKEDDIKNQIL<br>DKFSDFGFDGDYYFEYTEANVGHTWRLYSGKNGKALPRFQNKKQALQDKNVWVPEK<br>INVVDILNKLFAKFDKKKSFKSQIEAGVELQKDEERNETAWQSLRFALDLIQQIRNSGEK<br>NSGDDNFLYSPVRNDKDEHFDTRNYKNNGELSEIRDADANGAYNIARKGLIMDTHIK<br>HWINNGRPKTKIDGSEVSDLDLFISDREWDLWLLDREQWMKELPTFASKIAKYDSDA<br>PQTAKRRKKR |
| 447 | ID425 | 14 | MIIYNCYIGGSFMKKIDSFTNCYSLSKTLRFKLIPIGATQSNFDLNKMLDEDKKRAENYS<br>KAKSIIDKYHRFFIEKALSSVTENKVFDSFLEDIRAYAELYYRSNKDDSDKASMKTLESKM<br>RKFIALALQSDEGFKDLFGQNLIKKTLPEFLESDADKEIIAEFDGFSTYFTGFFNNRKNM<br>YSADDQSTAISHRCINDNLPKFLDNVRTFKNSDVANILNNNLKILNEDFDGIYGTSAED<br>VFNVDYFPFVLSQKGIEAYNSILGGYTNSDGSKIKGLNEYIYLYNQKNGNIHRIPKMKQL<br>FKQILSERESVSFIPEKFDSDDDVLSSINDYYLERDGGKVLSIEKTVEKIEKLFSAVTDYCT<br>DGIFVKNAAELTAVCSGAFGYWGTVQNAWNNEYDALNGYKETEKYIDKRKKAYKSVE<br>SFSLADIQKYADVSESSETNAEVTEWLRNEIKEKCNLAVQGYESSKDLISKPYTESKKLFN<br>NDNAVELIKNALDSVKELENVLRLLLGTGKEESKDENFYGEFLPCYERICEVDSLYDKVR<br>NYMTQKLYKTDKIKINFSNSHFLSGWAQTYSTKGALIVKKENNYYLVIVDKKLSNDDIVF<br>LGTNTQLSPAERIVYDFQKPDNKNTPRLFIRSKGTSYAPAVKEYDLPISDIIEIYDNEYFKT<br>EYRKINPKGYKEALIKLIDYFKLGFSRHESYRCFNFKWKESEQYSDISEFYNDVVKSCYQL<br>KSESINFDSLLKLVDEGKLYLFQLYNKDFSEHSKGTPNLHTLYFKMLFDERNLENVVFKL<br>NGEAEMFYREASISKDDMIVHPKNQPIKNKNEQNSRKQSTFKYDIVKDRRYTVDQFM<br>LHIPITLNFTANGGTNINNEVRKALKDCDKNYVIGIDRGERNLLYICVVDSEGRIIEQYSL<br>NEIINEYNGNTYSTDYHALLDKKEKERLESRKAWKTVENIKELKEGYISQVVHKICELVEK<br>YDAVIVMEDLNFGFKQGRSGKFEKSVYQKFEKMLIDKLNYFADKKKSPEEIGSVLNAY<br>QLTNAFESFEKMGKQNGFIFYVPAYLTSKIDPTTGFADLLHPSSKQSKESMRDFVGRFD<br>SITFNKTENYFEFELDYNKFPRCNTDYRKKWTVCTYGSRIKTFRNPEKNSEWDNKTVEL<br>TPAFMALFEKYSIDVNGDIKAQIMSVDKKDFFVELIGLLRLTLQMRNSETGKVDRDYLIS<br>PVKNSEGVFYNSDDYKGIENASLPKDADANGAYNIARKGLWIIEQIKACENDAELNKIR<br>LAMSNAEWLEYAQKK |
| 448 | ID426 | 14 | LLPARRCNGAVPHIRHTDNHATPGHSMSLDSFTRKYKLAKTLRFELRPVGRTLETFRSK<br>FLPGDERRAAAYPGAKEMLDNEHKALLERALANPPAGLDWSGLAQAHDTYRTSDKS<br>KAAKGALAARQAVFRKALADHLTKDPSYKTLTAATPKDLFKALKARCEEAGQPVPGDL<br>QTFLRFSCYFKGYQENRRNIYSDKAQATAANRAVGNFPRFLEDVRIFRHIAERYPQI<br>PADAARELAPLLEGRTLDSIFTPAAYNGFLAQSRIDFFNSVLGGFVPAEGEKTRGINEFV<br>NLYRQRHEDAREDRALAPLRPLHKQILSDRESHSLVPRMFENDGAVVSAIREMLDKRL<br>LALETENGTENVPDALQSLLATLSPSPAIWIDGAEITRVSKDLLGSWNALSILMEAAAEI<br>RFASESTEKKRDAAVANWMKKPVFSLAEMGGLRVDTDNGANPVDVSGLWKGPVAA<br>ARFDAVRKAVAEVRPVLDSAPSGEGTPLRERQEDIARIKAALDAILDLLRFVKPLRAGGE<br>LDRDEAFYGAFDPLFDALDGFVPLYNKVRNYLTRKPGETGSVKLMFDNPSFLEGWEQ<br>NLETKRTSILFFRDGFYYLGVMAPDAKINFSAFAVSAASGCYRKVVYKAISKAAQYFSIK<br>QIKPQNPPQFVLDWLAKGFDKKTLHRDQLTRLISYVMDDFIPNYPPLKDGSGRVAFDF<br>SFRKPSEYGSWKEFTDHIASMAYKISFEDIPAEAVDRLVEEGKLCLFLLWNKDFSQASN<br>GRPNLHTMYWKAVFSPENLRDVVIKLNGEAEVFYRPKSIRTPFRHKVGEKMVNRRGR<br>DGAPVPEAIHGELFRHANGDTAPLSGAARQWLESGNLVVKEVTHEIVKDARFAADKF<br>SFHVPVTINFKQPDVSARFNDQVRAFLRANPDVKVIGIDRGERNLLYLALVDREGNLLE<br>QRSFNTVSRTRKDGVVTPTDYQAKLVQSEKDRAEARASWAEIGAIKDLKAGYLSAVVH<br>EIAEMMVKHNAIVVLEDLNFGFKRGRFRIERQVYQKFEKALIDKLNYLVFKDRGMEEP<br>GGTLRGYQLTDAFESFEKIGKQTGFLFYVPAGYTSKIDPTTGFTNLFNTKKCTNAAGIRD<br>FFAAFDAIRWDAARRVFAFSFDYRNFKTSQESHRTKWTVYSADRRLAFDKESRSEREI<br>NPTAILLGALEERGIAVADGFDLKALLLATEPSKANAAFFRSVFYAFDRTLQMRNSRAE<br>EDYIHSPVLNARGGFFDSREAGDALPREADANGAYHIALKGVQLLEENLAAETPNLKIE<br>HKDWFRFAQELAERKFR |
| 33 | ID427 | 3 | LCSIFAHMAINFAREIKKYYLCIINIKKILNMECLKDFYNQYSVQKTLRFKLEPVGKTEEFI<br>ERAQVLENDERRAAEYKKVKDLIDNYHRWFIEQALSAPLLKVDSTGDNDSLEDFQDCY<br>NNDTSEKRSDNLEKIQGKLRSQIVKGFSKHPAFKHIDKKELITTDLKQFLTDPNEIDIVSH<br>FANFTTYFTGFHQNRMMNYSVEAKSTSISFRLINQNLVKCVDNSKILEKVKPALGADIF<br>SKLNHDFEPFLNVVDALDLFKVENYNEVITQPQIELYNAIIGGRVDNDSKVEIKGLNQYI<br>NEYNQTHSKQERLPKLKPLFKQILSEREGVSFRIEQFEKANQVQDAINEAYNDLHANVF<br>TKLKDLLLNLSSFDLDGVFVANDQSLTDISQRHYGAWDTVKNAVVASYDMTNPRKKS<br>QSQEKRDEQVKKHLKSIKSLSLATIDNMLKDSTGLSIVDYFTTLGAVNNENLQHENLFA |

TABLE S15A-continued

Enzyme Sequences Group 15

| SEQ ID NO | Ref. | Group | Sequence |
|---|---|---|---|
| | | | LIENRYNAARSVLDSDSPSDELLRKNITQIKDLLDSIKDLQRFIKPLCGSGEEPLKDEIFYS DFSALYESLDDTITPLYNKVRSYLTRKPYSLDKFKLNFDNSQLLDGWDVNKEKDYLSILLR KNGYYYLAIANKNDKSALSQINQCDMISGDCYEKLNYKLLPSPFKMLPKVFFSRKGIEVY NPSQEILDIYNEKKFQLGDKFDKESLIKLIDFYKNAIPQNESWQSFDFSFAPSQSYESINE FYSVIENQGYKIDFKKVPSSLINLLIDQGLLYVFKIANKDFSPHSKGRPNLHTIYWRMLFD ENNLKNVVYKLNGRAEMFYRKSSIQNPVIHKAHHDIKNKSEYNKLHKPSSKFDYDIIKD RRFTRNQYEFHVPITMNFKPAGSGQFNRDVLKFIKAKGIKHIIGIDRGERHLLYLTMIDL KGRIVEQFSLNSVASNPNNPDFKQDYNTMLAIKEGDRLNARRNWSTIENIKELKQGYL SQIVHLLSKMMIENDAILVLENLNSGFMRGRQKVEKSVYLKFEKMLIDKLNYVVDKGT DLNEPCGALKALQLTDSYEKFNKFQKGNVRQCGFVFYIPAWNTSKIDPATGFVNLFDT RLSTIGEIKAFFSKFDRISYDASNDVFEFSFDYNNFTSRAQGTRTRWTVTTRGERIFTHR SKEKNNQFVSELVSPTSLLKDVLEKTGTNLQGNLKEAIASLQSLDELKQLLHAFKLTMQ MRNSVTGTDVDYLISPAIDAKGNNFDSRECDSTMPLNADANGAFNIARKGLMIVEQI QKVDDIGNLKYAVTNKDWLTFAQK |
| 400 | ID428 | 13 | MYDLKQFIGIYPVSKTLRFELKPIGRTQEWIEKNHVLEHDWKRAEDYPRVKEMIDVYH KLCISKSLKNMDFDWEPLRDAIERNRQEKSDESKKELEAEQTRMRNKIHDQLSKFEHY KKLNADTPSLLINHILPQEDALESFKKFATYFEGFQKNRKNIYSKEAISTGVPYRLVHDNF PKFLANIEVFENLQELCPEVIRQAATEMAPFLQGVMIEDVFTVGFYNAILTQDGIDFYN QILGGVVKDEQHYQGINQLTNLYRQAHPDLTANRKSMTMVPLFKQILSDRETLSDIAK PIESEEQLIEVVTSFYHRVTDFTLNGNSINIIDELATLVQSLNTYNPEGIFVSAKSLTDVSH TLYGHWNKINEKLYEKAVELFGDVQVVKNRKKVEAYLNKDTYTLAELSFGDDISIAQYF ENISGGSADATNSLWVQFQSWCKTAEKPKFVHNEAGTELVKMLLDSILNVLHKCSVLVV SMENDLDKDFYNKFLPLYAELENVILLYNRVRNFLTQKPSSTGKIKLKFDIPSLGAGWGI NKEKKNKAILLFKDGRSYLGIMNVKGTLDFDCKAEHGEPTYKKMVCVNHSKPYMDLP NSFFRQTGIDKYKPSERILKIYEAFKKDSKSVDINEVRELIDYYKDAITRNEDWNSVSFTY SPTETYETIDDFYKEVAKQSYQVSFKDISQKQVDEWVEKGQLYLFQLYNKDYAEGAHG RKNLHTLYWESLFTAENLSDIVIKLGSNAELFYRPQAIKKKPVKHEVGTKMLNRRDNSGK PIPDTIYRSLYQFYNGKKAKAELTAEERAYISQVIVKDVQHEIIKDRRYTKQFHYQFHVPI VFNANANGKVKFNDKVMDYIQDNPDVNIIGIDRGERHLIYLTLINQRGEILKQKTFNVV GNYDYQEKLKQREKERNEARRSWQSVGKIKDLKEGFLSAVVHEIAQMMIEHNAIVVL EDLNRGFKRGRFKVERQVYQKFEKMLIDKLNYLSFKDREIADEGGILCGYQLTEKTLNYS DIGRQTGFLFYIPAAYTSKIDPVTGFVNHFNLNDITNAEKRKAFLMKMERIEVKNGNVE FEFDYRKFKTFQTDFQNVWTVNTSGKRIIFDTETRKAKDVYPTKEIAQSFANRGIALEE GMDLKAIIAEVEPDVKNAAFFKSLFYAFENTLRMRNSNTETQEDYILSPVAINGKQFCT TDEANKGKDADGNWLSKLPVDADANGAYHIALKGLYLLNNPQTKKIENEKWFQFMI EKLYLK |
| 59 | ID429 | 5 | MKEQFINCYPLSKTLQFSLIPVGKTDDNFNKKLLLERDKQRAENYEKVKGYIDRFHKEYI ESVLVNARVEKIDEYADLYWKSNKDDSDAKAMESLENDMRKQISKQLKSNARYKRLF GKELICEDLPSFLTDKEERETVECFRSFTTYFKGLNTNRENMYSSDEKSTAISYRCINDNL PRFLDNVKSFQKVFDNLSDETITKLNTDLYNTFGRNIEDVFSVDYFEFVLAQSGIDIYNS MIGGYTCSDGTKIQGLNECINLYNKQDAKNEKSKRLPLMKPLYKQILSEKDSVSFIPEKF NSDNEVLLSIEDYYSSHIGDLDLLTELLQSLNTYNANGIFVKSGAAVSDISNGAFNSWN VLRLAWNEKYEALHPVTSKTNLDNYIEKRDKIYKAIKSFSLFELQSLGNENGNEITDWYI SSSKECNSKIKEAYLQARELLKSDYEKSYNKRLSKNGKATQSIKNILDAIKDFHHLVKSLN CTGKEENKDELFYGKLTSYYDSITDIDRLYDKVRNYITQKPYSKDKIKLNFDNPQLLGGW DKNKESDYRTVLLRKDDFYYLAVMDKLHSKAFVDAPNITSKDEDYYEKMEYKLLPGPN KMLPKVFFAAKNIDTFQPSDRILDIRKRESFKKGATFNKSECHEFIDYFKNSIEKHYDWS QFGFEFTPTENYNDISEFYREISDQGYSVSFNKISKSYVDELVDNGYIYLFQIYNKDFSKY SKGTPNLHTLYFKMLFDERNLSNVVYKLNGEAEMFYREASINDKEKITHQANQPIENK NPDNEKKESTFEYDIIKDKRFTKRQFSLHVPITINFKAHGQEFLNYDVRKAVKYKDDNYV IGIDRGERNLIYISVIDSNGKIVEQMSLNEIISDNGHRVDYQKLLDTKEKERDKARKNWT SVENIKELKEGYISQVVHKICELVVKYDAVIAMEDLNFGFKRGRFPVEKQVYQKFENML ISKLNLLIDKKADPTEDGGLLRAYQLTNKFDGVNKAKQNGIIFYVPAWDTSKIDPVTGF VNLLKPKYTSVSEAKKLFETIDDIKYNANTDMFEFCIDYGKFPRCNSDYKNTWTVCTNS SRILTCRNKEKNNMWDNKQIVLTDEFKSLFGEFGIDYKGNLKTSILSISNADFYRRLIKLL SLTLQMRNSITGSTLPEDDYLISPVANDRGEFYDSRNYKGMNAALPCDADANGAYNIA RKALWAINVLKSTPDDMLNKANLSITNAEWLEYTQK |
| 57 | ID432 | 5 | MKEQFINRYSLSKTLRFSLIPVGETENNFNKNLLLKKDKQRAENYEKVKGYIDRFHKEYI ESVLSKARIEKVNEYANLYWKSNKDDSDIKAMESLENDMRKQISKQLKSNARYKRLFG KELICEDLPSFLTDKDERETVECFRSFTTYFKGFNTNRENMYSSDEKSTAIAYRCINDNLP RFLDNVKSFQKVFDNLSDETITKLNTDLYNIFGRNIEDIFSVDYFEFVLAQSGIEIYNSMI GGYTCSDKTKIQGLNEYINLYNQQISKNEKSKRLPLIKPLYKQILSEKDSVSFIPEKFNSDN EVLLAIDDYYNNHIGDFDLLTELLQSLNTYNANGIFVKSGVAITDISNGAFNSWNVLRS AWNEKYEALHPVTSKTKIDKYIEKRDKVYKAIKSFSLFELQSLGNENGNEITDWYISSINE SNRKIKEAYLQAQELLKSDYEKSYNKRLYKNEKATESVKNLLDTIKEFQKLIKPLNGTSKE ENKDELFYGKFTSLYDSVADIDRLYDKVRNYITQKPYSKDKIKLNFDNPTFLNGWALGN EFANSAQLLRDGDNYYLAIMDKELKNNIPKKYNSPTNEEDMLQKIIYQQAANPANDIP NLLVIDGVTVKKNGRKEKTGIHAGENIILENLRNTYLPDNINRIRKEKTESTSSENFSKDD LCEYIQYYICRVQEYYSSYNFTFKNASEYKNFPEFSDDVNSQAYQISYDNISKKQIMELV DNGYIYLFQIYNKDFSKYSKGTPNLHTLYFKMLFDERNLSNVVYKLNGEAEMFYREASI GDKEKITHYANQPIENKNPDNKKKESVFEYDIVKDKRFTKRQFSLHVPITINFKAHGQEF |

TABLE S15A-continued

Enzyme Sequences Group 15

| SEQ ID NO | Ref. | Group | Sequence |
|---|---|---|---|
| | | | LNYDVRKAVKYKDDNYVIGIDRGERNLIYISVIDSNGKIVEQMSLNEIISDNGHKVDYQK<br>LLDTKEKERDKARKNWTSVENIKELKEGYISQVVHKICELVVKYDAVIAMEDLNFGFKR<br>GRFPVEKQVYQKFENMLISKLNLLIDKKADPTENGGLLRAYQLTNKFDGVNKAKQNGII<br>FYVPAWDTSKIDPATGFVNLLKPKCNTSMPEAKKLFETIDDIKYNTNTDMFEFYIDYSK<br>FPRCNSDFKKSWTVCTNSSRILTFPNKEKNNMWDNKQIVLTDEFKSLFNEFGIDYKGN<br>LKSSILSISNADFYRRLIKLLSLTLQMRNSITGSTLPKDDYLISPVANKNGEFYDSRNYKGT<br>NAALPCDADANGAYNIARKALWAINVLKDTPDDMLNKAKLSITNAEWLEYTQK |
| 402 | ID433 | 13 | MLNLNYYLFYFVSLWQDNEYLKPITMNNLKQFIGIYPVSKTLRFELRPIGKTQEWIEINK<br>VLEGDVQKAADYPTVKKLIDEYHKICIHDSLKNVHFDWAPLKEAIVIFQKTKSDESKKRL<br>EAEQTIMRKQIAAAIKDFKHFKELTAATPSDLITSVLPEFSDDDSLMSFRGFATYFSGFQ<br>ENRINIYSQESISTGVPYRIVHDNFPKFLSNQEVYDRIRSVCPEVIKQASEELQPFLEGVM<br>IDDIFSLDFYNSLLTQDGIDFYNRVIGGVSEEGKQKYRGINEFSNLYRQQHKDLAASKKA<br>MTMIPLFKQILSDRETLSYIPVQIESEDELVSSIKQFYEHITHFERDGKTVNVLSELVAVLG<br>NIDSYNPDGICISASKLTDISQKVYGKWSIIEEKLKEKAIMQYGDISVAKNKKKVDAYLSR<br>KAYCLSDLCFDEVVSFSRYYSELPQMLNAINGYWMQFNEWCRSDEKQKFLNNPMGT<br>EVVKCLLDAMMELYHKSAVLVMPEEYEVDKSFYNEFIPLYEELDTLFLLYNKVRNYLTR<br>KPSDVKKFKLNFESPSLASGWDQNKEMKNNAILLFKDGKSYLGVLNAKNKAKIKDAKG<br>DASSSSYKKMIYKLLSDPSKDLPHKLFAKGNLDFYKPSEYILEGRELGKYKKGPNFDKKFL<br>HDFIDFYKAAIAIDPDWSKFNFQYSPTESYEDIGAFFSEIKKQAYKIRFTDITESQVNEW<br>VDNGQLYLFQLYNKDYAEGAHGRKNLHTLYWENLFTDENLSNLVLKLNGQAELFCRP<br>QSIKKPVSHKIGSKMLNRRDKSGMPIPENIYRSLYQFYNGKKKESELTTAEKQYMDQVI<br>VKDVTHEIIKDRRYTRQEYFFHVPLTLNANADGNEYINEQVLNYLKYNPDVNIIGIDRGE<br>RHLIYLTLINQRGEIIKQKTFNIVNNYNYQVKLEQREKERDEARKSWDSVGKIKDLKEGF<br>LSAVIHEITKMMIENNAIVVLEDLNFGFKRGRFKVERQVYQKFEKMLIDKLNYLSFKDR<br>EVGEEGGILRGYQMAQKFVSFQRLGKQSGFLFYIPAAYTSKIDPVTGFVNHFNFNDITN<br>AEKRKDFLMKMERIEMKNGYIEFTFDYRKFKTYQTDYQNVWTVSTFGKRIVMRIDEK<br>GYKKMVDYEPTNDIIYAFKNKGILLSEGSDLKALIADVEANATNAGFFGTLLYAFQKTLQ<br>MRNSNALTEEDFILSPVAKDGHHFCSTDEANKGRDAQGNWVSRLPVDADANGAYHI<br>ALKGLYLLRNPETKKIENEKWFQFMVEKPYLE |

TABLE S15B

Nucleotide Sequences Group 15

| SEQ ID NO | Ref. | Group | Sequence |
|---|---|---|---|
| 365 | ID405 | 10 | ATGGCTAGAATAATTGATGAGTTTTGTGGA<br>CAGATGAATGGGTATTCTCGTTCAATTACT<br>TTGAGGAATAGGTTAGTTCCTATTGGGAAA<br>ACTGAAGAAATTTAAAGCAGTTTTTAGAA<br>AAAGATTTGGAAAGAGCAACTGCTTATCCG<br>GACATAAAAAATCTTATAGATGCTATTCAT<br>CGTAATGTAATTGAGGATACTTTATCCAAA<br>GTTGCTTTGAATTGGAATGAAAATATTCAAT<br>ATACTTGCTACTTACCAAAATGAAAAAGAT<br>AAAAAAAAGAAAGCAGCAATAAAAAAGGAT<br>TTAGAGAAATTACAAAGTGGTGCAAGAAAA<br>AAAAAGTTGAGGCTTTTAAAAAGAATCCT<br>GATTTTGAAAAATTGTTTAAGGAAGGATTG<br>TTCAAAGAACTTTTACCCGAATTAATCAAA<br>TCTGCTCCCGTTGACGAAATAGCAGTCAAA<br>ACAAAAGCTTTGGAGTGTTTTAATAGATTT<br>AGTACATATTTTACAGGCTTTCATGACAAC<br>AGAAAAAAATATGTATAGTGAAGAGGCAAAG<br>TCTACGGCAATAAGTTATCGTATCGTAAAT<br>GAAAAATTTCCCAAATTTTTTGCAAATATA<br>AAACTGTTCAATTATTTAAAAGAGCATTTT<br>CCAAGAATAATTATTGATACAGAGGAATCT<br>TTAAAAGATTACCTCAAAGGTAAAAAACTT<br>GACTCTGTGTTCAGTATTGATGGTTTTAAC<br>AGTGTACTGGCTCAAAGTGGAATTGATTTT<br>TATAACACGTAATTGGTGAAATTTCTGGT<br>GAAGCAGGAACAAAAGAAAACTCAGGGATTG<br>AATGAAAAAATCAATCTTGCAAGACAACAA<br>TTGTCGAAAGAAGAAAAAAATAAACTTCGT<br>GGTAAAATGGTTGTCTTGTTTAAACAGATT<br>TTAAGTGATAGAGAAACCTCTTCTTTTATT<br>CCAGTTGGTTTTGCAAATAAAGAGGAGGTT | |
| | | | TATTCAACTGTTAAGGAATTTAATAACTCA<br>ATTGCTGAAAAGGCTGTTTCAAAAGTAAGA<br>GACTTATTCTTACACAGAAGAATTTACT<br>CTTAATGAAATCTTCGTTCCTGCAAAGTCA<br>TTGACAGATTTTTCTCAAGCGATTTTTGGG<br>TCTTGGTCAATACTTTCTGAAGGTCTGTTC<br>TTGCTGGAAAAGATAGCATGAAAAAGGCT<br>TTATCTGAGAGTCAAGAAGAAAAATCAAT<br>AAGGAAATTGCGAAAAAGATTGTTCTTTT<br>ACAGAATTGCAGTTGGCTTATGAAAGATAT<br>TGTACTGAACATAATCTACCTGTAGAGAAA<br>TTTTGCAAGGATTATTTTGACATTGTAGAT<br>TATCGTGGAAATGGTGCAAAATCAGAAAAG<br>ACAAAAGTTTCTATTCTTTCTGAAATTTTG<br>GAGACATTTTTGCAACTTGATTTTGACCAT<br>ATTCAGGATTTACAACAAGAAAAAAATGCG<br>GCAATTCCTATAAAAGCCTATTTAGATGAA<br>GTACAGAATCTATATCACCATTTGAAATTG<br>GTAGATTATCGTGGTGAGGAACAAAAGGAT<br>TCAACTTTTTATTCTAAACATGATGAGATT<br>TTGACTGACTTTTCGCAAATCGTTCCCCTT<br>TATAATAAAGTTAGAAACTTTGTTACCAAG<br>AAACTTGGAGAAAGTAAAAAGATAAAACTT<br>AATTTTGATTGTCCAACTTTAGCAAATGGC<br>TGGGATGAAAACCAAGAGTCTTCTAATGAT<br>GCCATTATGTTTGAGAAAAGATGGGAAATT<br>TATCTTGGAATTTATAATCCAAATAACAAG<br>CCAAAATTTGCTAAGAAAGATAGCATTGTT<br>GGTGATTGTTATGAAAAATGGCTTATAAA<br>CAAATAGCACTTCCAATGGGATTAGGTGCA<br>TTCGTAAGGAAATGTTTTGGTACCGCTCAA<br>AAGTATGGCTGGGGTTGTCCAGAAAATTGC |

TABLE S15B-continued

Nucleotide Sequences Group 15

| SEQ ID NO | Ref. | Group | Sequence |
|---|---|---|---|
| | | | TTAAATTCTGAAGGAAAAATTATAATCAAA |
| | | | GATGAGGAAGCAAAAGGAAATTTAGAGGCA |
| | | | ATTATCGATTGTTATAAAGACTTCTTAAAT |
| | | | AAATATGAAAAAGATGGTTTTAAATACAAA |
| | | | GATTACAATTTCAGCTTTTTAGATTCTGCT |
| | | | TCTTATGAAAAATTATCTGACTTTTTTAAC |
| | | | GATGTAAAACCTCAAGGTTATAAACTCTCC |
| | | | TTCACAAGTATTCCATTATCAGAAATTGAT |
| | | | AAAATGATAGATGAAGGCAAGCTCTTCCTT |
| | | | TTCCAGATTTACAACAAGGACTTTGCGAAG |
| | | | AAAGCGACAGGGAAGAAAAATCTTCATACC |
| | | | TTGTACTGGGAGAATCTTTTTAGTGTTGAG |
| | | | AACTTGCAGGATGTGGTCTTGAAATTGAAT |
| | | | GGCGAGGCGGAACTCTTTTGGAGGGAGGCA |
| | | | AGCATCAAAAAGGATAAGGTCATTGTCCAC |
| | | | AAGAAAGGTTCTATTCTGGTGAATAGGACG |
| | | | ACTACAGACGGAAAATCTATTCCAGAGGCC |
| | | | ATCTATCAGGAAATTTATCAACTTAAGAAC |
| | | | AAGATGGCTGACTCCATTTCTGATGAAGCC |
| | | | AAAAGGTTGTTGGAGTCAGGAACTGTCGTT |
| | | | TGTAAGGTTGCCACCCATGATATCGTGAAG |
| | | | GACAAGCACTTCACAGAGAATACCTATCTG |
| | | | TTCCACTGTCCTATTACCATGATAATTTCAAG |
| | | | GCGAAGGATAGAACAAATAAGGAATTTAAT |
| | | | AATCATGTCTTGGAGGTTCTCAATAAGAAT |
| | | | CCAGACATAAAAGTCATTGGCTTGGATCGT |
| | | | GGGAGAGCGTCATTTGCTCTATCTTTCTTTG |
| | | | ATCAACCAAAAAGGTGAGATTGAATGCCAG |
| | | | AAAAACACTGAATTTGGTGGAGCAAGTGAGG |
| | | | AATGACAAGACTGTCTCTGTAAACTACCAT |
| | | | GAAAAGCTGGTCCACAAAGAGGGTAGTCGT |
| | | | GATGCAGCACGCAAAGAATTGGCAAACGATT |
| | | | GGGAATATAAAGGAATTGAAGGAGGGGTAT |
| | | | CTTTCCGCTGTAGTCCATGAGATTGCCAGC |
| | | | TTGATGGTGAAGCATAATGCAATCGTTGTT |
| | | | ATGGAGGATTTAAACTTCGGGTTCAAGCGG |
| | | | GGACGTTTTGCAGTTGAGCGTCAGATTTAT |
| | | | CAGAAGTTTGAGAATATGCTGATAGAAAAG |
| | | | CTGAATTATCTTGTTTTCAAAGATAGGAAG |
| | | | GTCACTGAGCCGGGCGGAATTGTTGAATGCC |
| | | | TATCAATTGGCGAATAAGTCTGCAAAGGTG |
| | | | ACGGACGTTTACAAGCAATGTGGATGGCTT |
| | | | TTCTACATCCCCGCAGCCTACACCTCCAAG |
| | | | ATTGACCCTCGGACTGGATTTGCCAATCTT |
| | | | TTTATCACAAAGGGGCTGACAAATGTGGAA |
| | | | AAGAAGAAGGAATTCTTTGGAAAGTTTGAT |
| | | | TCAATCAGATATGATGCCACGGAGTCATGC |
| | | | TTTGTCTTTAGCTTTGATTACGCAAAAATC |
| | | | TGTGACAATGCAGACTACAAGAAAAAATGG |
| | | | GATGTGTACACGAGGGGAACCCGGCTTGTG |
| | | | TACAATAAAACTGAACGGAAGAATGTTTCT |
| | | | GTCAATCCCACAGAAGAGTTGCAGTGTGTA |
| | | | TTTGATGAATTTGGAATCAAGTGGAATACT |
| | | | GGAGAGGACTTGATTGAATCCATCAGTTTG |
| | | | ATTCCGGCAGAAAAGTCGAATGCAAAATTC |
| | | | TTTGACGTTCTGTTGAGGATGTTCAATGCC |
| | | | ACACTGCAAATGAGGAATTCTGTGCCGAAT |
| | | | ACGGACACTGACTACTTGGTTTCTCCTGTG |
| | | | AAAGCGGAGGACGGTTCTTTCTTTGATTCT |
| | | | CGTGAGGAGTTTAAGAAAGGTGGAGATGCA |
| | | | AGGCTTCCCATTGACTGTGATGCCAATGGA |
| | | | GCGTATCACATTGCGTTGAAGGGTCTGTAT |
| | | | TTGCTGTTGAATGACTTCAATCGGGATAAC |
| | | | AAGGGAGTGATTCAGAATATCTCCAACAAG |
| | | | GATTGGTTCAAGTTTGTACAGGAGAAAGTA |
| | | | TACAAGGACTGA |
| 74 | ID414 | 5 | ATGAAAGAACAGTTTATAAATTGCTATCCA |
| | | | TTATCCAAACTTTAAGATTTTCTTTAATC |
| | | | CCTGTTGGAAAAACCGAAGATAATTTCAAT |
| | | | AAAAAGCTTTTGCTTGAAAGCGATAAACAA |
| | | | AGAGCGGAGAATTATGAAAATGTCAAAAGC |
| | | | TATATTGACCGCTTTCATAAAGAATATATT |
| | | | AAATCTGCATTAGCAAACGCAAGAATTGAA |

TABLE S15B-continued

Nucleotide Sequences Group 15

| SEQ ID NO | Ref. | Group | Sequence |
|---|---|---|---|
| | | | AAAATCAATGAATATGCGGCTTTATATTGG |
| | | | AAAAACAATAAGGATGATTCTGACGCAAAA |
| | | | GCTATGGAATCGTTAGAAGATGATATAAGA |
| | | | AAGCAAATATCCAAACAACTTACATCAACC |
| | | | GCAAACTTTAAAAGACTGTTTGGAAAAGAG |
| | | | TTGATATGTGAAGACTTACCGGCTTTTTTA |
| | | | ACAGATGAAAATGAAAAAGAAACAGTTGAA |
| | | | TGCTTTAGAAGCTTTACAACATATTTTAAT |
| | | | GGTTTTAATACTAATCGAAGAATATGTAT |
| | | | TCGAGTGAAAAAAAGTCAACTGCAATAGCT |
| | | | TATCGTTGTGTAAATGACAACCTTCCTCGC |
| | | | TTTTTAGATAATATAAAAACCTTTCAAAAA |
| | | | ATATTCGATAATCTTTCTGATGAAACTATC |
| | | | ACAAAACTAAACACAGATTTATATAATATA |
| | | | TTCGGCAGAAAAATTGAAGATATTTTTCT |
| | | | GTTGATTATTTTGATTTTGTTTTGACTCAA |
| | | | TCAGGCATTGATATTTATAATTATATGATC |
| | | | GGCGGATATACTTGCTCAGACGGAACCAAA |
| | | | ATCCAAGGTCTTAATGAATGTATAAATCTT |
| | | | TATAACCAGCAGGTTGCCAAAAATGAAAAA |
| | | | TCAAAAAGATTGCCGTTAATGAAACCGTTA |
| | | | CGTAAGCAAATCTTAAGTGAAAAGGACAGT |
| | | | GTATCGTTCATTCCCGAGAAATTCAATTCA |
| | | | GACAACGAAGTGTTGCTTGCGATTGAAGAA |
| | | | TATTATAATAACCACATTAGTGATATCGAT |
| | | | TCGCTTACAGAGCTTTTGCAATCATTAAAC |
| | | | ACTTATAATGCCAATGGAATATTTATAAAA |
| | | | TCAGGTGCTGCCGTTTCCGATATTTCAAAC |
| | | | GCTGCATTTAACTCATGGAATGTATTACGC |
| | | | TTAGCTTGGAATGAAAAGTATGAGCTTTG |
| | | | CATCCCGTAACAAGCACAACAAAAATCGAT |
| | | | AAATATATTGAAAAGCGAGACAAGGTATAT |
| | | | AAATCAATAAAAAGCTTTTCGCTTTTTGAA |
| | | | CTTCAAGAGCTTGGTGCGAAAATGGGAAT |
| | | | GAAATAACCGATTGGTATATTTCATCAATC |
| | | | AATGAATGTAACCGCAAAATAAAAGAAACT |
| | | | TATTTGCAGGCACGGGAATTGCTGGAATCC |
| | | | GATTATGAAAAGGACTACGATAAAAGACTT |
| | | | TATAAAAATGAAAAAGCAACAGAGTTAGTA |
| | | | AAAAACCTGCTTGACGCAATAAAGGAATTT |
| | | | CAACAGCTTGTTAAACTGTTAAACGGCACA |
| | | | GGTAAAAGAAAACAAGGACGAGCTTTTTT |
| | | | TACGGCAAATTCACTTCACTTTATGACTCG |
| | | | GTAGCAGATATTGACAGGCTTTACGATAAG |
| | | | GTTAGAAACTACATTACTCAAAGACCTTAT |
| | | | TCCAAAGATAAAATAAAGCTGAATTTTGAC |
| | | | AATCCCCAACTTCTTGGCGGATGGGATAAA |
| | | | AACAAAGAAAGCGATTACAGAACCGTTATT |
| | | | CTTCGCAAAAATGATTTTTACTATCTTGCC |
| | | | GTTATGGACAAATCACACAGTAAGGTTTTT |
| | | | GTTAATGCACCTGAGATAACCTCTGAAGAC |
| | | | GAGGATTATTACGAAAAATGGAATATAAG |
| | | | CTTTTGCCCGGTCCCAATAAAATGTTGCCA |
| | | | AAGGTTTTCTTCGCCTCTAGAAATATTGAC |
| | | | AAATTTCAACCGTCAGACAGAATACTTGAT |
| | | | ATTCGCAAAAGAGAAAGCTTTAAAAAAGGA |
| | | | GCGACATTTAACAAATCCGAATGTCATGAG |
| | | | TTTATAGATTATTTTAAGGAATCTATTAAG |
| | | | AAGCATGATGATTGGTCAAAATTCGGATTT |
| | | | GAGTTTTCTCCTACAGAAAGCTATAACGAT |
| | | | ATTAGCAATTTTATCGAGAAGTTTCAGAT |
| | | | CAAGGCTATTATATTAGCTTTAGTAAAATA |
| | | | TCAAAAAACTATATCGATAAGCTTGTAGAA |
| | | | AACGGATATCTTTATCTTTTTAAAATCTAT |
| | | | AATAAAGACTTTTCAAAGTACAGCAAAGGA |
| | | | ACTCCGAATTTACATACTTTGTATTTCAAA |
| | | | ATGCTTTTGACGAGAGAATTTATCAAAT |
| | | | GTGGTATACAAGCTCAACGGTGAAGCCGAG |
| | | | ATGTTCTACCGTGAAGAAGTATAAAAACT |
| | | | AAAGAGAAATAACTCATCATGCCAATCAA |
| | | | CCGATAAAAACAAAAATCCTGATAACGAG |
| | | | AAAAAAGAAAGCGTTTTTGAGTATGATATT |
| | | | GTAAAAGACAAAAGATTTACCAAAAGGCAA |
| | | | TTTTCACTTCACGTGTCTGTTACAATCAAC |

TABLE S15B-continued

Nucleotide Sequences Group 15

| SEQ ID NO | Ref. | Group | Sequence |
|---|---|---|---|
| | | | TTCAAGGCACACGGTCAGGAATTTTTGAAC |
| | | | TATGATGTTCGCAAGGCGGTTAAATATAAA |
| | | | GATGATAATTACGTTATCGGCATTGACCGT |
| | | | GGCGAAAGGAATCTGATTTATATCAGCGTT |
| | | | ATCAATTCAAACGGTGAAATTGTTGAACAA |
| | | | ATGTCGCTTAATGAAATAATCGGTGACAAC |
| | | | GGATACAGTGTTGATTATCAAAAGCTTTTG |
| | | | GATAAGAAAGAAAAGGAAAGAGATAAAGCA |
| | | | AGAAAAAACTGGACCTCTGTTGAAAATATA |
| | | | AAGGAACTGAAAGAAGGCTACATCAGCCAG |
| | | | GTTGTTCACAAAATCTGTGAATTAGTCGTT |
| | | | AAATATGATGCCGTTATCGCTATGGAGGAT |
| | | | TTAAACTTCGGCTTCAAGCGCGGTAGGTTT |
| | | | CCTGTTGAAAAGCAAGTTTATCAAAAATTT |
| | | | GAAAATATGCTTATTTCCAAACTCAATTTG |
| | | | CTTATTGATAAGAAGGCGGAACCGACCGAA |
| | | | ACCGGCGGTCTTTTGCGAGCATATCAGCTT |
| | | | ACGAATAAATTCGACGCGTAAATAAGGCT |
| | | | AAGCAAACGGTATCATCTTTTATGTTCCG |
| | | | GCTTGGGATACAAGTAAAATAGATCCGGTA |
| | | | ACGGGCTTTGTTAATCTTTTAAAGCCAAAA |
| | | | TACACAAGTGTGCGGGAAGCTAAAAAGTTA |
| | | | TTTGAAACAATTGATGATATCAAATATAAC |
| | | | ACAAACACCGATATGTTTGAGTTCTGTATT |
| | | | GATTATGGTAAATTCCCGAGATGCAATTCG |
| | | | GATTTCAAAAAACTTGGACTGTTTGCACT |
| | | | AATTCAAGCAGAATTTTATCCTTCCGGAAT |
| | | | GAAAAAAAGAATAACGAGTGGGACAATAAG |
| | | | CAAATTGTTCTTACCGATGAATTCAAATCG |
| | | | TTGTTTAATGAATTTGGCATTGATTATACA |
| | | | AGTGATCTTAAGGCTTCTATTTTAAGCATT |
| | | | TCCAATGCCGATTTTTACAATCGATTGATA |
| | | | AGACTTCTTTCATTAACACTTCAAATGAGA |
| | | | AACAGTATTATCGGCAGCACATTACCGGAA |
| | | | GATGACTACCTTATTTCGCCTGTTGCAAAT |
| | | | GACAGAGGTGAGTTCTATGACGTCGTAAT |
| | | | TATAAAGGCTCAAATGCCGCTTTGCCTTGC |
| | | | GATGCCGATGCGAATGGCGCATATAATATT |
| | | | GCAAGAAAAGCGCTTTGGGCAATAAATGTT |
| | | | TTAAAAGCACACTCCGGATGATATGCTTCAA |
| | | | AAAGCAAAACTTAGTATAACTAATGCCGAA |
| | | | TGGCTTGAATATACACAAAGATGA |
| 565 | ID418 | N/A | ATGAAGGCCGAGCTGTTCAAAACCTTCGTG |
| | | | GATGAATACCCTGTGTCCAAGACACTGCGG |
| | | | TTCTCTCTGATCCCCGTGGGGAGAACCCTG |
| | | | GAGAATATTGAGAAGGACGGCATCCTGGAT |
| | | | TGCGACGAGAGCGGTCAGAAGAGTACAAG |
| | | | AGAGTGAAGAAGCTGCTGGATGAGTATTAT |
| | | | AAGACCTTCATCGAGCACGCCCTGACCAAT |
| | | | GTGGAGCTGGACATCAACAGCCTGGAGGAG |
| | | | TACGAGCGCCTGTACAACATCAAGAATAAA |
| | | | TCCGACAAGGAGAAGGCTGACTTCGATTCA |
| | | | GTGCAGAAGAATCTGAGAAAGCAGATTGTG |
| | | | AAGGCACTCAAGGAGGACGAAAAGTATAAG |
| | | | TTCCTGTTTAAGGAAGGAAATCATCGAGAAA |
| | | | GAGCTGGTTGACTTTCTGAACGGCCGCGAC |
| | | | AGCGACGTGGAACTGGTGAAAAGCTTCAAG |
| | | | GGCTACGCTACAATGTTTCAGGGCTTTTGG |
| | | | GACGCACGCAAGAATATCTTCTCAGACGAG |
| | | | GAGAAAAGCACAGCCTGCCTATAGAATT |
| | | | ATCAACGAGAATCTGCCTAAGTTCATTTCC |
| | | | AACAAAAATATCTACTTTACAAAGATCCAG |
| | | | CCAGAGATGGACGCCGAACTGGATCAGCTG |
| | | | ACTCTGTCAAATAATTCCAACGAAATCAGG |
| | | | GATATCTTTAAGCTGGAATACTTCAGCAAA |
| | | | ACCATCACACAGACAGGCATCGAGATCTAC |
| | | | AATGGCATCCTGGGCGGATATACCATCGAC |
| | | | GAGCAGGTGAAACTGCAGGGCATTAACGAG |
| | | | ATTGTGAACCTGCACAACCAGAAGAATAAG |
| | | | GACAGCGGGAAGATTCCAAAGCTGAAAATG |
| | | | CTGTACAAACAGATCCTGTCTGACACTAAC |
| | | | ACTCTGAGCTTCATCGCTGAAGGGTTCGAG |
| | | | ACCGACGACGAAGTGCTGGAGAGCCTGAAT |
| | | | ATCTTTTACGACGTGTTCAACGAGAATATC |
| | | | CTGGATGAGGACCTGGGCATCATCAATCTG |
| | | | CTGAGAAATATCGATAAATTCTCCTATGAC |
| | | | GGAATCTACATCAAGAATGACAAGGCCCTG |
| | | | ATCGATATCTCCAATTACCTGTTCGGGGAC |
| | | | TGGCATTACATTAAAAACGCTATCAATAAG |
| | | | AAGTATGAAATCGATAACCCTGGCAAAAAC |
| | | | ACCGAGAAGTATATTGTGAAGCGGAACAAG |
| | | | TTCATTAAATCTTTCGACAGTTTCTCCCTG |
| | | | AAGTATCTGCAGGACTGCACCGGCTCTAAG |
| | | | TTCAATGAGCACATCCTGATTAAGATCAAG |
| | | | AATTTAATCGACGACGTGAAGAAGGCCTAC |
| | | | AATAGCGTGGCACTGCTCATCAAGAATAAG |
| | | | TACGAGGGGACCAATCTCATTAACGACAAG |
| | | | GACGCCATCGAGAAGATCAAGCAGTTCCTG |
| | | | GATTCTATGAAGAGCCTGGTGTCTTTCATC |
| | | | AGGTGCTTCGAAGGTACCGGCCAAGAGCCC |
| | | | GACCGGGACGAGATCTTTTACGGGGAATTC |
| | | | GACACCGGGAAGAAGACCTTCTACTATCTG |
| | | | AACAACATCTATAATAAGACCAGAAATTAC |
| | | | GTGACCAAGAAACCATATAGCATCGAGAAG |
| | | | TACAAGCTGAATTTCGATAACGCAGAGCTG |
| | | | CTGACTGGGTGGGACCTGAATAAGGAGACC |
| | | | TCTAAGGCCAGTATCATCCTGAAGAAAGAC |
| | | | AACCTGTACTACCTGGGCATCATGAAGAAG |
| | | | AGCGACCGGCGAGTTTTCCTGAACGTGCCT |
| | | | GAGACCGAATCCACCTACAACTGCTACGAA |
| | | | AAAATGGAGTACAAGCTGCTGCCCGGGCCG |
| | | | AACAAAATGCTGCCAAAGGTTTTCTTCGCC |
| | | | AAATCCAACATCGACTACTATGATCCATCC |
| | | | CCCGAAATTATGCGCATCTACAAGGAGGGC |
| | | | ACTTTTAAGAAGGGCGACAATTTTAACATC |
| | | | GATGATTGTCACGACCTGATTGACTACTTC |
| | | | AAAGAGTCACTGGACAAAAATGATGACTGG |
| | | | AAGATTTTCGATTTCGACTTCTCCGAGACC |
| | | | TCATCTTATAAGGATATTGGAGAGTTTTAC |
| | | | AAGGAGGTGCAGCAGCAGGGATACAAAATT |
| | | | AGCTTTAAGAATATCGCCTCATCATACGTG |
| | | | GATGAACTGGTGGAGAACGGCAAGCTGTAC |
| | | | CTGTTCCAGATCTACAACAAAGATTTTAGC |
| | | | AAGAACAGCAAGGGAACAGAGAACCTGCAT |
| | | | ACAATGTATTGGCGCGCCCTGTTCGATGAG |
| | | | GAGAACCTGGAGAACGTCATTTACAAGCTG |
| | | | AACGGAGTGCTGAGATCTTTTTAGGCGG |
| | | | AAGAGCATCAGCGAGAATGAGAAGATCGTG |
| | | | CACCCAGCCCACGTGGAGATCGAGAACAAA |
| | | | AATGATGAAACTAGGAAGGAAAAGAAGACC |
| | | | TCTATTTTCAACTACGACATCATTAAAGAC |
| | | | AAGCGCTTCACAGTGGACAAATTTCAGTTC |
| | | | CACGTGCCTATCACTCTGAATTTCCAGGCC |
| | | | ATCGACAGGAAGTCCGATATCAACCTGCGC |
| | | | ATGAGACAGGAGATCAAAAAAATAAGAC |
| | | | ATGCATATCATCGGTATTGACCGCGGGGAG |
| | | | CGGAATCTGCTGTACATTAGCATCATCGAT |
| | | | CTGGACGGAAACATCGTGAAGCAGGAAAGC |
| | | | CTGAATACAATCACTAATGAGTACGACGGC |
| | | | AAAATCTACACCACCGACTATCACAAGCTG |
| | | | CTGGATAAAAGGAGGAAGCGGAAAGTG |
| | | | GCCAGGCAGACATGGAACACAATCGAGAAC |
| | | | ATCAAAGAGCTGAAGGCCGGCTACATGAGC |
| | | | CAGGTGGTGCACAAGATCACCCAGCTGATG |
| | | | ATGGAATCAACGCCATCGTGGTGCTGGAG |
| | | | GACCTGAATACTGGCTTTAAAAGGGGTCGT |
| | | | CAGAAGGTGGAAAAACAGATCTACCAAGCC |
| | | | TTCGAGAAGTCTCTGATCAACAAGCTGAAT |
| | | | TATTACGTGGACAAGAAGGTGGATAAGAAC |
| | | | GAGATCAGCGGGCTGTACAAGCCCCTGCAG |
| | | | CTGACCAAGGAATTTGAGAGCTTTAAGAAG |
| | | | CTGGGAAAGCAGTCTGGCGCAATCTTTTAT |
| | | | GTGCCTGCATGGAACACCAGCAAGATGGAC |
| | | | CCCACAACCGGATTCGTGAACCTGCTGTCT |
| | | | GTGAAGTACGAGAACATGGAGAAGTCCAAG |
| | | | GAATTCATCAACAAAATCAAGGACATTAAT |
| | | | TTCAAGGAAGATGACTGTGGCAAATATTAC |

TABLE S15B-continued

Nucleotide Sequences Group 15

| SEQ ID NO | Ref. | Group | Sequence |
|---|---|---|---|
| | | | GAGTTTCATATCGATTTCAACGAATTCACC |
| | | | GATAAGGGCAAGGATACCAAGACTGACTGG |
| | | | AATATCTGTTCTTTCGGCAAGCGCATTGAC |
| | | | AATGCCAGGAATCAGAAGGGGGACTTCGAG |
| | | | AGCAAGATGATCGATCTGACAAATGAGTTC |
| | | | CACAACCTGTTCAAGAAGTATGGCATCAAT |
| | | | GACAACTCCAACCTCAAGGAGGACATTCTG |
| | | | AACGTCAAAGAGGCCAAATTCTACAAGGAG |
| | | | TTCATCAATCTGTTCAAGCTGATGCTGCAG |
| | | | ATCAGGAACAGCGAGAGTAACGAGAAGGTG |
| | | | GACTTCCTGCAGTCCCCCGTGAAGAATAAC |
| | | | AAGGGCGAATTCTTCAACTCCAACAACGTG |
| | | | AACGGAAATGAGGCCCCTGAGAACGCCGAC |
| | | | GCCAATGGGGCCTACAACATTGCCCGGAAA |
| | | | GGCTGTGGATTGTTAACCAGATCAAGACT |
| | | | ATGCCGGACTCACAGATGCACAAGATCAAG |
| | | | CTGGCTATGAAGAATCAGGAATGGCTGCTG |
| | | | TTCGCCCAGAAAGGGAACGTGTGA |
| 366 | ID406 | 10 | ATGGCAACGATTGAGAATTTTGTGGACAA |
| | | | GAGAATGGGTATTCTCGGTCAATTACTTTA |
| | | | AGAAATAAGTTGATTCCTATTGGAAAAACA |
| | | | GCGAACAACTTAAAACAATTTTTGGAAAAG |
| | | | GATCAAGAAAGAGCTGATGTTTATCCTGAA |
| | | | ATTAAAAAGTTAATTGATGAAATACATAGA |
| | | | GGCTTTATTGAAGATACTCTTTCTAAGTTT |
| | | | TCATTTGTATGGGAACCTTTATTTGATGAT |
| | | | TTTGAATTATATCAAATGAAAAGGATAAA |
| | | | TCTAAAAAGCCACAAAGAAAAAAGATTTA |
| | | | GAGAAATTTCAAAGTGGAGCAAGAAAAAAA |
| | | | ATTGTGGAAGCGTTTAAGAAGCATCCAGAC |
| | | | TATGACAAACTTTTTTAAAGATGGATTATTT |
| | | | AAGGAATTATTACCAGCTTTGATAAAAAT |
| | | | TCTTCTGATTCTGAAATATCAAATAAGAA |
| | | | GAAGCATTAAAAGTTTTTGATAGATTTAGT |
| | | | ACATATTTTGTTGGTTTTCACGAAAATAGA |
| | | | AAAAAATATGTATAGCGAAGAAGACAAATCT |
| | | | ACTGCAATAAGCTATAGAATAGTTAATGAA |
| | | | AACTTTCCAAAATTCTATGCCAATGTAAAA |
| | | | TTGTACAATTATATAAAAGAAAATTTCCCA |
| | | | AAAATTATTTCTGAGACAGAGGAATCTTTA |
| | | | AAGAATCATTTGAACGGAAAAAGACTTGAT |
| | | | GAGATTTTTAATGCAGAATCTTTTAATGAT |
| | | | GTATTAGCACAAAGTGAATTGACTTCTAT |
| | | | AACACTGTTATTGGTGGTATTTCTACAGAA |
| | | | ACAGAAAAGTTCAAGGTTTGATGAAAAA |
| | | | ATAAATCTTGCAAGACAAAAACTTCCCGCA |
| | | | GAAGAAAAAAATAAACTACGGGGTAAAATG |
| | | | GTAGTTTTGTTTAAGCAGATTTTAAGTGAT |
| | | | AGAGGAACATCATCTTTTATTCCTGTTGGT |
| | | | TTTAACAACAAGGAAGAAGTCTATTCTTCT |
| | | | GTAAAATCATTCAATGATGAATTTGTAAAT |
| | | | ATTTCTGTTTGTGAAACAAAGAATTATTC |
| | | | AAACAAGTTGCAGAGTTTAATCTTAGTGAA |
| | | | ATTTATGTTCCAGCAAAATCTTTAACAAAC |
| | | | TTTTCGCAAAATATTTTGGTTCTTGGTCA |
| | | | ATTCTAACAGAAGGACTTTTCTTATTAGAA |
| | | | AAAGATAAAGTGAAAAAAGCATTATCAGAA |
| | | | AATAAAGAAGAAAAATCAACAAAGAGATT |
| | | | GCAAAAAAGATTATTCTTTGGATGAGTTA |
| | | | CAAGTTGCTTATGAAGATTTGTAATGAA |
| | | | CATAATTTTTCAGTAGAGAAAAATTGCAAA |
| | | | GATTATTTTGATGTTGTTGATTATCGATCA |
| | | | GAAAATGAAAATCTGATAAGAAAAAATT |
| | | | TCTATACTTTCAGCTATTACAGAATCTTAT |
| | | | TCAAAAATAGATTTTGAAAATATTCATGAT |
| | | | TTACAACAAGAAAAGAAGCCGCTACACCA |
| | | | ATTAAACATATTTGGATGAAGTTCAGAAT |
| | | | TTATATCATCATCTAAAACTTGTTGATTAT |
| | | | CGTGGGGAAGAACAAAAAGATTCAAACTTT |
| | | | TATTCAAATTGGATGAAATCATTACTCAG |
| | | | CTTTCAGAAATTATTCCTTTATACAATAAA |
| | | | GTTAGAAACTTTGTTACAAAGAAACCTGGT |
| | | | GAAATGAAGAAGATAAAATTGAATTTTGAT |
| | | | TGTCCTACTCTAGCTAATGGATGGGATGAA |
| | | | AATAAAGAATCTTCAAATGATGCAATAATT |
| | | | TTAAGAAAGGATGGTAAATATTATTTAGGA |
| | | | ATTTTTAATCCAAATAATAAACCAAAATTT |
| | | | TCTAAAAATCGAAAACATTTCTGAATCATAC |
| | | | TACGAAAAAATGGTGTATAAACTTTTACCA |
| | | | GGCCCAAACAAGATGTTACCAAAAGTCTTT |
| | | | TTTTCAACAAAAGGACAAGAAACATTTTTG |
| | | | CCACCAAAAGATTTGCTCTTAGGATATGAT |
| | | | GCAGGTAAACATAAAAAAGGTGATGCTTTT |
| | | | GATAAAGAATTTATGTATAAATTAATTGAT |
| | | | TGGTTTAAAGATGCAATTAATCGTCATGAA |
| | | | GATTGGAAAAAATTTAATTTTGTATTCTCT |
| | | | CCTACAAAATCTTACGAAGATATGAGTGGT |
| | | | TTTTATAGGGAAGTTGAATTACAAGGGTAT |
| | | | AAAGTTTCTTTTCAAAAAATATCTGACACA |
| | | | GAAATAAATTCTTTTGTAAGCAACGGAAAA |
| | | | CTTTTCCTTTTCCAAATATACAATAAAGAC |
| | | | TTTGCTTTAAAAGCTTCTGGAAAGAAAAAT |
| | | | CTTCATACACTTTATTGGGAAAATCTTTTT |
| | | | AGTGAAGAAAACTTAAAAGATGTTTGTCTA |
| | | | AAATTAAATGGAGAAGCAGAATTATTCTGG |
| | | | AGAAAACCAAGTTTGAACAAAGAAAAAGTT |
| | | | ACTGTTCACGAAAAAGGTTCAATTCTTGTA |
| | | | AATAGGACAACAAATGACGGAAAGTCAATT |
| | | | CCAGAAGACATTTATCAAGAAATTTATCAA |
| | | | TTCAAAAATAAAATGAAAGATAAAATTTCT |
| | | | GACAATATTTCTATACAGAATGATGATGGT |
| | | | AAAGTCATTACGATTACAGTAACTTTGGAA |
| | | | AATAAGCAAAAAGAAAAATTCACAGAAAAT |
| | | | TATAAAGTTGTATATAAAACTGCAACTCAC |
| | | | TATATTACAAAGGATAATCGTTTTACAGAA |
| | | | GACACTTATCTTTTCCATTGTCCTATTACA |
| | | | ATGAACTTTAAGGCACCTGATAAATCAAAT |
| | | | AAAGAATTTAATAATCATGTTCTTGAAGTA |
| | | | TTGAGTGGTAATCCTAATGTAAAAATTATT |
| | | | GGATTGGATCGAGGCGAAAGACACCTTATT |
| | | | TATCTTTCATTGATAAATCAAAAAGGTGAA |
| | | | ATTGAACTTCAAAAAACATTAAATCTTGTT |
| | | | GAACAAGTTAGAAATGATAAAACTGTAAA |
| | | | GTAAATTATCAAGAAAACTTGTACACAAA |
| | | | GAAGATGATAGAGATAAGGCTCGTAAAAGC |
| | | | TGGCAAACAATTGGAAATATCAAAGAATTA |
| | | | AAAGAAGGCTATCTTTCAAATGTTGTTCAT |
| | | | GAAATTGCAAAAATGATGGTTGAACATAAC |
| | | | GCAATTGTTGTTATGGAAGATTTGAATTTT |
| | | | GGATTTAAGCGGGGCGTTTTGCTGTAGAA |
| | | | AGACAGATTTATCAAAATTTGAAATATG |
| | | | TTAATTGAAAAACTAAATTATCTTGTTTC |
| | | | AAAGATAAAAAGGTAACAGAGCCTGGTGGT |
| | | | GTTCTTAATGCTTATCAATTAACAAATAAA |
| | | | TCTGCAAATGTATCTGATGTCTACAGACAA |
| | | | TGTGGATGGCTTTTCTATATTCCTGCTGCT |
| | | | TATACTTCAAAGATTGATCCAAAAACTGGT |
| | | | TTTGCAAATCTTTTTATTACAAAAGGCTTA |
| | | | ACAAACGTAGAAAAGAAAAAAGAATTTTTT |
| | | | GATAAGTTAGATTCTATTCGTTATGACTCA |
| | | | AAAGAAGATTGTTTTGTTTTTGGGATTTGAT |
| | | | TATGGAAAAATCTGTGATAATGCTGATTTT |
| | | | AAGAAAAAGTGGGAAGTTTATACAAAAGGG |
| | | | GAACGACTTGTTTACAATAAAACTGAACGC |
| | | | AAGAATATTAACATAAATCCAACAGAAGCA |
| | | | TTGAAGTCAATCTTTGATGACTTTGGAATA |
| | | | AATTGGAATAATGAAGAAATTTTATTGAT |
| | | | TCTGTCCATACAATCCAAGCTGAAAAATCA |
| | | | AATGCAAAATTCTTTGATACACTTTTAAGA |
| | | | ATGTTTAATGCAACTTTGCAAATGAGAAAT |
| | | | TCTATTCCAAACACGGAAATTGACTACTTA |
| | | | ATTTCTCCTGTAAAATCAGAAGATGGAACT |
| | | | TTCTTTGATTCTAGAGAAGAATTGAAAAAA |
| | | | GGTGAAAACGCAAAATTACCAATTGATGCA |
| | | | GATGCAAACGGAGCTTATCACATTGCATTA |
| | | | AAAGGTTTGTATTTGTTGGAAAATGACTTT |
| | | | AACCGTAATGATAAAGGTGTAATTCAAAAC |

TABLE S15B-continued

Nucleotide Sequences Group 15

| SEQ ID NO | Ref. | Group | Sequence |
|---|---|---|---|
| | | | ATCTCCAACGCCGATTGGTTTAAGTTTGTT
CAGGAGAAAGAATATAGGGATTAA |
| 362 | ID411 | 10 | TTGTTGTTTATAATTGAGTTTGAGGAGAAA
ATTATGAAAACAATTGAAAATTTTGTGGC
CAAAAAAATGGTTATTCTCGCTCTATTACC
TTGCGAAACAGGTTGATTCCAATCGGAAAA
ACAGAAGAAAATATTGAAAAACTACAACTT
CTTGATAATGACATTAAGCGTTCAAAGGCT
TATGTTGAAGTCAAGTCGATGATAGATGAT
TTTCACCGCGCATTCATAGAAGAAGTTCTT
TCTAAGGCAAAACTTGAATGGGGGCCATTA
TATGACCTGTTTGATTTGTTCCAGAATGAA
AAAGACAAGCATAAGAAAAGTAAAATAAAA
AAAGAGTTAGAAACATTGAAAGGTGTGATG
CGAAAACAGATTGTAAAAAGTTTAAGGAT
GATGATAGGTTTGACAAGCTTTTCAAGAAA
GAAATTTTAACTGAATTGTTCCAACTGTA
ATAAAGGCTGATGAATCAGGAACTATATCC
GACAAGCGGGCAGCTCTTGATGTGTTTAAG
GGATTTGCGACATATTTTACAGGTTTTCAC
CAAAACAGACAAAATATGTATAGCGAAGAG
GCTAAGGCTACCGCTATCAGCAATAGAATA
GTTAATGAAAATTTTCCAAAGTTCTATGCA
AATGTAAAGGTTTTTGAATGCTTGCAGAAAA
GAGTATCCTGCAATTATCACTGAAACGGAA
GAGGCTCTTTCTGAAATCCTTAATGGCAAA
AAACTGGCTGATATTTTAGCGCGGACGGA
TTTAATTCAGTTTTGAGCCAGAGCGGCATT
GATTTTTATAATACGATAATTGGCGGCATT
GCAGGAGAGGCAGGAACTCAAAAGTTGCAA
GGCATAAACGAAAAAATAAATCTTGCCCGC
CAGCAGCTTCCTACAGAAGAAAAAAACAAG
CTCAAGCGGAAGATGAGTGTATTATACAAG
CAGATTTTAAGCGACAGAAGTACGGCTTCT
TTTATTCCGATTGGATTTGAATCAAGCGAT
GAAGTTTACGAATCTGTAAAACAGTTTAAG
GAACAGTCATTAGATAATGTCATTTCCGCT
GCAAAAGAATTGTTTGAAAAATCTGATTAT
GATTTGAGTCAGATTTATGTTCCTGCAAAA
GAAGTCACCGACTTTTCATTGAAGCTTTTT
GGCAATTGGTCGATTTTGCATGACGGGCTT
TTCTTAATTGAGAAAGATAATTCAAAGAAG
ACTTTCACGGAAAAGCAGATTGAAAACCTA
AGAAAAGAAATCGCAAAAACAGATTGTTCT
CTTGCGGATTTGCAGAACGCCTATGAGCGA
TGGGCAAAAGAAAATGATGTTAAAGCTGAA
AAGACTGTAAAGAACTATTTCAAAATTGCA
GAGCTTCGCGCTGATGGAAAATCAAGAGAA
AAAACTTCTGTGGAGATTCTGAATAAAATT
GAATCGACCTTTGAGAAAATTGATTTTGAA
AAGCGAGATAATCTTATAAAGGAAAAGGAG
ACGGCAACTCCGATAAAAGAATTCCTCGAC
G\AAGTTCAGAACCTTTATCATTATCTGAA
ATTGGTTGACTATCGTGGTGAAGAACAGAA
GGACACCGATTTTTATTCAAAATATGATGA
AATACTGCAGACGCTTTCTGAAATTGTTCC
GCTTTATAATAAGGTGAGAAATTTTGTCAC
AAAAAAAGCCTAATGAGGTGAAGAAAGTAAA
GCTGAATTTTGATAATGTTTCATTAGCAAA
AGGTTGGGATGTAAACAAGAATCTGATTA
TACATGTATTTTACTCCGCAGAAGTGGACT
GTATTATTTAGGAGTACTAAATCCAAAGA
TAAGCCAAAGTTTGACTCTGAGAACAATGG
TGAAACAAGTATAAATAAGAATGATTGTTA
CGAAAAGCTTGTTTATAAGTATTTTAAGGA
TGTAACAACCATGATTCCAAATGTTCGAC
ACAGTTAAATGATGTTAAACAGCATTTTAA
AACTCTAATGAAGATTATATTTTGAAAA
CAATAATTTTATTAAGCCACTTGTAATTTC
AAAGAGAATTTTGATCTGAATAATAAAAC
TTTTGATGAAAGAAATGTTTCAAATTGA
CTATTATAGGAATACTGGCGATTTAAAAGG
TTATACAGAAGCTGTAAAAGATTGGATTTC |
| | | | ATTTTGTATGACCTTTGTTCATTCCTATAA
AAGTACCTGTATATATGATTTTTCTTCCTT
AGGCGATTGCAGCCAATTTAAGCAGGTTGA
TCAGTTTTACAAAGAGATTAATCTTTTACT
TTATAAATTTGGTTTGTGAATGTAACTGC
TGAAAAAATCAATTCCCTTGTAGATTCCGG
TAAACTTTTCCTTTTCCAAATCTACAACAA
AGACTATTCAACTGGTAAAGACGGCGGAAA
CGGTTCAACAGGCAAAAGATCTTCATAC
GATGTATTGGGAAAATTTGTTCAGCGAAGA
AAATCTTCGGGATGTCTGCCTTAAATTGAA
TGGAGATGCAGAACTTTTCTGGGGGATGCA
AATCCTGATGTGAAAGATGTATGCCATAAA
AAAGGTTCAGTTCTTGTAAACAGAACGACC
TCTGACGGTGAGACAATCCCAGAAGAAATA
TATCAAGAAATTTACAAGTTCAAAAATCCT
AATAAACAGGAAAAAAGCTTTAAACTTTCT
GATACCGCAAAAGAACTTCGGATAGTGGA
AAAGTCGGTTCAAAGAGGCCAAATTTGAC
ATTATCAAAGACCGTCATTTTACACAGAAA
ACATATCTGTTCCATTGTCCGATTACCATG
AATTTTAAGGCTCCTGAAATTACAGGAAGA
AAATTCAATGAAAAAGTCCAGCAGGTGTTG
AAAAATAATCCTGATGTAAAGGTTATTGGT
CTTGACCGTGGCGAGCGTCATTTGATTTAT
CTTTCGCTTATCAATCAAAAGGGCGAAATC
GAGCTTCAGAAAACGCTCAACCTTGTGGAA
CAGGTTCGCAATGATAAAACTGTTTCTGTA
AATTATCAGGAGAAACTAGTCCAGAAGGAG
GGAGAGCGTGGCAAGGCTCGCAAGAACTGG
CAAACAATCAGCAATATCAAAGAATTAAAA
GAAGGATATCTTTCAAACATTGTTCACGAG
ATTGCAAAATTAATGGTAGAAAATAATGCA
ATTGTCGTAATGGAAGATTTGAATTTTGGA
TTTAAACGAGGACGATTTGCGGTTGAGCGT
CAAGTTTACCAGAAGTTTGAAAACATGCTC
ATTGAAAAGCTTAATTATCTTGTGTTCAAG
GATAAGAAGTCGCTGAGCCTGGTGGCGTT
TTGAATGCATATCAGCTAACTGACAAAGTT
GCAAATGTAAGCGATGTTGGCAAACAGTGG
GGATGGATTTTCTATATTCCGGCTGCGTAT
ACTTCAAAAATTGATCCAAAGACTGGTTTT
GCAAATCTTTTTTATACTGCAGGGCTTACA
AATATCGAAAAGAAAAAAGATTTCTTTGAT
AAGTTTGATTCTATTCGCTATGCAGAAAAA
ACAGATTCGTTTGTGTTCACTTTTGATTAC
AGCGACTTTGGAGATAATGCGGACTTTAAG
AAAAAATGGGAACTCTATTCTAGGGGAGG
CGACTTGTTTTCAGCAAGGCAGAGAAATCT
GTTGTTCATGTAAATCCAACAGAAAACTTA
AAGGCATTGTTCGACAAGCAAGGGATAAAC
TGGAGTTCAGAAGATAATATTATAGACCAG
ATACAGGCAGTGCAGGCTGAAAGAGAAAAT
TGCGCTTTTTATGACGGCCTATACCGTTCG
TTTACTGCAATTCTCCAGATGCGAAATTCC
GTTCCTAATTCTTCAAAAGGGGAAGATGAT
TATCTGATTTCACCAGTCATGGCAGAAGAT
GGAAGTTTCTATGACAGCCGAGAGGAAGCT
GAAAAAGGAAAACGACTGACGGAAAATGG
ATTTCAAAGCTTCCTGTTGATGCTGATGCC
AACGCGCGTACCATATTGCGCTAAAGGGA
CTTTATCTTTTGCAGAATAATTTCAATTTA
AATGAAAATGGCTATATTGAAAACATTTCA
AACGCCGACTGGTTTAAGTTTGTTCAGGAG
AAGGAATATGCAAAATAA |
| 30 | ID415 | 2 | ATGGAGATGAGATTAATGGTTGTATTTGAG
GATTTCACAAAACAGTATCAAGTGTCGAAA
ACATTAAGATTGAATTGATTCCCCAAGGA
AAGACCTTGGAAAATATGGAACGGGCAGGT
ATTGTAAAGGAGATTGTCAACGTAGTGAG
GACTATCAAGAAGCAAAGAAAATTATCGAT
AAAATTTATAAACACATTTTAAATTCATCC
ATGGCTAAGGTTGAAATTGATTGGTCAACC |

TABLE S15B-continued

Nucleotide Sequences Group 15

| SEQ ID NO | Ref. | Group | Sequence |
|---|---|---|---|
| | | | TTAGCGGAAGCAACTAAAGAATTTAGGAAA
AATAAGGATAAAAAGAAATATGAAAATGTT
CAAGTTCGTGTTAGAAAGAAACTGCTTGAA
GATATAAAAAATCAAACAATCACAGTAGAA
AAGGGGGCGAAAGATCTTTATAAGGCAATG
TTTGAGAAAGAAATCGTTACGGGGGAAGTA
TGTGCTGCATTTCCCGAAATAGATTTAACG
GATGAAGAAAAAGCCATATTGGATAAATTT
AAAAAATTTACAACGTATTTTACAGGATTC
TTTGAAAACAGAAAAAATATCTTTACTGAT
GAAGGTATCAGTACTTCTTTTACGTATCGA
CTGGTAAATGATAATTTTATAAAATTTTAT
GATAATTGCAATCTTTATAAAGATATTATT
GCCTCTGTTCCGGGATTGAAGGGCGAGTTT
AAGAAATGTTTAAAGACTTACAGCTTTTT
TCTAAATGTAGACTAGAAGAAATCTTTGAG
ACTTCTTTTTATAATCATATTTTGACACAA
GACGGTATCGATGAATTTAATCAACTCTTG
GGCGGAATTTCCGCAAAAGAGGGAGAAAAA
AAGAAACAAGGCTTAAATGAAGTTATCAAT
TTAGCTATGCAAAAAGACGAGGGAATTAGA
AATAAGTTAAGATATAGAGCTCATAAATTT
ACGCCTCTTTTTAAACAATTTTAAATGAC
CGGTCTACCTTGTCATTTATACCCGAAACT
TTTGAAAATGACCGTAAAGTTTTGGAGTCT
ATAGAGGCATATAAATTATATTTATCTGAA
CAGAATATATTAGAAAAAGCACAAGAATTA
CTGTGCAGCATGAATCGGTATGATTCTCGA
AAGTTAAGTATTGACGGTAAGTATATTTCA
AAGCTGTCTCAGGCTATCTTTAACTCTTGG
AGTAAGATTCATGATGGAATAAAAGATTAT
AAGAAGTCTTTACTTCCTAAAGAAACGAAA
AAAGCTTTGAAAGGCATTGACATGGAATTA
AAGCAGGGAGTAAGCGTGCAGGACATATTG
GACGCACTTCCTGAAGAAAATTTTCATGAA
GTTATAGTTGATTATACTCATAATCTTGTG
CAAAAATGTCAAGCTGTATTGAGCGGGTCT
TTGCCTGGTAATATTGAAACGGATAAAGAT
AAAACAGATATTAAGCTAGTAATGGACCCA
CTGTTGGATTTGTATCGGTTTTTAGAAATA
TTCAGCCATGATAATTCCCAAGGTGTAAAA
ACGGCATTTGAAGAACAATTGATGGAAATT
TTGGCAGATATGAAGGAAATCATCCCTTTG
TACAATAAGGTTAGAAATTTCGCTACTAAA
AAAGCATATTCAGTAGAAAAATTTAAACTT
AATTTTAATGTAGCGACATTGGCATCCGGT
TGGGATCAGAACAAAGAAAATGCAAATTGT
GCAATTATACTTCGAAAGAAGGATATGTAT
TATTTGGGTATATATAATTCTTCCAATCAG
CCGTTTTTTGAAATAGTCGAGCAAGATGAT
GACGGGTTTGAAAGATGATATATAAACAA
TTTCCCGATTTTAATAAAATGTTACCTAAA
TGTACAGTATCACGTAAAAATGATGTTGCA
GTTCATTTTAATAAGTCTGATGCAGATTTT
TTATTAAATGTAAATACGTTCAGTAAACCG
CTTCTTATAACTAAAGAGTCTATGATTTA
GGCACTAAAACTGTTCAAGGAAAAAAGAAA
TTCCAGATTGATTATAAGAGAAACACTGGG
GATGAGGCCGGGTATAAGGCTGCCTTGAAG
GCATGGATTGACTTCGGGAAAGAGTTCATA
AAGGCTTATGAAAGCACAGCTATATACGAT
ATATCATTGTTACGAAAAAGCGAAGATTAT
CCCGATATCCAATCTTTTTACAAGGATGTA
GACAATATATGCTATAAAATCGCCTTTCAA
AAGATCTCTGATGAAGCAGAAATCAATGT
GTAGAAAATGGTTCTTTATATCTTTTTAAA
TTGCACGCCAAGGATTTTCGCCCGGTGCC
AGTGGGAAACCGAATTTACACACGCTGTAT
TGGAAGTATGTATTTGAAGAAGAAAACTTG
AAAGATGTAGTTGTGAAATTAAACGGACAG
GCAGAATTGTTTTATCGCCCCGAAGTTTA
ACGCAGCCAGTTGTACATAAAAAAGGAGAG
AAAATTCTTAATAAAACTACTCGATCGGGA
GAACCCGTTCCCGATGACGTATATGTTGAG
TTGTCTCACTTTATTAAAAACGGAAGTACG
GGCAATTTGTCGAATGAGGCAAAAAAGTGG
CAGGCGAAGGTAAGCGTTCGCAATGTGCCT
CATGAGATTACAAAGGATCGCAGATTTACA
CAGGATAAATTCTTTTTCCATGTGCCTCTG
ACTTTGAATTATAAATCTGCCAATACACCC
CGGCGCTTTAATGATTTAGTCAAAGCGTAT
ATTAAGAAGAATCCGGATGTGCATGTCATT
GGAATTGACCGGGGCGAACGAAATCTTATT
TATGCAGTTGTTATTGACGGAAAAGGTAAG
ATTGTTGAACAGCCGGTCCTTCAATATCGTA
GGGGGCTATAATTACCAAGAAAAATTATGG
CAAAAAGAAATGAACGGCAGGCAGCGAGA
CGCGATTGGACCGCTGTCACCACGATTAAG
GATTTAAAACAAGGATACCTGTCCGCTGTT
GTACATGAGTTATCTAAAATGATAGTGAAG
TATAAGGCTATTGTTGTACTTGAAAACCTC
AACGCGGGTTTTAAACGTATGCGAGGCGGC
ATTGCGGAACGATCCGTTTACCAGCAGTTT
GAAAAGGCCTTAATCGATAAATTAAATTAT
TTAGTTTTTAAAGATGCAGTCCCTGCGGTG
CCCGGAGGAGTCTTAAATGCGTATCAATTA
ACCGACAAATTTGACAGTTTCAGTAAAATG
AACCAGCAAACGGGATTTTTGTTTTACGTG
CCCGCAGCTTATACTTCTAAAATTGATCCC
TTAACAGGATTTGTAGATTGTTTTAATTGG
AAACAAATAAAGAAAAATACTGAGAGTCGG
AAGGCATTTATTGGTTTGTTTGAATCGCTT
TGCTATGACGCGAATACGAATAATTTTGTG
CTTCATTATAGGCATAAGGCTAACCGATAT
GTTCGTGGCGGTAATTTGGACATTACGGAA
TGGGATATACTGATTCAAGAAAATAAAGAA
GTAGTAAGTAAAACCGGCAAATCCTATCGC
CAAGGGAAACGCATTATCTACAGGAAAGGC
TCCGGTAATCATGGGGAAGCGTCTCCCTAC
TATCCTCACGAAGAACTGCAATCTTTTGTT
GAAGAACATGGAATTTCATATAAAGCAGGC
AAGAACATCTTACCCAAGATTAAAGCCGCT
AATGACAACGCATTGGTAGAAAAGTTGCAC
TACATTATTAAGGCCGTGCTTCAATTACGC
AACAGCAATAGTGAAACCGGAGAGGATTAT
ATCAGTTCTCCCGTTGAAGGCCGCAAAGAT
TGGTGCTTTGATAGTAGAGCTGCAGATGAT
GCGTTACCACAAGATGCTGATGCTAACGAT
GCCTTTCATATTGCCATGAAAGGATTGTTA
TTAATGAAACGGATTCGGAATGATGAAAAG
CTTGCAATTAGTAATGAAGATTGGCTGAAT
TACATACAAGGATTGAGAAGCTAA |
| 487 | ID419 | 14 | ATGCCAAATATTTCTGAATTTAGTGAACAT
TTTCAAAAGACTTTAACATTAAGAAACGAG
TTAGTACCTGTAGGGAAAAACTCTTGAAAAC
ATCATTTCTTCTAATGTATTGATAAATGAT
GAAAAAGAAGTGAAGACTATAAAAAGGCT
AAAGAGATTATAGACTCTTATCATCAAGAG
TTTATAGAAAAATCTCTTTCATCTGTAACT
GTTGATTGGAATGATTTGTTCTCCTTTTA
TCCAGAAAAGAACCAGAAGACTATGAAGAA
AAGCAGAAGTTCCTAGAAGAGCTAGAAAGT
ATTCAGCTTGAAAAGAGAAAAAGCATTGTT
AATCAATTTGAACAATATGATTTTGGTTCA
TACACAGATTTAAAGGGAAAGAAAACAAAG
GAACTAAGTTTTGAGAGCCTTTTTAAATCG
GAGTTATTTGATTTTCTTTTACCTAATTTT
ATAAAAAATAATGAGACAAAAAATAATA
AGTAGTTTAACAAGTTTACTTCTTACTTT
ACTGGTTTTTACGAAAATAGAAAGAATTTA
TATACATCAGCACCTTTGCCAACGGCTGTT
GCTTACAGAAGTTAACGATAACTTTCCT
AAATTCATTTCTAACCAAAAGATCTTTCGT
GTGTGGAAAGACAATGTTCCTAAGTTTGTA
GAAATAGCGAAAACTAAACTAAGAGAAAAA
GGTATTTCTGATTTAAATTTAGAATTTCAA
TTTGAGTTATCAAATTTCAATTCATGTTTA |

TABLE S15B-continued

Nucleotide Sequences Group 15

| SEQ ID NO | Ref. | Group | Sequence |
|---|---|---|---|
| | | | AATCAAACAGGAATTGATTCTTACAATGAA CTGATAGGTCAACTAAACTTTGCAATTAAC CTTGAATGTCAGCAAGACAAGAATTTAAGT GAGCTTTTAAGGAAGAAAAGAAGCCTTAAA ATGATACCTCTGTATAAACAGATTTTATCA GATAAAGACTCTTCATTCTGCATTGACGAA TTTGAAAATGATGAATCAGCGATAAATGAT GTTATTTCTTTTTATAAGAAAGCGGTTTGT GAAAACGGTCCTCAACGAAAACTATCCGAA TTATTACGTGATTTGTCATCTCACGATCTT GATAAGATATTTATTCAAGGTAAAAACTTA AATTCAATTTCTAAAAATTTATTTGGAGGA AAAAACTGGTCTTTACTCAGAGATGCCATT ATTGCAGAAAAGTCAAAAGACAAAAGCTAT AAAAAGGCTATAAAGACAAATCCTTCATCA GACGATCTTGACAGAATTCTATCTAAAGAT GAATTTTCAATTTCATACTTATCAAAGGTA TGCGGAAAAGATTTGTGCGAAGAAATTGAT AAATTTATTAAAAATCAAGATGAACTGTTA ATTAAAATAAATTCACAAGCTTGGCCAAGC TCTCTTAAGAATAGTGACGAGAAAAATCTC ATAAAATCACCATTAGATTTCTTGTTAAAT TTTTATAGATTTGCTCAGGCATTTTCTTCA AATAATACAGATAAGGATATGTCTTTATAT GCCGATTATGATGTATCTTTATCTTTATTG GTCTCTGTAATAGGTCTTTATAACAAAGTT AGAAACTATGCAACCAAGAAGCCTTATAGT CTTGAAAAAATCAAATTAAATTTTGAAAAT CCAAACTTAGCAACAGGTTGGAGTGAAAAC AAAGAAAATGATTGTTTATCAGTAATCTTA TTAAAAAATCAAATTTACTATTTAGGTATT TTAAACAAAAGTAATAAACCTAATTTTTCT AATGGTATTTCTCAACAACCTTCTTCAGAA AGCTGCTATAAAAGATGAGATACTTATTA TTCAAAGGATTCAATAAAATGTTACCTAAA TGTGCTTTTACAGGAGAAGTAAAAGAGCAT TTTAAGGAATCTTCTGAAGATTATCATCTT TATAACAAGGATACTTTTGTTTATCCTCTT GTTATTAACAAAGAGATTTTTGATCTAGCA TGCAGTACAGAAAAAGTAAAAAAATTTCAA AAAGCATATGAAAAGGTCAACTATGCAGAA TATAGGCAATCACTGATAAAGTGGATTTCT TTTGGCCTTGAATTTTTATCTGCATACAAA ACTACATCTCAATTTGATTTATCAAATTTA AGAAAACCTGAAGAATATAGCGATCTAAAA GAATTTTATGAAGATGTAGACAATCTAACA TACAAGATAGAATTAGTAGATTTAAAAGAA GAATATGTAGACTCTTTGGTTGAAAATGGG CAACTGTTTTTATTCGAAATAAGAAATAAA GATTTTGCAAAAAAATCTAGTGGAACTCCT AATTTACATACTCTTTATTTTAAAAGCATA TTTGATCCGAGAAATTTAAAAAATTGTATT GTCAAACTTAATGGTGAAGCCGAGATTTTC TACAGAAAGAAAAGCTTGAAGATTGATGAC ATAACAGTTCATCAAAAGGAAGTTGCCTT GTTAATAAAGTTTTCTTCAATCCTGATTCT GGCAAATCCGAGCAGATCCCAGACAAAATC TATAACAATATTTATGCATATGTTAATGGC AAATCAACAACTTTATCAAAAGAAGATGAG TTTTTTTACACAAAAGCCACAATAAAAAAA GCAACTCACGAGATCGTAAAAGATAAACGC TTTACTGTGGATAAATTCTTTTTCCACTGC CCAATTACGATTAACTATAAATCTAAAGAT AAGCCAACTAAATTTAATGACAGAGTATTA GATTTCTTAAGAAAGAATGAAGATATCAAC ATTATTGGAATAGATCGAGGTGAGAGAAAT CTTATCTATGCAACTGTAATTAATCAAAAA GGTGAAATTATTGATTGCAGATCTTTTAAT ACAATCAAGCACCAGTCTTCATCTGTAAAT TATGATGTAGATTATCACAATAAATTGCAA GAAAGAGAAAATAATAGAAAAGAAGAAAAG AGATCTTGGAACAGTATTTCTAAAATTGCA GACCTTAAAGAAGGATATCTTTCAGCTGTA ATTCATGAGATAGCATTAATGATGGTTAAA TACAATGCTATTGTTGTTATGGAAAATTTG AATCAAGGCTTTAAGAGAATCAGAGGCGGA ATCGCTGAAAGATCTGTGTACCAAAAATTT GAGAAAATGCTGATAGATAAACTTAATTAT TTTGTTATTAAAAATGAGAATTGGACAAAT CCTGGAGGAGTTCTCAATGGTTATCAGTTG ACAAACAAGGTATCAACAATCAAAGAAATT GGTAATCAATGTGGTTTTTTATTCTACGTA CCTGCAGCATATACTTCAAAGATAGATCCT TCAACTGGTTTTGTTAATTTGTTGAATTTC AATAAATACAATAACTCAGATAAACGAAGA GAGCTTATTTGCAAATTTTACGAGATTTGT TATGTGCAAAATGAGAATTTATTTAAATTT TCTATAGATTATGGAAAATTATGCCCTGAT AGCAAAATACCTGTAAAAAATGGGATATT TTCTCTTATGGGAAAAGAATTGTTAAGGAA GATCTAAAGACTGGTTATATGAAAGAAAAT CCAGAATACGATCCAACTGAAGAACTTAAG AATTTGTTTACATTAATGAGGGTTGAGTAT AAAAAAGGTGAAAATATACTTGAAACAATA TCTATCAGAGACATGAGTAGAGAATTTTGG AATTCTCTTTTCAAGATTTTCAAAGCTATA TTACAAATGAGAAATAGTCTAACTAATTCA CCGGTAGACAGACTTTTTATCTCCAGTAAAG GGAAAAGATGCAACCTTCTTTGATACAGAT AAAGTTGATGGAACTAAATTTGAAAATTA AAAGATGCTGATGCAAATGGAGCTTATAAC ATTGCATTAAAAGGCTTATTAATTCTCAAA AATAATGATTCTGTAAAGACAGACAAAGAA CTAAAAAATGTAAAGAAGGTAAGTCTTGAG GATTGGTTAAAGTTTGTTCAAATCTCCTTA AGAGGATAA |

TABLE S15C

Corresponding Guide Sequences Group 15

| SEQ ID NO | Associated Cas12a protein |
|---|---|
| 355-360 | ID405 |
| 69-71 | ID414 |
| 355-360 | ID406 |
| 355-360 | ID411 |
| 28-29 | ID415 |
| 542-563 | ID419 |

TABLE S15D

Enzyme and PAM Sequences of Table Ex. 9.2
As described in Example 9, PAM sequence recognition was identified for each protein in Table Ex. 9.2. In the table, the following lettering refers to the following:
A = Adenine, C = Cytosine, G = Guanine,
T = Thymine, R = A or G, Y = C or T,
S = G or C, W = A or T, D = A or G or T,
H = A or C or T, K = G or T, M = A or C,
N = any base, B = C or G or T,
V = A or C or G).

| SEQ ID NO: | Ref. | PAM SEQUENCE |
|---|---|---|
| SEQ ID NO: 333 | ID401 | YTTV |
| SEQ ID NO: 386 | ID402 | TTTC |
| SEQ ID NO: 403 | ID403 | TTV |
| SEQ ID NO: 387 | ID404 | TTTV |

TABLE S15D-continued

Enzyme and PAM Sequences of Table Ex. 9.2
As described in Example 9, PAM sequence recognition was identified for each protein in Table Ex. 9.2. In the table, the following lettering refers to the following:
A = Adenine, C = Cytosine, G = Guanine,
T = Thymine, R = A or G, Y = C or T,
S = G or C, W = A or T, D = A or G or T,
H = A or C or T, K = G or T, M = A or C,
N = any base, B = C or G or T,
V = A or C or G).

| SEQ ID NO: | Ref. | PAM SEQUENCE |
|---|---|---|
| SEQ ID NO: 334 | ID405 | YTTV |
| SEQ ID NO: 335 | ID406 | YTTV |
| SEQ ID NO: 32 | ID407 | TTTV |
| SEQ ID NO: 401 | ID408 | YTTV |
| SEQ ID NO: 339 | ID409 | CTC |
| SEQ ID NO: 331 | ID411 | TTTV |
| SEQ ID NO: 440 | ID412 | TTTV |
| SEQ ID NO: 118 | ID413 | TTTV |
| SEQ ID NO: 58 | ID414 | TTTV |
| SEQ ID NO: 20 | ID415 | TTTV |
| SEQ ID NO: 442 | ID416 | DTTV |
| SEQ ID NO: 336 | ID417 | TTTV |
| SEQ ID NO: 564 | ID418 | HTTV |
| SEQ ID NO: 445 | ID419 | TTTV |
| SEQ ID NO: 446 | ID420 | TTTV |
| SEQ ID NO: 119 | ID421 | TTTV |
| SEQ ID NO: 1 | ID422 | HTTTV |
| SEQ ID NO: 404 | ID423 | GNTTC |
| SEQ ID NO: 3 | ID424 | WTTV |
| SEQ ID NO: 447 | ID425 | TTTV |
| SEQ ID NO: 448 | ID426 | DTTTN |
| SEQ ID NO: 33 | ID427 | TTTM |
| SEQ ID NO: 400 | ID428 | DNCYC |
| SEQ ID NO: 59 | ID429 | TTTV |
| SEQ ID NO: 57 | ID432 | TTTV |
| SEQ ID NO: 402 | ID433 | DHYTC |

P. Cas12a Mutant Type V Nuclease and Associated Sequences

The following are protein coding sequences (i.e., nucleotide sequences) and the corresponding protein sequences for various mutant Type V nucleases, and in particular, those based on making a variety of substitutions in ID405 (SEQ ID NO: 304), ID414 (SEQ ID NO: 58), and ID418 (SEQ ID NO: 564) as described in Table S8 of the Examples.

1. Protein Coding Sequences (SEQ ID Nos: 566-583)

| ID | Protein coding sequence |
|---|---|
| 405-1 (D169R) | atggccagaataattgacgaattctgcggacagatgaacgggtattcaag aagcataacactgagaaaccggctggtccctatcggcaagacagaggaga atctgaagcaatttctggagaaggacctggagcgggccacggcctatcct gacatcaagaacctgatcgatgccatccaccggaacgtgattgaggacac cctgagcaaggtggccctgaactggaatgaaattttcaatatcctggcca cctaccagaacgagaaggataagaaaaaaaaagctgccattaagaaggac ctggaaaagctccaaagcggcgccagaaaaaagatagtggaggcttttaa gaagaaccccgatttcgagaagctgttcaaggaaggactgttcaaggaac tgctgcctgagctgatcaaaagcgctcctgtggacgagatcgccgttaag accaaggctctcgagtgcttcaacaggttcagcacctactttaccggctt ccacagaaacagaaagaacatgtacagcgaagaagccaagagcacagcca tctcttatagaatcgtgaacgaaaatttccccaagttcttcgcaaacatc aagctattcaactacctgaaggagcacttccctagaatcataatcgatac cgaggaatctctgaaggactacctgaagggcaagaagctggatagcgtgt tctctatcgatggcttcaactctgtgctggctcagagcggcatcgatttc tacaacaccgtgatcggaggaattagcggagaggccggcaccaagaagac acagggcttaaatgagaagattaacctggccagacagcagctgagcaagg aagagaagaataagctgagaggaaagatggtggtgctgtttaaacagatc ctgagcgacagagaaacctcttctttcatccctgttggctttgccaataa ggaagaggtctacagcaccgtgaaggagttcaataacagcatcgctgaga aagccgtgagcaaggtgcgggacttgttcctgcacagagaggaattcacc ctgaatgagatcttcgttcctgccaaaagcctgacagatttctctcaggc catctttggaagctggagcatcctgtctgagggcctgttcctgcttgaaa aggacagcatgaagaaagccctgtctgaaagccaggaggaaaagatcaac aaggaaatcgccaagaaggactgcagcttcaccgaactgcagctcgccta cgagagatactgcaccgagcacaacctacccgtggagaaattctgtaaag attactttgacatcgttgactatagaggcaacggagctaagagcgagaag acgaaggtgagcatcctgtccgagatcctggaaacattcctccaactgga |

| ID | Protein coding sequence |
|---|---|
| | ctttgaccacatccaggacctgcaacaggagaagaacgccgccatccca<br>tcaaggcatacctggacgaagtgcagaacctgtaccaccacctgaagctg<br>gtggactaccggggagaggaacagaaggattctaccttctacagcaagca<br>cgacgagattctcaccgatctgagccagattgtgcctctgtacaacaagg<br>tacgaaactttgtgaccaaaaagctgggcgagagcaagaagattaagctg<br>aacttcgactgtcctaccctggccaacggctgggatgagaatcaggagag<br>cagcaacgacgcgatcatcctgcggaaggacggcaagtactacctgggca<br>tctacaaccctaataacaagcccaagttcgccaagaaagacagtatcgtg<br>ggcgactgctacgagaagatggcctacaagcagattgccctgccaatggg<br>cctcggcgccttcgtgagaaagtgcttcggcaccgcacagaagtacggct<br>ggggatgtcctgagaactgcctgaactccgaaggcaagatcatcatcaag<br>gacgaggaagccaagggcaacctcgaagccatcatcgactgctacaaaga<br>cttcctgaacaagtacgagaaggatggattcaagtacaaggactacaact<br>tcagcttcctggactctgccagctacgagaaactgagcgacttcttcaac<br>gacgtcaagcctcagggctacaagctgagcttaccagcatcccactgag<br>cgaaatcgataagatgatcgacgagggcaaactgtttctgtttcagatct<br>acaataaagacttcgccaagaaggccacaggcaaaaagaacctgcacacc<br>ctgtactgggagaatctgttttctgtcgagaacctgcaagatgtggtgct<br>gaagttgaacggcgaggccgaactgttctggcggaggctagtatcaaga<br>aggataaggtgatcgtgcataagaagggcagtatccttgtgaaccgaacc<br>accaccgacggcaagagcatcccagaagccatctaccaggagatttacca<br>gctgaagaacaagatggccgatagcatcagcgacgaggccaaaagactgc<br>tggagtccggcacagtggtgtgcaaggtcgcgacacacgatatcgtgaag<br>gacaaacacttcacagagaacacatacctgttccactgtcctatcaccat<br>gaactttaaggccaaggacagaacaaataaagaattcaacaaccacgtgc<br>tggaggtgctgaacaagaaccccgatatcaaagtgatcggactggacaga<br>ggagagagacacctgctgtacctgtccctgatcaaccagaaaggcgagat<br>cgagtgtcagaaaacactgaacctggtcgagcaggtgcggaacgacaaga<br>ccgtgtccgtgaattaccatgagaagctggtgcacaaggagggtcccgt<br>gacgccgcccgcaagaactggcagaccatcggcaatatcaaggagctgaa<br>agaaggctacctgagcgctgtggtgcatgagatcgctagcctgatggtca<br>aacacaacgccatcgtggtgatggaagatctgaatttcggctttaagcgg<br>ggtagattcgctgtgtgaacggcagatctaccaaaagttcgagaatatgct<br>gatcgagaaacttaactacctggtattcaaagataggaaggtgaccgagc<br>ccggcggagtgctgaacgcctatcagctcgctaacaagagcgccaaggtg<br>acagacgtgtacaagcagtgtggctggctgttctacatccctgctgccta<br>caccagcaagatcgaccccagaaccggcttcgccaatctgttcatcacca<br>agggtctgaccaacgtggaaaagaagaaagaattcttcggcaagtttgac<br>tcgataaggtacgacgccacagagagctgcttcgtgttcagcttcgatta<br>cgccaaaatctgcgacaacgcggactataagaaaaagtgggacgtgtata<br>caagaggcaccagacttgtgtacaacaaaaccgaaagaaaaaacgtgtca<br>gtgaaccctacagaggaactgcagtgcgtgttcgatgaattcggcatcaa<br>gtggaacaccggcgaggatctgatcgagagcatcagcctgatccccgccg<br>agaagtctaacgccaagttcttcgacgtgctgctgagaatgttcaacgcc<br>acactgcagatgagaaacagcgtgccaaacaccgacaccgactacctggt<br>gtcccctgtgaaggccgaggacggcagcttctttgatagcagagaggaat<br>tcaaaaagggcggcgatgcccggctgcctatcgattgcgacgccaacggc<br>gcctaccacattgccctgaagggcctgtacctgctgctgaacgatttcaa<br>tagagataataaaggcgtgatccaaaacatctctaacaaggactggttca<br>agttcgtgcaggagaaggtgtacaaggac (SEQ ID NO: 566) |
| 405-2<br>(D169<br>R/R95<br>0K/R9<br>54A) | atggccagaataattgacgaattctgcggacagatgaacgggtattcaag<br>aagcataacactgagaaaccggctggtccctatcggcaagacagaggaga<br>atctgaagcaatttctggagaaggacctggagcggggccacggcctatcct<br>gacatcaagaacctgatcgatgccatccaccggaacgtgattgaggacac<br>cctgagcaaggtggccctgaactggaatgaaattttcaatatcctggcca<br>cctaccagaacgagaaggataagaaaaaaaaagctgccattaagaaggac<br>ctggaaaagctccaaagcggcgccagaaaaaagatagtggaggcttttaa<br>gaagaaccccgatttcgagaagctgttcaaggaaggactgttcaaggaac<br>tgctgcctgagctgatcaaaagcgctcctgtggacgagatcgccgttaag<br>accaaggctctcgagtgcttcaacaggttcagcacctacttaccggctt<br>ccacagaaacagaaagaacatgtacagcgaagaagccaagagcacagcca<br>tctcttatagaatcgtgaacgaaaatttcccccaagttcttcgcaaacatc<br>aagctattcaactacctgaaggagcacttccctagaatcataatcgatac<br>cgaggaatctctgaaggactacctgaagggcaagaagctggatagcgtgt<br>tctctatcgatggcttcaactctgtgctggctcagagcggcatcgatttc<br>tacaacaccgtgatcggaggaattagcggagaggccggcaccaagaagac<br>acagggcttaaatgagaagattaacctggccagacagcagctgagcaagg<br>aagagaagaataagctgagaggaaagatggtggtgctgttaaacagatc<br>ctgagcgacagagaaacctcttctttcatccctgttggctttgccaataa<br>ggaagaggtctacagcaccgtgaaggagttcaataacagcatcgctgaga<br>agccgtgagcaaggtgcgggacttgttcctgcacagagaggaattcacc<br>ctgaatgagatcttcgttcctgccaaaagctgacagatttctctcaggc<br>catctttggaagctggagcatcctgtctgagggcctgttcctgcttgaaa<br>aggacagcatgaagaaagccctgtctgaaagccaggaggaaaagatcaac<br>aagaaatcgccaagaaggactgcagcttcaccgaactgcagctcgccta<br>cgagagatactgcaccgagcacaacctaccgtggagaaattctgtaaag |

| ID | Protein coding sequence |
|---|---|
| | attactttgacatcgttgactatagaggcaacggagctaagagcgagaag<br>acgaaggtgagcatcctgtccgagatcctggaaacattcctccaactgga<br>ctttgaccacatccaggacctgcaacaggagaagaacgccgccatccca<br>tcaaggcatacctggacgaagtgcagaacctgtaccaccacctgaagctg<br>gtggactaccggggagaggaacagaaggattctaccttctacagcaagca<br>cgacgagattctcaccgatctgagccagattgtgcctctgtacaacaagg<br>tacggaactttgtgaccaaaaagctgggcgagagcaagaagattaagctg<br>aacttcgactgtcctaccctggccaacggctgggatgagaatcaggagag<br>cagcaacgacgcgatcatcctgcgggaaggacggcaagtactacctgggca<br>tctacaaccctaataacaagcccaagttcgccaagaaagacagtatcgtg<br>ggcgactgctacgagaagatggcctacaagcagattgccctgccaatggg<br>cctcggcgccttcgtgagaaagtgcttcggcaccgcacagaagtacgct<br>ggggatgtcctgagaactgcctgaactccgaaggcaagatcatcatcaag<br>gacgaggaagccaagggcaacctcgaagccatcatcgactgctacaaaga<br>cttcctgaacaagtacgagaaggatggattcaagtacaaggactacaact<br>tcagcttcctggactctgccagctacgagaaactgagcgacttcttcaac<br>gacgtcaagcctcagggctacaagctgagcttaccagcatcccactgag<br>cgaaatcgataagatgatcgacgagggcaaactgtttctgtttcagatct<br>acaataaagacttcgccaagaaggccacaggcaaaaagaacctgcacacc<br>ctgtactgggagaatctgtttctgtcgagaacctgcaagatgtggtgct<br>gaagttgaacggcgaggccgaactgttctggcgggaggctagtatcaaga<br>aggataaggtgatcgtgcataagaagggcagtatccttgtgaaccgaacc<br>accaccgacggcaagagcatcccagaagccatctaccaggagatttacca<br>gctgaagaacaagatggccgatagcatcagcgacgaggccaaaagactgc<br>tggagtccggcacagtggtgtgcaaggtcgcgacacacgatatcgtgaag<br>gacaaacacttcacagagaacacatacctgttccactgtcctatcaccat<br>gaactttaaggccaaggacagaacaaataaagaattcaacaaccacgtgc<br>tggaggtgctgaacaagaaccccgatatcaaagtgatcggactggacaga<br>ggagagagacacctgctgtacctgtccctgatcaaccagaaaggcgagat<br>cgagtgtcagaaaacactgaacctggtcgagcaggtgcggaacgacaaga<br>ccgtgtccgtgaattaccatgagaagctggtgcacaaggagggatccaaa<br>gacgccgccgccaagaactggcagaccatcggcaatatcaaggagctgaa<br>agaaggctacctgagcgctgtggtgcatgagatcgctagcctgatgctca<br>aacacaacgccatcgtggtgatggaagatctgaatttcggctttaagcgg<br>ggtagattcgctgtggaacggcagatctaccaaaagttcgagaatatgct<br>gatcgagaaacttaactacctggtattcaaagataggaaggtgaccgagc<br>ccggcggagtgctgaacgcctatcagctcgctaacaagagcgccaaggtg<br>acagacgtgtacaagcagtgtggctggctgttctacatccctgctgccta<br>caccagcaagatcgaccccagaaccggcttcgccaatctgttcatcacca<br>agggtctgaccaacgtggaaagaagaaagaattcttcggcaagtttgac<br>tcgataaggtacgacgccacagagagctgcttcgtgttcagcttcgatta<br>cgccaaaatctgcgacaacgcggactataagaaaaagtgggacgtgtata<br>caagaggcaccagacttgtgtacaacaaaaccgaaagaaaaaacgtgtca<br>gtgaaccctacagaggaactgcagtgcgtgttcgatgaattcggcatcaa<br>gtggaacaccggcgaggatctgatcgagagcatcagcctgatccccgccg<br>agaagtctaacgccaagttcttcgacgtgctgctgagaatgttcaacgcc<br>acactgcagatgagaaacagcgtgccaaacaccgacaccgactacctggt<br>gtcccctgtgaaggccgaggacggcagcttctttgatagcagagaggaat<br>tcaaaaagggcggcgatgcccggctgcctatcgattgcgacgccaacggc<br>gcctaccacattgccctgaagggcctgtacctgctgctgaacgatttcaa<br>tagagataataaaggcgtgatccaaaacatctctaacaaggactggttca<br>agttcgtgcaggagaaggtgtacaaggac (SEQ ID NO: 567) |
| 405-3<br>(D169<br>R/N55<br>9R/Q5<br>65R) | atggccagaataattgacgaattctgcggacagatgaacgggtattcaag<br>aagcataacactgagaaaccggctggtccctatcggcaagacagaggaga<br>atctgaagcaatttctggagaaggacctggagcgggccacggcctatcct<br>gacatcaagaacctgatcgatgccatccaccgaacgtgattgaggacac<br>cctgagcaaggtggccctgaactggaatgaaattttcaatatcctggcca<br>cctaccagaacgagaaggataagaaaaaaaaagctgccattaagaaggac<br>ctggaaaagctccaaagcggcgccagaaaaaagatagtggaggcttttaa<br>gaagaaccccgatttcgagaagctgttcaaggaaggactgttcaaggaac<br>tgctgcctgagctgatcaaaagcgctcctgtggacgagatcgccgttaag<br>accaaggctctcgagtgcttcaacaggttcagcacctactttaccggctt<br>ccacagaaacagaaagaacatgtacagcgaagaagccaagagcacagcca<br>tctcttatagaatcgtgaacgaaaatttccccaagttcttcgcaaacatc<br>aagctattcaactacctgaaggagcacttccctagaatcataatcgatac<br>cgaggaatctctgaaggactacctgaagggcaagaagctggatagcgtgt<br>tctctatcgatggcttcaactctgtgctggctcagagcggcatcgatttc<br>tacaacaccgtgatcggaggaattagcggagaggccggcaccaagaagac<br>acagggcttaaatgagaagattaacctggccagacagcagctgagcaagg<br>aagagaagaataagctgagaggaaagatggtggtgctgtttaaacagatc<br>ctgagcgacagagaaacctcttcttttcatccctgttggcttttgccaataa<br>ggaagaggtctacagcaccgtgaaggagttcaataacagcatcgctgaga<br>agccgtgagcaaggtgcgggacttgttcctgcacagagaggaattcacc<br>ctgaatgagatcttcgttcctgccaaaagcctgacagatttctctcaggc<br>catctttggaagctggagcatcctgtctgagggcctgttcctgcttgaaa<br>aggacagcatgaagaaagccctgtctgaaagccaggaggaaaagatcaac |

| ID | Protein coding sequence |
|---|---|
| | aaggaaatcgccaagaaggactgcagcttcaccgaactgcagctcgccta cgagagatactgcaccgagcacaacctacccgtggagaaattctgtaaag attactttgacatcgttgactatagaggcaacggagctaagagcgagaag acgaaggtgagcatcctgtccgagatcctggaaacattcctccaactgga ctttgaccacatccaggacctgcaacaggagaagaacgccgccatcccca tcaaggcatacctggacgaagtgcagaacctgtaccaccacctgaagctg gtggactaccggggagaggaacagaaggattctaccttctacagcaagca cgacgagattctcaccgatctgagccagattgtgcctctgtacaacaagg tacgaactttgtgaccaaaaagctgggcgagagcaagaagattaagctg aacttcgactgtcctaccctggccagaggctgggatgagaatagagagag cagcaacgacgcgatcatcctgcggaaggacggcaagtactacctgggca tctacaaccctaataacaagcccaagttcgccaagaaagacagtatcgtg ggcgactgctacgagaagatggcctacaagcagattgccctgccaatggg cctcggcgccttcgtgagaaagtgcttcggcaccgcacagaagtacggct ggggatgtcctgagaactgcctgaactccgaaggcaagatcatcatcaag gacgaggaagccaagggcaatctagaagccatcatcgactgctacaaaga cttcctgaacaagtacgagaaggatggattcaagtacaaggactacaact tcagcttcctggactctgccagctacgagaaactgagcgacttcttcaac gacgtcaagcctcagggctacaagctgagcttaccagcatcccactgag cgaaatcgataagatgatcgacgagggcaaactgttctgtttcagatct acaataaagactcgccaagaaggccacaggcaaaaagaacctgcacacc ctgtactgggagaatctgttttctgtcgagaacctgcaagatgtggtgct gaagttgaacggcgaggccgaactgttctggcgggaggctagtatcaaga aggataaggtgatcgtgcataagaagggcagtatccttgtgaaccgaacc accaccgacggcaagagcatcccagaagccatctaccaggagatttacca gctgaagaacaagatggccgatagcatcagcgacgaggccaaaagactgc tggagtccggcacagtggtgtgcaaggtcgcgacacacgatatcgtgaag gacaaacacttcacagagaacacatacctgttccactgtcctatcaccat gaactttaaggccaaggacagaacaaataaagaattcaacaaccacgtgc tggaggtgctgaacaagaaccccgatatcaaagtgatcggactggacaga ggagagagacacctgctgtacctgtccctgatcaaccagaaaggcgagat cgagtgtcagaaaacactgaacctggtcgagcaggtgcggaacgacaaga ccgtgtccgtgaattaccatgagaagctggtgcacaaggagggggtcccgt gacgccgcccgcaagaactggcagaccatcggcaatatcaaggagctgaa agaaggctacctgagcgctgtggtgcatgagatcgctagcctgatggtca aacacaacgccatcgtggtgatggaagatctgaatttcggctttaagcgg ggtagattcgctgtggaacggcagatctaccaaaagttcgagaatatgct gatcgagaaacttaactacctggtattcaaagataggaaggtgaccgagc ccggcggagtgctgaacgcctatcagctcgctaacaagagcgccaaggtg acagacgtgtacaagcagtgtggctggctgttctacatccctgctgccta caccagcaagatcgaccccagaaccggcttcgccaatctgttcatcacca agggtctgaccaacgtggaaaagaagaaagaattcttcggcaagtttgac tcgataaggtacgacgccacagagagctgcttcgtgttcagcttcgatta cgccaaaatctgcgacaacgcggactataagaaaaagtgggacgtgtata caagaggcaccagacttgtgtacaacaaaaccgaaagaaaaaacgtgtca gtgaaccctacagaggaactgcagtgcgtgttcgatgaattcggcatcaa gtggaacaccggcgaggatctgatcgagagcatcagcctgatccccgccg agaagtctaacgccaagttcttcgacgtgctgctgagaatgttcaacgcc acactgcagatgagaaacagcgtgccaaacaccgacaccgactacctggt gtcccctgtgaaggccgaggacggcagcttctttgatagcagagaggaat tcaaaaagggcggcgatgcccggctgcctatcgattgcgacgccaacggc gcctaccacattgccctgaagggcctgtacctgctgctgaacgatttcaa tagagataataaaggcgtgatccaaaacatctctaacaaggactggttca agttcgtgcaggagaaggtgtacaaggac (SEQ ID NO: 568) |
| 405-4 (C554R) | atggccagaataattgacgaattctgcggacagatgaacgggtattcaag aagcataacactgagaaaccggctggtccctatcggcaagacagaggaga atctgaagcaatttctggagaaggacctggagcgggccacggcctatcct gacatcaagaacctgatcgatgccatccaccggaacgtgattgaggacac cctgagcaaggtggccctgaactggaatgaaatttttcaatatcctggcca cctaccagaacgagaaggataagaaaaaaaaagctgccattaagaaggac ctggaaaagctccaaagcggcgccagaaaaaagatagtggaggcttttaa gaagaaccccgatttcgagaagctgttcaaggaaggactgttcaaggaac tgctgcctgagctgatcaaaagcgctcctgtggacgagatcgccgttaag accaaggctctggagtgcttcaacaggttcagcacctactttaccggctt ccacgacaacagaaagaacatgtacagcgaagaagccaagagcacagcca tctcttatagaatcgtgaacgaaaatttcccccaagttcttcgccaacatc aagctattcaactacctgaaggagcacttccctagaatcataatcgatac cgaggaatctctgaaggactacctgaaggcaagaagctggatagcgtgt tctctatcgatggcttcaactctgtgctggctcagagcggcatcgatttc tacaacaccgtgatcggaggaattagcggagaggccggcaccaagaagac acagggcttaaatgagaagattaacctggccagacagcagctgagcaagg aagagaagaataagctgagaggaaagatggtggtgctgtttaaacagatc ctgagcgacagagaaacctcttctttcatccctgttggctttgccaataa ggaagaggtctacagcaccgtgaaggagttcaataacagcatcgctgaga aagccgtgagcaaggtgcgggacttgttcctgcacagagaggaattcacc ctgaatgagatcttcgttcctgccaaaagcctgacagatttctctcaggc |

| ID | Protein coding sequence |
|---|---|
| | catctttggaagctggagcatcctgtctgagggcctgttcctgcttgaaa aggacagcatgaagaaagccctgtctgaaagccaggaggaaaagatcaac aaggaaatcgccaagaaggactgcagcttcaccgaactgcagctcgccta cgagagatactgcaccgagcacaacctacccgtggagaaattctgtaaag attactttgacatcgttgactatagaggcaacggagctaagagcgagaag acgaaggtgagcatcctgtccgagatcctggaaacattcctccaactgga ctttgaccacatccaggacctgcaacaggagaagaacgccgccatcccca tcaaggcatacctggacgaagtgcagaacctgtaccaccacctgaagctg gtggactaccggggagaggaacagaaggattctaccttctacagcaagca cgacgagattctcaccgatctgagccagattgtgcctctgtacaacaagg tacggaactttgtgaccaaaaagctgggcgagagcaagaagattaagctt aacttcgacagacctaccctggccaacggctgggatgagaatcaggagag cagcaacgacgcgatcatcctgcggaaggacggcaagtactacctgggca tctacaaccctaataacaagcccaagttcgccaagaaagacagtatcgtg ggcgactgctacgagaagatggcctacaagcagattgccctgccaatggg cctcggcgccttcgtgagaaagtgcttcggcaccgcacagaagtacggct ggggatgtcctgagaactgcctgaactccgaaggcaagatcatcatcaag gacgaggaagccaagggcaacctcgaagccatcatcgactgctacaaaga cttcctgaacaagtacgagaaggatggattcaagtacaaggactacaact tcagcttcctggactctgccagctacgagaaactgagcgacttcttcaac gacgtcaagcctcagggctacaagctgagcttttaccagcatcccactgag cgaaatcgataagatgatcgacgagggcaaactgtttctgtttcagatct acaataaagacttcgccaagaaggccacaggcaaaaagaacctgcacacc ctgtactgggagaatctgttttctgtcgagaacctgcaagatgtggtgct gaagttgaacggcgaggccgaactgttctggcgggaggctagtatcaaga aggataaggtgatcgtgcataagaagggcagtatccttgtgaaccgaacc accaccgacggcaagagcatcccagaagccatctaccaggagatttacca gctgaagaacaagatggccgatagcatcagcgacgaggccaaaagactgc tggagtccggcacagtggtgtgcaaggtcgcgacacacgatatcgtgaag gacaaacacttcacagagaacacatacctgttccactgtcctatcaccat gaactttaaggccaaggacagaacaaataaagaattcaacaaccacgtgc tggaggtgctgaacaagaaccccgatatcaaagtgatcggactggacaga ggagagagacacctgctgtacctgtccctgatcaaccagaaaggcgagat cgagtgtcagaaaacactgaacctggtcgagcaggtgcggaacgacaaga ccgtgtccgtgaattaccatgagaagctggtgcacaaggaggggtcccgt gacgccgcccgcaagaactggcagaccatcggcaatatcaaggagctgaa agaaggctacctgagcgctgtggtgcatgagatcgctagcctgatggtca aacacaacgccatcgtggtgatggaagatctgaatttcggctttaagcgg ggtagattcgctgtggaacggcagatctaccaaaagttcgagaatatgct gatcgagaaacttaactacctggtattcaaagataggaaggtgaccgagc ccggcggagtgctgaacgcctatcagctcgctaacaagagcgccaaggtg acagacgtgtacaagcagtgtggctgctgttctacatccctgctgccta caccagcaagatcgaccccagaaccggcttcgccaatctgttcatcacca agggtctgaccaacgtggaaaagaagaaagaattcttcggcaagtttgac tcgataaggtacgacgccacagagagctgcttcgtgttcagcttcgatta cgccaaaatctgcgacaacgcggactataagaaaaagtgggacgtgtata caagaggcaccagacttgtgtacaacaaaaccgaaagaaaaaacgtgtca gtgaaccctacagaggaactgcagtgcgtgttcgatgaattcggcatcaa gtggaacaccggcgaggatctgatcgagagcatcagcctgatccccgccg agaagtctaacgccaagttcttcgacgtgctgctgagaatgttcaacgcc acactgcagatgagaaacagcgtgccaaacaccgacaccgactacctggt gtcccctgtgaaggccgaggacggcagcttctttgatagcagagaggaat tcaaaaagggcggcgatgcccggctgcctatcgattgcgacgccaacggc gcctaccacattgccctgaagggcctgtacctgctgctgaacgatttcaa tagagataataaaggcgtgatccaaaacatctctaacaaggactggttca agttcgtgcaggagaaggtgtacaaggac (SEQ ID NO: 569) |
| 405-5 (C554 N) | atggccagaataattgacgaattctgcgcgacagatgaacgggtattcaag aagcataacactgagaaaccggctggtccctatcggcaagacagaggaga atctgaagcaatttctggagaaggacctggagcgggccacggcctatcct gacatcaagaacctgatcgatgccatccaccggaacgtgattgaggacac cctgagcaaggtggccctgaactggaatgaaattttcaatatcctggcca cctaccagaacgagaaggataagaaaaaaaaagctgccattaagaaggac ctggaaaagctccaaagcggcgccagaaaaaagatagtggaggcttttaa gaagaacccgatttcgagaagctgttcaaggaaggactgttcaaggaac tgctgcctgagctgatcaaaagcgctcctgtggacgagatcgccgttaag accaaggctctggagtgcttcaacaggttcagcacctacttttaccggctt ccacgacaacagaaagaacatgtacagcgaagaagccaagagcacagcca tctcttatagaatcgtgaacgaaaatttccccaagttcttcgcaaacatc aagctattcaactacctgaaggagcacttccctagaatcataatcgatac cgaggaatctctgaaggactacctgaagggcaagaagctggatagcgtgt tctctatcgatggcttcaactctgtgctggctcagagcggcatcgatttc tacaacaccgtgatcggaggaattagcggagaggccggcaccaagaagac acagggcttaaatgagaagattaacctggccagacagcagctgagcaagg aagagaagaataagctgagaggaaagatggtggtgctgtttaaacagatc ctgagcgacagagaaacctcttctttcatccctgttggctttgccaataa ggaagaggtctacagcaccgtgaaggagttcaataacagcatcgctgaga |

| ID | Protein coding sequence |
|---|---|
| | aagccgtgagcaaggtgcgggacttgttcctgcacagagaggaattcacc<br>ctgaatgagatcttcgttcctgccaaaagcctgacagatttctctcaggc<br>catctttggaagctggagcatcctgtctgagggcctgttcctgcttgaaa<br>aggacagcatgaagaaagccctgtctgaaagccaggaggaaaagatcaac<br>aaggaaatcgccaagaaggactgcagcttcaccgaactgcagctcgccta<br>cgagagatactgcaccgagcacaacctacccgtggagaaattctgtaaag<br>attactttgacatcgttgactatagaggcaacggagctaagagcgagaag<br>acgaaggtgagcatcctgtccgagatcctggaaacattcctccaactgga<br>ctttgaccacatccaggacctgcaacaggagaagaacgccgccatcccca<br>tcaaggcatacctggacgaagtgcagaacctgtaccaccacctgaagctg<br>gtggactaccggggagaggaacagaaggattctaccttctacagcaagca<br>cgacgagattctcaccgatctgagccagattgtgcctctgtacaacaagg<br>tacgaactttgtgaccaaaaagctgggcgagagcaagaagattaagctt<br>aacttcgacaaccctaccctggccaacggctgggatgagaatcaggagag<br>cagcaacgacgcgatcatcctgcggaaggacggcaagtactacctgggca<br>tctacaaccctaataacaagcccaagttcgccaagaaagacagtatcgtg<br>ggcgactgctacgagaagatggcctacaagcagattgccctgccaatggg<br>cctcggcgccttcgtgagaaagtgcttcggcaccgcacagaagtacggct<br>ggggatgtcctgagaactgcctgaactccgaaggcaagatcatcatcaag<br>gacgaggaagccaagggcaacctcgaagccatcatcgactgctacaaaga<br>cttcctgaacaagtacgagaaggatggattcaagtacaaggactacaact<br>tcagcttcctggactctgccagctacgagaaactgagcgacttcttcaac<br>gacgtcaagcctcagggctacaagctgagctttaccagcatcccactgag<br>cgaaatcgataagatgatcgacgagggcaaactgtttctgtttcagatct<br>acaataaagacttcgccaagaaggccacaggcaaaaagaacctgcacacc<br>ctgtactgggagaatctgttttctgtcgagaacctgcaagatgtggtgct<br>gaagttgaacggcgaggccgaactgttctggcgggaggctagtatcaaga<br>aggataaggtgatcgtgcataagaagggcagtatccttgtgaaccgaacc<br>accaccgacggcaagagcatcccagaagccatctaccaggagatttacca<br>gctgaagaacaagatggccgatagcatcagcgacgaggcaaaagactgc<br>tggagtccggcacagtggtgtgcaaggtcgcgacacacgatatcgtgaag<br>gacaaacacttcacagagaacacataccatgttccactgtcctatcaccat<br>gaactttaaggccaaggacagaacaaataaagaattcaacaaccacgtgc<br>tggaggtgctgaacaagaaccccgatatcaaagtgatcggactggacaga<br>ggagagagacacctgctgtacctgtccctgatcaaccagaaaggcgagat<br>cgagtgtcagaaaacactgaacctggtcgagcaggtgcggaacgacaaga<br>ccgtgtccgtgaattaccatgagaagctggtgcacaaggagggtcccgt<br>gacgccgcccgcaagaactggcagaccatcggcaatatcaaggagctgaa<br>agaaggctacctgagcgctgtggtgcatgagatcgctagcctgatggtca<br>aacacaacgccatcgtggtgatggaagatctgaatttcggctttaagcgg<br>ggtagattcgctgtggaacggcagatctaccaaaagttcgagaatatgct<br>gatcgagaaacttaactacctggtattcaaagataggaaggtgaccgagc<br>ccggcggagtgctgaacgcctatcagctcgctaacaagagcgccaaggtg<br>acagacgtgtacaagcagtgtggctggctgttctacatccctgctgccta<br>caccagcaagatcgaccccagaaccggcttcgccaatctgttcatcacca<br>agggtctgaccaacgtggaaaagaagaaagaattcttcggcaagtttgac<br>tcgataaggtacgacgccacagagagctgcttcgtgttcagcttcgatta<br>cgccaaaatctgcgacaacgcggactataagaaaagtgggacgtgtata<br>caagaggcaccagacttgtgtacaacaaaaccgaaagaaaaaacgtgtca<br>gtgaaccctacagaggaactgcagtgcgtgttcgatgaattcggcatcaa<br>gtggaacaccggcgaggatctgatcgagagcatcagcctgatccccgccg<br>agaagtctaacgccaagttcttcgacgtgctgctgagaatgttcaacgcc<br>acactgcagatgagaaacagcgtgccaaacaccgacaccgactacctggt<br>gtccctgtgaaggccgaggacggcagcttctttgatagcagagaggaat<br>tcaaaaaggcggcgatgcccggctgcctatcgattgcgacgccaacggc<br>gcctaccacattgccctgaagggcctgtacctgctgctgaacagatttcaa<br>tagagataataaaggcgtgatccaaaacatctctaacaaggactggttca<br>agttcgtgcaggagaaggtgtacaaggac (SEQ ID NO: 570) |
| 405-6<br>(L860<br>Q) | atggccagaataattgacgaattctgcggacagatgaacgggtattcaag<br>aagcataacactgagaaaccggctggtccctatcggcaagacagaggaga<br>atctgaagcaatttctggagaaggacctggagcgggcacggcctatcct<br>gacatcaagaacctgatcgatgccatccaccggaacgtgattgaggacac<br>cctgagcaaggtggccctgaactggaatgaaattttcaatatcctggcca<br>cctaccagaacgagaaggataagaaaaaaaaagctgccattaagaaggac<br>ctggaaaagctccaaagcggcgccagaaaaaaagatagtggaggctttaa<br>gaagaaccccgatttcgagaagctgttcaaggaaggactgttcaaggaac<br>tgctgcctgagctgatcaaaagcgctcctgtggacgagatcgccgttaag<br>accaaggctctggagtgcttcaacaggttcagcacctactttaccggctt<br>ccacgacaacagaaagaacatgtacagcgaagaagccaagagcacagcca<br>tctcttatagaatcgtgaacgaaaatttccccaagttcttcgcaaacatc<br>aagctattcaactacctgaagggacacttccctagaatcataatcgatac<br>cgaggaatctctgaaggactacctgaagggcaagaagctggatagcgtgt<br>ctctatcgatggcttcaactctgtgctggctcagagcggcatcgatttc<br>tacaacaccgtgatcggaggaattagcggagaggccggcaccaagaagac<br>acagggcttaaatgagaagattaacctggccagacagcagctgagcaagg<br>aagagaagaataagctgagaggaaagatggtggtgctgtttaaacagatc |

| ID | Protein coding sequence |
|---|---|
| | ctgagcgacagagaaacctcttctttcatccctgttggctttgccaataa<br>ggaagaggtctacagcaccgtgaaggagttcaataacagcatcgctgaga<br>aagccgtgagcaaggtgcgggacttgttcctgcacagagaggaattcacc<br>ctgaatgagatcttcgttcctgccaaaagctgacagatttctctcaggc<br>catctttggaagctggagcatcctgtctgagggcctgttcctgcttgaaa<br>aggacagcatgaagaaagccctgtctgaaagccaggaggaaaagatcaac<br>aaggaaatcgccaagaaggactgcagcttcaccgaactgcagctcgccta<br>cgagagatactgcaccgagcacaacctacccgtggagaaattctgtaaag<br>attactttgacatcgttgactatagaggcaacggagctaagagcgagaag<br>acgaaggtgagcatcctgtccgagatcctggaaacattcctccaactgga<br>ctttgaccacatccaggacctgcaacaggagaagaacgccgccatcccca<br>tcaaggcatacctggacgaagtgcagaacctgtaccaccacctgaagctg<br>gtggactaccggggagaggaacagaaggattctaccttctacagcaagca<br>cgacgagattctcaccgatctgagccagattgtgcctctgtacaacaagg<br>tacggaactttgtgaccaaaaagctgggcgagagcaagaagattaagctg<br>aacttcgactgtcctaccctggccaacggctgggatgagaatcaggagag<br>cagcaacgacgcgatcatcctgcggaaggacggcaagtactacctgggca<br>tctacaaccctaataacaagcccaagttcgccaagaaagacagtatcgtg<br>ggcgactgctacgagaagatggcctacaagcagattgccctgccaatggg<br>cctcggcgccttcgtgagaaagtgcttcggcaccgcacagaagtacgct<br>ggggatgtcctgagaactgcctgaactccgaaggcaagatcatcatcaag<br>gacgaggaagccaagggcaacctcgaagccatcatcgactgctacaaaga<br>cttcctgaacaagtacgagaaggatggattcaagtacaaggactacaact<br>tcagcttcctggactctgccagctacgagaaactgagcgacttcttcaac<br>gacgtcaagcctcagggctacaagctgagcttaccagcatcccactgag<br>cgaaatcgataagatgatcgacgagggcaaactgtttctgtttcagatct<br>acaataaagacttcgccaagaaggccacaggcaaaaagaacctgcacacc<br>ctgtactgggagaatctgtttttctgtcgagaacctgcaagatgtggtgct<br>gaagttgaacggcgaggccgaactgttctggcgggaggctagtatcaaga<br>aggataaggtgatcgtgcataagaagggcagtatccttgtgaaccgaacc<br>accaccgacggcaagagcatcccagaagccatctaccaggagatttacca<br>gctgaagaacaagatggccgatagcatcagcgacgaggccaaaagactgc<br>tggagtccggcacagtggtgtgcaaggtcgcgacacacgatatcgtgaag<br>gacaaacacttcacagagaacacataccagttccactgtcctatcaccat<br>gaactttaaggccaaggacagaacaaataaagaattcaacaaccacgttc<br>tagaggtgctgaacaagaaccccgatatcaaagtgatcggactggacaga<br>ggagagagacacctgctgtacctgtccctgatcaaccagaaaggcgagat<br>cgagtgtcagaaaacactgaacctggtcgagcaggtgcggaacgacaaga<br>ccgtgtccgtgaattaccatgagaagctggtgcacaaggagggtcccgt<br>gacgccgcccgcaagaactggcagaccatcggcaatatcaaggagctgaa<br>agaaggctacctgagcgctgtggtgcatgagatcgctagcctgatggtca<br>aacacaacgccatcgtggtgatggaagatctgaatttcggctttaagcgg<br>ggtagattcgctgtggaacggcagatctaccaaaagttcgagaatatgct<br>gatcgagaaacttaactacctggtattcaaagataggaaggtgaccgagc<br>ccggcggagtgctgaacgcctatcagctcgctaacaagagcgccaaggtg<br>acagacgtgtacaagcagtgtggctggctgttctacatccctgctgccta<br>caccagcaagatcgaccccagaaccggcttcgccaatctgttcatcacca<br>agggtctgaccaacgtggaaaagaagaaagaattcttcggcaagtttgac<br>tcgataaggtacgacgccacagagagctgcttcgtgttcagcttcgatta<br>cgccaaaatctgcgacaacgcggactataagaaaaagtgggacgtgtata<br>caagaggcaccagacttgtgtacaacaaaaccgaaagaaaaaacgtgtca<br>gtgaaccctacagaggaactgcagtgcgtgttcgatgaattcggcatcaa<br>gtggaacaccggcgaggatctgatcgagagcatcagcctgatccccgcg<br>agaagtctaacgccaagttcttcgacgtgctgctgagaatgttcaacgcc<br>acactgcagatgagaaacagcgtgccaaacaccgacaccgactacctggt<br>gtccctgtgaaggccgaggacggcagcttctttgatagcagagaggaat<br>tcaaaaagggcggcgatgcccggctgcctatcgattgcgacgccaacggc<br>gcctaccacattgccctgaagggcctgtacctgctgctgaacgatttcaa<br>tagagataataaaggcgtgatccaaaacatctctaacaaggactggttca<br>agttcgtgcaggagaaggtgtacaaggac (SEQ ID NO: 571) |
| 414-1<br>(T154<br>R) | atgaaggaacaattcatcaattgctacccctgagcaaaacactgagatt<br>cagcctgatccccgtcggaaaaacagaggacaatttcaacaaaaagttgt<br>tgctggaaagcgataagcagagagccgaaaactacgagaacgtgaaaagc<br>tacatcgatcgattccacaaggagtacatcaagagcgccctggccaatgc<br>tagaatcgagaagatcaatgaatacgccgctctgtactggaagaacaaca<br>aggatgatagtgatgccaaggccatggagagcctcgaggacgacatccgc<br>aagcagatctctaaacagctgactagcaccgccaatttcaagagactgtt<br>tgggaaggagctgatctgcgaggacctgccggcctttctgactgatgaga<br>acgagaaggaaaccgtggaatgcttcagaagcttcaccacgtactttaac<br>ggcttcaacagaaacagaaagaatatgtactctagcgagaagaagtccac<br>agccatcgcctatagatgcgtgaacgataatctgcctagatttctagaca<br>atatcaagacattccagaagatcttcgacaacctgtccgatgagacaatc<br>acaaagctgaatacagatctgtacaatatcttcggcagaaagatcgaaga<br>cattttttagcgtggactatttcgatttcgtactgacccagtccggcattg<br>acatctacaactacatgatcggcggatacacctgcagcgacggcaccaaa<br>attcagggcctaaatgagtgtatcaacctgtataaccagcaggtggccaa |

-continued

| ID | Protein coding sequence |
|---|---|
| | gaatgagaaaagcaagcgcctgcctctgatgaagccactgagaaagcaga<br>tcctgtctgaaaaagattctgtgtctttcatccccgaaaagttcaacagc<br>gacaacgaggtgctgctcgccatcgaagagtattacaacaaccacatctc<br>cgacatcgacagcctgaccgagctgctgcagagcctgaatacctacaacg<br>ccaacggcatcttcatcaaatcaggcgccgccgtgtcagacatcagcaac<br>gccgcttttaacagctggaacgtgctgaggctggcctggaacgaaaagta<br>cgaggccctgcatcctgtgaccagcaccaccaagatcgacaaatacatcg<br>agaaaagggacaaggtgtacaagagcatcaagtccttcagcctgttcgag<br>ctgcaagagctgggagctgagaacggcaacgagatcaccgactggtacat<br>ctccagcatcaacgagtgcaacagaaaaataaaagaaacctacctgcagg<br>ccagagagctgctggagagcgactatgagaaggactatgataaacggctg<br>tacaaaaacgaaaaggccacagagctggtgaagaatctgctggacgccat<br>caaggaatttcagcaactggtgaagctcctgaacggtacaggcaaggagg<br>aaaacaaggatgagctcttttacggcaagttcacatctctctacgacagc<br>gttgccgatatcgatagactttacgacaaagtgcggaactacattacaca<br>gcggccttactctaaggacaaaatcaagctgaacttcgacaaccccccagt<br>tgctgggcggatgggataaaaacaaggaaagcgactacagaaccgtgatc<br>ctgaggaagaacgacttttattacctggctgtgatggacaaaagccacag<br>caaggtgttcgtgaacgcccctgagatcaccagcgaagatgaggactact<br>acgagaagatggaatataagctgctgccaggccccaataagatgctgcct<br>aaggtgttcttcgcctcccggaatatcgacaagttccagcctagcgaccg<br>catcctggatattcggaagcgggaatcttttaagaagggcgccaccttca<br>acaagtccgaatgccacgagtttatcgactacttcaaggaatcaattaag<br>aagcacgacgactggtccaagttcggctttgagttctctcctaccgagag<br>ctacaacgatatcagtgagttctacagagaggtgagcgatcagggctact<br>acatcagcttcagcaagatcagtaagaactacatcgacaaacttgtggag<br>aatggctacctgtacctgttttaaaatctcaacaaggacttcagcaaata<br>ctccaagggcacacctaacctgcatacccctgtacttcaagatgctgttcg<br>acgagcggaacctcagcaacgtggtctacaaactgaacggagaggccgag<br>atgttctacagagaagctagcattaacgacaaggaaaagatcacccacca<br>cgccaaccagcctatcaagaacaagaatcctgataacgagaaaaaggaaa<br>gcgtgtttgagtacgacatcgtgaaggataagagattcaccaagcggcag<br>ttcagcctgcacgtgtctgtcacaatcaatttcaaagcccacggacagga<br>gttcctgaactacgacgtgcggaaggctgtgaagtacaaggacgacaact<br>acgtgatcggcatcgatagaggcgagagaaacctgatctacatcagcgtt<br>atcaacagcaacggcgagatcgtgaacagatgagcctgaacgaaatcat<br>tggcgacaacggctactctgtggactatcagaagctgctggacaagaaag<br>agaaggaaagagataaggcgagaaagaattggacctccgtcgagaacatc<br>aaggaactgaaggagggctacatcagccaggtggtgcacaagatatgtga<br>actggtggtgaagtacgatgccgtgatcgccatggaagatctgaacttcg<br>gattcaaaagaggcagattccccgtggaaaagcaagtgtaccagaagttc<br>gaaaacatgctgatcagcaagctgaacctgctgattgacaagaaagcaga<br>gcctacagaccggcggcctgctgcgggcctaccaactgacaaacaagt<br>tcgacggcgtgaacaaagccaagcagaacggcatcatcttctacgtgcct<br>gcctgggacaccctctaagatcgaccctgtgactggcttcgtgaacctgct<br>gaagcccaagtatacctcggtgcgggaggccaagaagctgttcgagacca<br>tcgacgatatcaagtacaacaccaacacagacatgttcgagttctgcatc<br>gattacggcaaattccctagatgtaacagcgacttcaagaaaacctggac<br>agtgtgcaccaactctagccggatcctgagcttcagaaacgaaaagaaaa<br>acaacgagtgggacaacaagcaaatcgtcctgaccgacgaattcaagtct<br>ctgttcaacgagtttggcatcgattacaccctcggacctgaaagctagcat<br>cctgtctatcagcaacgctgacttctacaatagactgatccggctgctat<br>ctctgacactgcagatgcgtaacagcatcatcggtagcaccctgcccgag<br>gacgactacctgatcagccctgtggccaacgaccggggagaattctacga<br>cagcagaaactacaaaggctccaacgccgcccttccatgtgacgccgacg<br>ccaacggcgcttacaatatcgcccggaaagccctgtgggctatcaacgtg<br>ctgaaggataccccctgacgatatgctgcagaaggccaagctcagcatcac<br>caatgccgagtggctggaatacacccagaga (SEQ ID NO: 572) |
| 414-2<br>(T154<br>R/R88<br>7K/R8<br>91A) | atgaaggaacaattcatcaattgctaccccctgagcaaaacactgagatt<br>cagcctgatccccgtcggaaaaacagaggacaatttcaacaaaaagttgt<br>tgctggaaagcgataagcagagagccgaaaactacgagaacgtgaaagcc<br>tacatcgatcgattccacaaggagtacatcaagagcgccctggccaatgc<br>tagaatcgagaagatcaatgaatacgccgctctgtactggaagaacaaca<br>aggatgatagtgatgccaaggccatggagagcctcgaggacgacatccgc<br>aagcagatctctaaacagctgactagcaccgccaatttcaagactgtt<br>tgggaaggagctgatctgcgaggacctgccggcctttctgactgatgaga<br>acgagaaggaaaccgtggaatgcttcagaagcttcaccacgtactttaac<br>ggcttcaacagaaacagaaagaatatgtactctagcgagaagaagtccac<br>agccatcgcctatagatgcgtgaacgataatctgcctagatttctagaca<br>atatcaagacattccagaagatcttcgacaacctgtccgatgagacaatc<br>acaaagctgaatacagatctgtacaatatcttcggcagaaagatcgaaga<br>cattttagcgtggactatttcgatttcgtactgacccagtccggcattg<br>acatctacaactacatgatcggcggatacacctgcagcgacggcaccaaa<br>attcagggcctaaatgagtgtatcaacctgtataaccagcaggtggccaa<br>gaatgagaaaagcaagcgcctgcctctgatgaagccactgagaaagcaat<br>cctgtctgaaaaagattctgtgtctttcatccccgaaaagttcaacagcg |

| ID | Protein coding sequence |
|---|---|
| | acaacgaggtgctgctcgccatcgaagagtattacaacaaccacatctcc
gacatcgacagcctgaccgagctgctgcagagcctgaatacctacaacgc
caacggcatcttcatcaaatcaggcgccgccgtgtcagacatcagcaacg
ccgcttttaacagctggaacgtgctgaggctggcctggaacgaaaagtac
gaggccctgcatcctgtgaccagcaccaccaagatcgacaaatacatcga
gaaaagggacaaggtgtacaagagcatcaagtccttcagcctgttcgagc
tgcaagagctgggagctgagaacggcaacgagatcaccgactggtacatc
tccagcatcaacgagtgcaacagaaaaataaaagaaacctacctgcaggc
cagagagctgctggagagcgactatgagaaggactatgataaacggctgt
acaaaaacgaaaaggccacagagctggtgaagaatctgctggacgccatc
aaggaatttcagcaactggtgaagctcctgaacggtacaggcaaggagga
aaacaaggatgagctcttttacggcaagttcacatctctctacgacagcg
ttgccgatatcgatagactttacgacaaagtgcggaactacattacacag
cggccttactctaaggacaaaatcaagctgaacttcgacaaccccccagtt
gctgggcggatgggataaaaacaaggaaagcgactacagaaccgtgatcc
tgaggaagaacgactttttattacctggctgtgatggacaaaagccacagc
aaggtgttcgtgaacgcccctgagatcaccagcgaagatgaggactacta
cgagaagatggaatataagctgctgccaggccccaataagatgctgccta
aggtgttcttcgcctcccggaatatcgacaagttccagcctagcgaccgc
atcctggatattcggaagcgggaatcttttaagaagggcgccaccttcaa
caagtccgaatgccacgagtttatcgactacttcaaggaatcaattaaga
agcacgacgactggtccaagttcggctttgagttctctcctaccgagagc
tacaacgatatcagtgagttctacagagaggtgagcgatcagggctacta
catcagcttcagcaagatcagtaagaactacatcgacaaacttgtggaga
atggctacctgtacctgttttaaaatctacaacaaggacttcagcaaatac
tccaagggcacacctaacctgcataccctgtacttcaagatgctgttcga
cgagcggaacctcagcaacgtggtctacaaactgaacggagaggccgaga
tgttctacagagaagctagcattaacgacaaggaaaagatcacccaccac
gccaaccagcctatcaagaacaagaatcctgataacgagaaaaaggaaag
cgtgtttgagtacgacatcgtgaaggataagagattccaagcggcagt
tcagcctgcacgtgtctgtcacaatcaatttcaaagcccacggacaggag
ttcctgaactacgacgtgcggaaggctgtgaagtacaaggacgacaacta
cgtgatcggcatcgatagaggcgagagaaacctgatctacatcagcgtta
tcaacagcaacggcgagatcgtggaacagatgagcctgaacgaaatcatt
ggcgacaacggctactctgtggactatcagaagctgctggacaagaaaga
gaaggaaaaggataaggcggccaagaattggacctccgtcgagaacatca
aggaactgaaggagggctacatcagccaggtggtgcacaagatatgtgaa
ctagtggtgaagtacgatgccgtgatcgccatggaagatctgaacttcgg
attcaaaagaggcagattccccgtggaaaagcaagtgtaccagaagttcg
aaaacatgctgatcagcaagctgaacctgctgattgacaagaaagcagag
cctacagagaccggcggcctgctgcgggcctaccaactgacaacaagtt
cgacggcgtgaacaaagccaagcagaacggcatcatcttctacgtgcctg
cctgggacacctctaagatcgaccctgtgactggcttcgtgaacctgctg
aagcccaagtatacctcggtgcgggaggccaagaagctgttcgagaccat
cgacgatatcaagtacaacaccaacagacatgttcgagttctgcatcg
attacggcaaattccctagatgtaacagcgacttcaagaaaacctggaca
gtgtgcaccaactctagccggatcctgagcttcagaaacgaaaagaaaaa
caacgagtgggacaacaagcaaatcgtcctgaccgacgaattcaagtctc
tgttcaacgagtttggcatcgattacacctcggacctgaaagctagcatc
ctgtctatcagcaacgctgacttctacaatagactgatccggctgctatc
tctgacactgcagatgcgtaacagcatcatcggtagcaccctgcccgagg
acgactacctgatcagccctgtggccaacgaccggggagaattctacgac
agcagaaactacaaaggctccaacgccgcccttccatgtgacgccgacgc
caacggcgcttacaatatcgcccggaaagccctgtgggctatcaacgtgc
tgaaggatacccctgacgatatgctgcagaaggccaagctcagcatcacc
aatgccgagtggctggaatacacccagaga (SEQ ID NO: 573) |
| 414-3
(T154
R/G53
6R/K5
42R) | atgaaggaacaattcatcaattgctacccctgagcaaaacactgagatt
cagcctgatccccgtcggaaaaacagaggacaatttcaacaaaaagttgt
tgctggaaagcgataagcagagagccgaaaactacgagaacgtgaaaagc
tacatcgatcgattccacaaggagtacatcaagagcgccctggccaatgc
tagaatcgagaagatcaatgaatacgccgctctgtactggaagaacaaca
aggatgatagtgatgccaaggccatggagagcctcgaggacgacatccgc
aagcagatctctaaacagctgactagcaccgccaatttcaagagactgtt
tgggaaggagctgatctgcgaggacctgccggcctttctgactgatgaga
acgagaaggaaaccgtggaatgcttcagaagcttcaccacgtactttaac
ggcttcaacagaaacagaaagaaatatgtactctagcgagaagaagtccac
agccatcgcctatagatgcgtaacgataatctgcctagatttctagaca
atatcaagacattccagaagatcttcgacaacctgtccgatgagacaatc
acaaagctgaatacagatctgtacaatatcttcggcagaaagatcgaaga
cattttttagcgtggactattttcgatttcgtactgacccagtccggcattg
acatctacaactacatgatcggcggatacacctgcagcgacggcaccaaa
attcagggcctaaatgagtgtatcaacctgtataaccagcaggtggccaa
gaatgagaaagcaagcgcctgcctctgatgaagccactgagaaagcaga
tcctgtctgaaaagattctgtgtctttcatccccgaaaagttcaacagc
gacaacgaggtgctgctcgccatcgaagagtattacaacaaccacatctc
cgacatcgacagcctgaccgagctgctgcagagcctgaatacctacaacg |

| ID | Protein coding sequence |
|---|---|
| | ccaacggcatcttcatcaaatcaggcgccgccgtgtcagacatcagcaac
gccgcttttaacagctggaacgtgctgaggctggcctggaacgaaaagta
cgaggccctgcatcctgtgaccagcaccaccaagatcgacaaatacatcg
agaaaagggacaaggtgtacaagagcatcaagtccttcagcctgttcgag
ctgcaagagctgggagctgagaacggcaacgagatcaccgactggtacat
ctccagcatcaacgagtgcaacagaaaaataaaagaaacctacctgcagg
ccagagagctgctggagagcgactatgagaaggactatgataaacggctg
tacaaaaacgaaaaggccacagagctggtgaagaatctgctggacgccat
caaggaatttcagcaactggtgaagctcctgaacggtacaggcaaggagg
aaaacaaggatgagctcttttacggcaagttcacatctctctacgacagc
gttgccgatatcgatagactttacgacaaagtgcggaactacattacaca
gcggccttactctaaggacaaaatcaagctgaacttcgacaacccccagt
tgctgagaggatgggataaaaacagagaaagcgactacagaaccgtgatc
ctgaggaagaacgacttttattacctggctgtgatggacaaaagccacag
caaggtgttcgtgaacgcccctgagatcactagtgaagatgaggactact
acgagaagatggaatataagctgctgccaggccccaataagatgctgcct
aaggtgttcttcgcctcccggaatatcgacaagttccagcctagcgaccg
catcctggatattcggaagcgggaatcttttaagaagggcgccaccttca
acaagtccgaatgccacgagtttatcgactacttcaaggaatcaattaag
aagcacgacgactggtccaagttcgggctttgagttctctcctaccgagg
ctacaacgatatcagtgagttctacagagaggtgagcgatcagggctact
acatcagcttcagcaagatcagtaagaactacatcgacaaacttgtggag
aatggctacctgtacctgtttaaaatctcaacaaggacttcagcaaata
ctccaagggcacacctaacctgcatacctgtacttcaagatgctgttcg
acgagcggaacctcagcaacgtggtctacaaaactgaacggagaggccgag
atgttctacagagaagctagcattaacgacaaggaaaagatcacccacca
cgccaaccagcctatcaagaacaagaatcctgataacgagaaaaaggaaa
gcgtgtttgagtacgacatcgtgaaggataagagattcaccaagcggcag
ttcagcctgcacgtgtctgtcacaatcaatttcaaagcccacggacagga
gttcctgaactacgacgtgcggaaggctgtgaagtacaaggacgacaact
acgtgatcggcatcgatagaggcgagagaaacctgatctacatcagcgtt
atcaacagcaacgcgagatcgtgaacagatgagcctgaacgaaatcat
tggcgacaacggctactctgtggactatcagaagctgctggacaagaaag
agaaggaaagagataaggcgagaaagaattggacctccgtcgagaacatc
aaggaactgaaggagggctacatcagccaggtggtgcacaagatatgtga
actggtggtgaagtacgatgccgtgatcgccatggaagatctgaacttcg
gattcaaaagaggcagattcccgtggaaagcaagtgtaccagaagttc
gaaaacatgctgatcagcaagctgaacctgctgattgacaagaaagcaga
gcctacagaccggcggcctgctgcgggcctaccaactgacaaacaagt
tcgacggcgtgaacaaagccaagcagaacggcatcatcttctacgtgcct
gcctgggacacctctaagatcgaccctgtgactggcttcgtgaacctgct
gaagcccaagtatacctcggtgcgggaggccaagaagctgttcgagacca
tcgacgatatcaagtacaacaccaacacagacatgttcgagttctgcatc
gattacggcaaattccctagatgtaacagcgacttcaagaaaacctggac
agtgtgcaccaactctagccggatcctgagcttcagaaacgaaaagaaa
acaacgagtgggacaacaagcaaatcgtcctgaccgacgaattcaagtct
ctgttcaacgagtttggcatcgattacaccctcggacctgaaagctagcat
cctgtctatcagcaacgctgacttctacaatagactgatccggctgctat
ctctgacactgcagatgcgtaacagcatcatcggtagcaccctgcccgag
gacgactacctgatcagccctgtggccaacgaccggggagaattctacga
cagcagaaactacaaaggctccaacgccgcccttccatgtgacgccgacg
ccaacggcgcttacaatatcgcccggaaagccctgtgggctatcaacgtg
ctgaaggatacccctgacgatatgctgcagaaggccaagctcagcatcac
caatgccgagtggctggaatacacccagaga (SEQ ID NO: 574) |
| 414-4<br>(TN53<br>1R/S8<br>02L) | atgaaggaacaattcatcaattgctaccccctgagcaaaacactgagatt
cagcctgatccccgtcggaaaaacagaggacaatttcaacaaaaagttgt
tgctggaaagcgataagcagagagccgaaaactacgagaacgtgaaagc
tacatcgatcgattccacaaggagtacatcaagagcgccctggccaatgc
tagaatcgagaagatcaatgaatacgccgctctgtactggaagaacaaca
aggatgatagtgatgccaaggccatggagagcctcgaggacgacatccgc
aagcagatctctaaacagctgactagcaccgccaatttcaagagactgtt
tgggaaggagctgatctgcgaggacctgccggccttctctgactgatgaga
acgagaaggaaaccgtggaatgcttcagaagcttcaccacgtactttaac
ggcttcaacaccaacagaagaatatgtactctagcgagaagaagtccac
agccatcgcctatagatgcgtgaacgataatctgcctagatttctggaca
atatcaagacattccagaagatcttcgacaacctgtccgatgagacaatc
acaaagctgaatacagatctgtacaatatcttcggcagaaagatcgaaga
cattttagcgtggactatttcgatttcgtactgacccagtccggcattg
acatctacaactacatgatcggcggatacacctgcagcgacggcaccaaa
attcagggcctaaatgagtgtatcaacctgtataaccagcaggtggccaa
gaatgagaaaagcaaggcctgcctctgatgaagccactgagaaagcaga
tcctgtctgaaaaagattctgtgtctttcatcccgaaaagttcaacagc
gacaacgaggtgctgctcgccatcgaagagtattacaacaaccacatctc
cgacatcgacagcctgaccgagctgctgcagagcctgaatacctacaacg
ccaacggcatcttcatcaaatcaggcgccgccgtgtcagacatcagcaac
gccgcttttaacagctggaacgtgctgaggctggcctggaacgaaaagta |

-continued

| ID | Protein coding sequence |
|---|---|
| | cgaggccctgcatcctgtgaccagcaccaccaagatcgacaaatacatcg agaaaagggacaaggtgtacaagagcatcaagtccttcagcctgttcgag ctgcaagagctgggagctgagaacggcaacgagatcaccgactggtacat ctccagcatcaacgagtgcaacagaaaaataaaagaaacctacctgcagg ccagagagctgctggagagcgactatgagaaggactatgataaacggctg tacaaaaacgaaaaggccacagagctggtgaagaatctgctggacgccat caaggaatttcagcaactggtgaagctcctgaacggtacaggcaaggagg aaaacaaggatgagctcttttacggcaagttcacatctctctacgacagc gttgccgatatcgatagactttacgacaaagtgcggaactacattacaca gcggccttactctaaggacaaaatcaagcttaacttcgacagaccccagt tgctgggcggatgggataaaaacaaggaaagcgactacagaaccgtgatc ctgaggaagaacgacttttattacctggctgtgatggacaaaagccacag caaggtgttcgtgaacgcccctgagatcaccagcgaagatgaggactact acgaagatggaatataagctgctgccaggccccaataagatgctgcct aaggtgttcttcgcctcccggaatatcgacaagttccagcctagcgaccg catcctggatattcggaagcgggaatcttttaagaagggcgccaccttca acaagtccgaatgccacgagtttatcgactacttcaaggaatcaattaag aagcacgacgactggtccaagttcggctttgagttctctcctaccgagag ctacaacgatatcagtgagttctacagagaggtgagcgatcagggctact acatcagcttcagcaagatcagtaagaactacatcgacaaacttgtggag aatggctacctgtacctgtttaaaatctacaacaaggacttcagcaaata ctccaagggcacacctaacctgcatacccctgtacttcaagatgctgttcg acgagcggaacctcagcaacgtggtctacaaactgaacgagaggccgag atgttctacagagaagctagcattaacgacaaggaaaagatcacccacca cgccaaccagcctatcaagaacaagaatcctgataacgagaaaaaggaaa gcgtgtttgagtacgacatcgtgaaggataagagattcaccaagcggcag ttcctgctgcacgtgtctgtcacaatcaatttcaaagcccacggacagga gttcctgaactacgacgtgcggaaggctgtgaagtacaaggacgacaact acgtgatcggcatcgatagaggcgagagaaacctgatctacatcagcgtt atcaacagcaacggcgagatcgtggaacagatgagcctgaacgaaatcat tggcgacaacggctactctgtggactatcagaagcttctagacaagaaag agaaggaaagagataaggcgagaaagaattggacctccgtcgagaacatc aaggaactgaaggagggctacatcagccaggtggtgcacaagatatgtga actggtggtgaagtacgatgccgtgatcgccatggaagatctgaacttcg gattcaaaagaggcagattccccgtggaaaagcaagtgtaccagaagttc gaaaacatgctgatcagcaagctgaacctgctgattgacaagaaagcaga gcctacagagaccggcggcctgctgcgggcctaccaactgacaaacaagt tcgacgcgtgaacaaagccaagcagaacggcatcatcttctacgtgcct gcctgggacacctctaagatcgaccctgtgactggcttcgtgaacctgct gaagcccaagtatacctcggtgcgggaggccaagaagctgttcgagacca tcgacgatatcaagtacaacaccaacacagacatgttcgagttctgtcatc gattacggcaaattccctagatgtaacagcgacttcaagaaaacctggac agtgtgcaccaactctagccggatcctgagcttcagaaacgaaaagaaaa acaacgagtgggacaacaagcaaatcgtcctgaccgacgaattcaagtct ctgttcaacgagtttggcatcgattacacctcggacctgaaagctagcat cctgtctatcagcaacgctgacttctacaatagactgatccggctgctat ctctgacactgcagatgcgtaacagcatcatcggtagcaccctgcccgag gacgactacctgatcagccctgtggccaacgaccggggagaattctacga cagcagaaactacaaaggctccaacgccgcccttccatgtgacgccgacg ccaacgcgcttacaatatcgcccggaaagccctgtgggctatcaacgtg ctgaaggataccccctgacgatatgctgcagaaggccaagctcagcatcac caatgccgagtggctggaatacacccagaga (SEQ ID NO: 575) |
| 414-5 (N531R) | atgaaggaacaattcatcaattgctaccccctgagcaaaacactgagatt cagcctgatccccgtcggaaaaacagaggacaatttcaacaaaaagttgt tgctggaaagcgataagcagagagccgaaaactacgagaacgtgaaaagc tacatcgatcgattccacaaggagtacatcaagagcgccctggccaatgc tagaatcgagaagatcaatgaatacgccgctctgtactggaagaacaaca aggatgatagtgatgccaaggccatggagagcctcgaggacgacatccgc aagcagatctctaaacagctgactagcaccgccaatttcaagagactgtt tgggaaggagctgatctgcgaggacctgccggcctttctgactgatgaga acgagaaggaaaccgtggaatgcttcagaagcttcaccacgtactttaac ggcttcaacaccaacagaaagaatatgtactctagcgagaagaagtccac agccatcgcctatagatgcgtaacgataatctgcctagatttctggaca atatcaagacattccagaagatcttcgacaacctgtccgatgagacaatc acaaagctgaatacagatctgtacaatatcttcggcagaaagatcgaaga catttttagcgtggactatttcgatttcgtactgacccagtccggcattg acatctacaactacatgatcggcggatacacctgcagcgacggcaccaaa attcagggcctaaatgagtgtatcaacctgtataaccagcaggtggccaa gaatgagaaagcaagcgcctgcctctgatgaagccactgagaaagcaga tcctgtctgaaaaagattctgtgtctttcatccccgaaaagttcaacagc gacaacgaggtgctgctcgccatcgaagagtattacaacaaccacatctc cgacatcgacagcctgaccgagctgctgcagagcctgaatacctacaacg ccaacggcatcttcatcaaatcaggcgccgccgtgtcagacatcagcaac gccgcttttaacagctggaacgtgctgagggctggcctggaacgaaagta cgaggccctgcatcctgtgaccagcaccaccaagatcgacaaatacatcg agaaaagggacaaggtgtacaagagcatcaagtccttcagcctgttcgag |

-continued

| ID | Protein coding sequence |
|---|---|
| | ctgcaagagctgggagctgagaacggcaacgagatcaccgactggtacat
ctccagcatcaacgagtgcaacagaaaaataaaagaaacctacctgcagg
ccagagagctgctggagagcgactatgagaaggactatgataaacggctg
tacaaaaacgaaaaggccacagagctggtgaagaatctgctggacgccat
caaggaatttcagcaactggtgaagctcctgaacggtacaggcaaggagg
aaaacaaggatgagctcttttacggcaagttcacatctctctacgacagc
gttgccgatatcgatagactttacgacaaagtgcggaactacattacaca
gcggccttactctaaggacaaaatcaagcttaacttcgacagaccccagt
tgctgggcgatgggataaaaacaaggaaagcgactacagaaccgtgatc
ctgaggaagaacgacttttattacctggctgtgatggacaaaagccacag
caaggtgttcgtgaacgcccctgagatcaccagcgaagatgaggactact
acgagaagatggaatataagctgctgccaggccccaataagatgctgcct
aaggtgttcttcgcctcccggaatatcgacaagttccagcctagcgaccg
catcctggatattcggaagcgggaatcttttaagaagggcgccaccttca
acaagtccgaatgccacgagtttatcgactacttcaaggaatcaattaag
aagcacgacgactggtccaagttcggctttgagttctctcctaccgagag
ctacaacgatatcagtgagttctacagagaggtgagcgatcagggctact
acatcagcttcagcaagatcagtaagaactacatcgacaaacttgtggag
aatggctacctgtacctgtttaaaatctacaacaaggacttcagcaaata
ctccaagggcacacctaacctgcatacctgtacttcaagatgctgttcg
acgagcggaacctcagcaacgtggtctacaaactgaacggagaggccgag
atgttctacagagaagctagcattaacgacaaggaaaagatcacccacca
cgccaaccagcctatcaagaacaagaatcctgataacgagaaaaaggaaa
gcgtgtttgagtacgacatcgtgaaggataagagattcaccaagcggcag
ttcagcctgcacgtgtctgtcacaatcaatttcaaagcccacggacagga
gttcctgaactacgacgtgcggaaggctgtgaagtacaaggacgacaact
acgtgatcggcatcgatagaggcgagagaaacctgatctacatcagcgtt
atcaacagcaacggcgagatcgtgaacagatgagcctgaacgaaatcat
tggcgacaacggctactctgtggactatcagaagctgctggacaagaaag
agaaggaaagagataaggcgagaaagaattggacctccgtcgagaacatc
aaggaactgaaggagggctacatcagccaggtggtgcacaagatatgtga
actggtggtgaagtacgatgccgtgatcgccatggaagatctgaacttcg
gattcaaaagaggcagattccccgtggaaaagcaagtgtaccagaagttc
gaaaacatgctgatcagcaagctgaacctgctgattgacaagaaagcaga
gcctacagaccggcggcctgctgcgggcctaccaactgacaaacaagt
tcgacggcgtgaacaaagccaagcagaacggcatcatcttctacgtgcct
gcctgggacacctctaagatcgaccctgtgactggcttcgtgaacctgct
gaagcccaagtatacctcggtgcgggaggccaagaagctgttcgagacca
tcgacgatatcaagtacaacaccaacacagacatgttcgagttctgcatc
gattacggcaaattccctagatgtaacagcgacttcaagaaaacctggac
agtgtgcaccaactctagccggatcctgagcttcagaaacgaaaagaaaa
acaacgagtgggacaacaagcaaatcgtcctgaccgacgaattcaagtct
ctgttcaacgagtttggcatcgattacacctcggacctgaaagctagcat
cctgtctatcagcaacgctgacttctacaatagactgatccggctgctat
ctctgacactgcagatgcgtaacagcatcatcggtagcaccctgcccgag
gacgactacctgatcagccctgtggccaacgaccggggagaattctacga
cagcagaaactacaaaggctccaacgccgcccttccatgtgacgccgacg
ccaacggcgcttacaatatcgcccggaaagccctgtgggctatcaacgtg
ctgaaggatacccctgacgatatgctgcagaaggccaagctcagcatcac
caatgccgagtggctggaatacacccagaga (SEQ ID NO: 576) |
| 414-6
(S802
L) | atgaaggaacaattcatcaattgctaccccctgagcaaaacactgagatt
cagcctgatccccgtcggaaaaacagaggacaatttcaacaaaaagttgt
tgctggaaagcgataagcagagagccgaaaactacgagaacgtgaaaagc
tacatcgatcgattccacaaggagtacatcaagagcgccctggccaatgc
tagaatcgagaagatcaatgaatacgccgctctgtactggaagaacaaca
aggatgatagtgatgccaaggccatggagagcctcgaggacgacatccgc
aagcagatctctaaacagctgactgcaccgccaatttcaagagactgtt
tgggaaggagctgatctgcgaggacctgccggcctttctgactgatgaga
acgagaaggaaaccgtggaatgcttcagaagcttcaccacgtactttaac
ggcttcaacaccaacagaagaatatgtactctagcgagaagaagtccac
agccatcgcctatagatgcgtgaacgataatctgcctagatttctggcaa
atatcaagacattccagaagatcttcgacaacctgtccgatgagacaatc
acaaagctgaatacagatctgtacaatatcttcggcagaaagatcgaaga
cattttttagcgtggactatttcgatttcgtactgacccagtccggcattg
acatctacaactacatgatcggcggatacacctgcagcgacggcaccaa
attcaggcgcctaaatgagtgtatcaacctgtataaccagcaggtggccaa
gaatgagaaaagcaagcgcctgcctctgatgaagccactgagaaagcaga
tcctgtctgaaaaagattctgtgtctttcatccccgaaaagttcaacagc
gacaacgaggtgctgctcgccatcgaagagtattacaacaaccacatctc
cgacatcgacagcctgaccgagctgctgcagagcctgaatacctacaacg
ccaacggcatcttcatcaaatcaggcgccgccgtgtcagacatcagcaac
gccgcttttaacagctggaacgtgctgaggctggcctggaacgaaaagta
cgaggccctgcatcctgtgaccagcaccaccaagatcgacaaatacatcg
agaaagggacaaggtgtacaagagcatcaagtccttcagcctgttcgag
ctgcaagagctgggagctgagaacggcaacgagatcaccgactggtacat
ctccagcatcaacgagtgcaacagaaaaataaaagaaacctacctgcagg |

| ID | Protein coding sequence |
|---|---|
| | ccagagagctgctggagagcgactatgagaaggactatgataaacggctg
tacaaaaacgaaaaggccacagagctggtgaagaatctgctggacgccat
caaggaatttcagcaactggtgaagctcctgaacggtacaggcaaggagg
aaaacaaggatgagctcttttacggcaagttcacatctctctacgacagc
gttgccgatatcgatagactttacgacaaagtgcggaactacattacaca
gcggccttactctaaggacaaaatcaagctgaacttcgacaaccccagt
tgctgggcggatgggataaaaacaaggaaagcgactacagaaccgtgatc
ctgaggaagaacgacttttattacctggctgtgattggacaaaagccacag
caaggtgttcgtgaacgcccctgagatcaccagcgaagatgaggactact
acgagaagatggaatataagctgctgccaggccccaataagatgctgcct
aaggtgttcttcgcctcccggaatatcgacaagttccagcctagcgaccg
catcctggatattcggaagcgggaatcttttaagaagggcgccaccttca
acaagtccgaatgccacgagtttatcgactacttcaaggaatcaattaag
aagcacgacgactggtccaagttcggctttgagttctctcctaccgagag
ctacaacgatatcagtgagttctacagagaggtgagcgatcagggctact
acatcagcttcagcaagatcagtaagaactacatcgacaaacttgtggag
aatggctacctgtacctgtttaaaatctacaacaaggacttcagcaaata
ctccaagggcacacctaacctgcatacccctgtacttcaagatgctgttcg
acgagcggaacctcagcaacgtggtctacaaactgaacggagaggccgag
atgttctacagagaagctagcattaacgacaaggaaaagatcacccacca
cgccaaccagcctatcaagaacaagaatcctgataacgagaaaaaggaaa
gcgtgtttgagtacgacatcgtgaaggataagagattcaccaagcggcag
ttcctgctgcacgtgtctgtcacaatcaatttcaaagcccacggacagga
gttcctgaactacgacgtgcggaaggctgtgaagtacaaggacgacaact
acgtgatcggcatcgatagaggcgagagaaacctgatctacatcagcgtt
atcaacagcaacggcgagatcgtggaacagatgagcctgaacgaaatcat
tggcgacaacggctactctgtggactatcagaagcttctagacaagaaag
agaaggaaagataaggcgagaaagaattggacctccgtcgaacatc
aaggaactgaaggagggctacatcagccaggtggtgcacaagatatgtga
actggtggtgaagtacgatgccgtgatcgccatggaagatctgaacttcg
gattcaaaagaggcagattcccgtggaaaagcaagtgtaccagaagttc
gaaaacatgctgatcagcaagctgaacctgctgattgacaagaaagcaga
gcctacagagaccggcggcctgctgcgggcctaccaactgacaaacaagt
tcgacgcgtgaacaaagccaagcagaacggcatcatcttctacgtgcct
gcctgggacacctctaagatcgaccctgtgactggcttcgtgaacctgct
gaagcccaagtatacctcggtgcgggaggccaagaagctgttcgagacca
tcgacgatatcaagtacaacaccaacacagacatgttcgagttctgcatc
gattacggcaaattccctagatgtaacagcgacttcaagaaaacctggac
agtgtgcaccaactctagccggatcctgagcttcagaaacgaaaagaaaa
acaacgagtgggacaacaagcaaatcgtcctgaccgacgaattcaagtct
ctgttcaacgagtttggcatcgattacacctcggacctgaaagctagcat
cctgtctatcagcaacgctgacttctacaatagactgatccggctgctat
ctctgacactgcagatgcgtaacagcatcatcggtagcaccctgcccgag
gacgactacctgatcagccctgtggccaacgaccggggagaattctacga
cagcagaaactacaaaggctccaacgccgcccttccatgtgacgccgacg
ccaacgcgcttacaatatcgcccggaaagccctgtgggctatcaacgtg
ctgaaggatacccctgacgatatgctgcagaaggccaagctcagcatcac
caatgccgagtggctggaatacacccagaga (SEQ ID NO: 577) |
| 418-1
(D161
R) | atgaaggccgagctgttcaagacattcgtggacgaataccccgtgtctaa
gacactgcggttcagcctgattcctgtgggcagaaccctggaaaacatcg
aaaaggacggcatcctggattgtgatgagaagcgatctgaagaatacaag
agagtgaagaagctgctggatgaatactacaagacattcatcgagcagcc
cctgaccaatgtagaactggatatcaactccctggaagaatacgagagac
tctacaacatcaaaaacaagtcagacaaggaaaaggccgattttgacagc
gtgcagaaaacctaaggaaacagattgtgaaggccctgaaggaggatga
gaagtacaagttccttttcaagaaggaaatcatcgaaggaactggtag
attttctgaacggcagagacagcgatgtggagctggtcaagtcettcaag
ggctacgctaccatgttccaaggcttctggagagctcgaaagaatatctt
cagcgacgaagagaaaagcaccgccatcgcctacagaatcatcaacgaaa
atctgcctaagtttatctctaataaaaacatctacttcaccaagatccag
cctgagatggatgccgagctggacagctgacactgagcaacaacagcaa
tgagatcagagatatcttttaagctggagtatttcagcaaaaccatcaccc
agacaggcatcgagatctataatggaattctgggcggatacaccatcgat
gaacaggtgaaactgcaggaatcaacgagatcgtgaacctgcataatca
gaagaacaaggacagtggcaagatcccaaagctgaagatgctgtataagc
agatcctgagcgatacaaacacgctgcattcatcgccgaaggctttgag
accgatgacgaggttctggaatcgcttaatatttttctacgacgtgttcaa
cgagaacatcctggacgaggacctgggtataatcaacctgctgagaaaca
tcgataagttctcctacgatgggatctacatcaagaatgacaaggccctg
atcgacatcagcaactacctgttcggtgactggcactacatcaaaaacgc
catcaataaaaatatgagatcgataaccctggcaagaacacagagaagt
acatcgtgaaaagaaataaattcatcaagagcttcgactcttcagcctg
aagtacctgcaggactgtacaggcagcaagttcaacgagcacatcctgat
caagatcaacaacctgatcgacgacgtgaagaaggcttacaacagcgtcg
ccctgctgatcaagaacaagtacgagggaaccaacctgatcaacgacaag
gacgccatcgagaagatcaagcaatttctggacagcatgaagagcctggt |

| ID | Protein coding sequence |
|---|---|
| | gtccttcatcagatgcttcgaaggcacaggccaggagcctgacagagatg<br>aaatcttctacggcgagttcgataccggcaagaagaccttctactacctg<br>aacaacatctacaacaagaccagaaactacgtgaccaagaagccctcag<br>catcgagaaatacaagctgaacttcgacaatgccgaactgctgaccggat<br>gggatctgaacaaggagacatctaaggcctccatcattctgaagaaggac<br>aatctgtactatctcggaatcatgaagaagtctgatagacgggtgttcct<br>gaacgtgccagaaaccgagagcacctacaactgctacgagaagatggagt<br>acaaactgctcccggccctaacaaaatgctgcctaaggtcttcttcgcc<br>aaaagtaacatcgactactacgaccctagccccgagattatgcggatcta<br>caaggagggcaccttcaaaaaggggataacttcaacattgacgactgcc<br>acgacttaatcgactacttcaaagagagcctggacaagaacgacgattgg<br>aaaatcttcgattttgacttcagcgagacaagcagctacaaggacatcgg<br>agaattctataaggaagttcagcagcagggctacaaaatcagctttaaga<br>acatcgccagcagctatgtggacgagcttgtggagaacggaaagctgtac<br>ctgttccagatctacaacaaggacttttctaagaactctaaaggcaccga<br>gaacctgcacacagtgactggcgggcctgttcgacgaggagaacctgg<br>aaaatgtgatctacaagctgaacggcgacgccgagatcttttcagaaga<br>aaatccatatccgagaacgagaagatcgtgcacccagcccacgtggagat<br>tgagaataaaaatgacgagactcggaaggaaaaaaagacaagcatcttta<br>actacgacatcatcaaggataagagattcaccgtggacaaatttcagttt<br>cacgtgcccatcaccctgaactttcaggccatcgatcggaagagcgatat<br>caacctcagaatgcggcaggagatcaaaaagaacaaggacatgcacatca<br>tcggcatagacagaggcgagagaaaccttctgtatatcagcatcatcgac<br>ctggacggcaatatcgttaagcaggagagcctcaacaccatcaccaacga<br>atacgacggcaagatttataccacagactatcacaagctgctcgacaaga<br>aggaggagaagcgcaaagtcgccagacagacctggaacaccatcgagaat<br>atcaaggaactgaaagctggatacatgagccaggtggtgcataaaattac<br>acagctgatgatggaatacaacgcaatcgtcgtgctggaagatctaaaca<br>ccggcttcaagcggggcaggcaaaaggtggaaaagcagatctaccaggcc<br>ttcgagaaagccctgatcaacaagctgaactactacgtggacaagaaggt<br>ggataagaacgaaataagcggcctgtacaagcctctgcagctgaccaagg<br>agttcgaaagctttaaaaagctgggcaagcagtctggagccatcttctat<br>gtgcctgcttggaacacaagcaagatggacccaccaccggcttcgtgaa<br>tctgctgtctgtcaagtacgagaacatggaaagtccaaagagttcatca<br>acaaaatcaaggacatcaacttcaaggaggatgactgcggcaaatactac<br>gaatttcacatcgatttcaacgaattcaccgacaagggcaaggacaccaa<br>gaccgattggaatatctgcagctttggcaagcggatcgacaacgcaagaa<br>atcagaaaggagatttcgagtccaagatgatcgacctgacaaacgagttc<br>cacaacctgttcaagaagtacggcatcaacgacaacagcaatctgaagga<br>ggacatcctgaatgtgaaggaagctaaattttacaaggaattcatcaacc<br>tgttcaagctgatgctgcaaatccggaattctgagagcaatgaaaaggtg<br>gacttcctgcaaagtcctgtgaaaaacaacaagggcgagttcttcaactc<br>taacaacgtgaacggcaacgaggcccctgagaatgccgacgccaacggcg<br>cctacaacatagctagaaagggcctgtggatcgtgaaccagatcaagacc<br>atgcctgatagccagatgcacaaaattaagctggccatgaagaaccagga<br>atggctgctgttcgcccagaagggcaacgtg (SEQ ID NO: 578) |
| 418-2<br>(D161<br>R/R88<br>8K/R8<br>92A) | atgaaggccgagctgttcaagacattcgtggacgaataccccgtgtctaa<br>gacactgcggttcagcctgattcctgtgggcagaacccctggaaaacatcg<br>aaaaggacggcatcctggattgtgatgagaagcgatctgaagaatacaag<br>agagtgaagaagctgctggatgaatactacaagacattcatcgagcacgc<br>cctgaccaatgtagaactggatatcaactccctggaagaatacgagagac<br>tctacaacatcaaaaacaagtcagacaaggaaaaggccgattttgacagc<br>gtgcagaaaaacctaaggaaacagattgtgaaggccctgaaggaggatgc<br>gaagtacaagttcctttttcaagaaggaaatcatcgagaaggaactggtag<br>atttctgaacggcagagacagcgatgtggagctggtcaagtccttcaag<br>ggctacgctaccatgttccaaggcttctggagagctcgaaagaatatctt<br>cagcgacgaagagaaaagcaccgccatcgctacagaatcatcaacgaaa<br>atctgcctaagtttatctctaataaaaacatctacttcaccaagatccag<br>cctgagatggatgccgagctggaccagctgacactgagcaacaacagcaa<br>tgagatcagagatatctttaagctggagtattcagcaaaaccatcaccc<br>agacaggcatcgagatctataatgaattctgggcggatacaccatcgat<br>gaacaggtgaaactgcagggaatcaacgagatcgtgaacctgcataatca<br>gaagaacaaggacagtggcaagatcccaaagctgaagatgctgtataagc<br>agatcctgagcgatacaaacacgctgtcattcatcgccgaaggctttgag<br>accgatgacgaggttctggaatcgcttaatattttctacgacgtgttcaa<br>cgagaacatcctggacgaggacctgggtataatcaacctgctgagaaaca<br>tcgataagttctctcctacgatgggatctacatcaagaatgacaaggccctg<br>atcgacatcagcaactacctgttcggtgactggcactacatcaaaaacgc<br>catcaataaaaatatgagatcgataaccctggcaagaacacagagaagt<br>acatcgtgaaaagaaataaattcatcaagagcttcgactcttcagcctg<br>aagtacctgcaggactgtacaggcagcaagttcaacgagcacatcctgat<br>caagatcaacaacctgatcgacgacgtgaagaaggcttacaacagcgtcg<br>ccctgctgatcaagaacaagtacgagggaaccaacctgatcaacgacaag<br>gacgccatcgagaagatcaagcaatttctggacagcatgaagagcctggt<br>gtccttcatcagatgcttcgaaggcacaggccaggagcctgacagagatg<br>aaatcttctacggcgagttcgataccggcaagaagaccttctactacctg |

| ID | Protein coding sequence |
|---|---|
| | aacaacatctacaacaagaccagaaactacgtgaccaagaagccctacag catcgagaaatacaagctgaacttcgacaatgccgaactgctgaccggat gggatctgaacaaggagacatctaaggcctccatcattctgaagaaggac aatctgtactatctcggaatcatgaagaagtctgatagacgggtgttcct gaacgtgccagaaaccgagagcacctacaactgctacgagaagatggagt acaaactgctccccggccctaacaaaatgctgcctaaggtcttcttcgcc aaaagtaacatcgactactacgaccctagccccgagattatgcggatcta caaggagggcaccttcaaaaaggggggataacttcaacattgacgactgcc acgacttaatcgactacttcaaagagagcctggacaagaacgacgattgg aaaatcttcgattttgacttcagcgagacaagcagctacaaggacatcgg agaattctataaggaagttcagcagcagggctacaaaaatcagctttaaga acatcgccagcagctatgtggacgagcttgtggagaacggaaagctgtac ctgttccagatctacaacaaggactttttctaagaactctaaaggcaccga gaacctgcacacaatgtactggcgggccctgttcgacgaggagaacctgg aaaatgtgatctacaagctgaacggcgacgccgagatcttttttcagaaga aaatccatatccgagaacgagaagatcgtgcacccagcccacgtggacgat tgagaataaaaatgacgagactcggaaggaaaaaaagacaagcatctta actacgacatcatcaaggataagagattcaccgtggacaaatttcagttt cacgtgcccatcaccctgaactttcaggccatcgatcggaagagcgatat caacctcagaatgcggcaggagatcaaaaagaacaaggacatgcacatca tcggcatagacagaggcgagagaaaaccttctgtatatcagcatcatcgac ctggacggcaatatcgttaagcaggagagcctcaacaccatcaccaacga atacgacggcaagatttataccacagactatcacaagctgctcgacaaga aggaggagaagaagaaagtcgccgcccagacctggaacaccatcgagaat atcaaggaactgaaagctggatacatgagccaggtggtgcataaaattac acagctgatgatggaatacaacgcaatcgtcgtgctcgaggatctaaaca ccggcttcaagcggggcaggcaaaaggtggaaaagcagatctaccaggcc ttcgagaaagccctgatcaacaagctgaactactacgtggacaagaaggt ggataagaacgaaataagcggcctgtacaagcctctgcagctgaccaagg agttcgaaagctttaaaaagctgggcaagcagtctggagccatcttctat gtgcctgcttggaacacaagcaagatggaccccaccaccggcttcgtgaa tctgctgtctgtcaagtacgagaacatggaaaagtccaaagagttcatca acaaaatcaaggacatcaacttcaaggaggatgactgcggcaaatactac gaatttcacatcgatttcaacgaattcaccgacaagggcaaggacaccaa gaccgattggaatatctgcagctttggcaagcggatcgacaacgcaagaa atcagaaaggagatttcgagtccaagatgatcgacctgacaaacgagttc cacaacctgttcaagaagtacggcatcaacgacaacagcaatctgaagga ggacatcctgaatgtgaaggaagctaaattttacaaggaattcatcaacc tgttcaagctgatgctgcaaatccggaattctgagagcaatgaaaaggtg gacttcctgcaaagtcctgtgaaaacaacaagggcgagttcttcaactc taacaacgtgaacggcaacgaggcccctgagaatgccgacgccaacggcg cctacaacatagctagaaagggcctgtggatcgtgaaccagatcaagacc atgcctgatagccagatgcacaaaattaagctggccatgaagaaccagga atggctgctgttcgcccagaagggcaacgtg (SEQ ID NO: 579) |
| 418-3 (D161 R/T53 2R/K5 38R) | atgaaggccgagctgttcaagacattcgtggacgaataccccgtgtctaa gacactgcggttcagcctgattcctgtgggcagaaccctggaaaacatcg aaaaggacggcatcctggattgtgatgagaagcgatctgaagaatacaag agagtgaagaagctgctggatgaatactacaagacattcatcgagcacgc cctgaccaatgtagaactggatatcaactccctggaagaatacgagagac tctacaacatcaaaaacaagtcagacaaggaaaaggccgattttgacagc gtgcagaaaaacctaaggaaacagattgtgaaggccctgaaggaggatga gaagtacaagttccttttcaagaagggaaatcatcgagaaggaactggtag attttctgaacggcagagacagcgatgtggagctggtcaagtccttcaag ggctacgctaccatgttccaaggcttctggagagctcgaaagaatatctt cagcgacgaagagaaaagcaccgccatcgcctacagaatcatcaacgaaa atctgcctaagtttatctctaataaaaacatctacttcaccaagatccag cctgagatggatgccgagctggaccagctgacactgagcaacaacagcaa tgagatcagagatatctttaagctggagtattcagcaaaaccatcaccc agacaggcatcgagatctataatgaattctgggcggatacaccatcgat gaacaggtgaaactgcaggaatcaacgagatcgtgaacctgcataatca gaagaacaaggacagtggcaagatcccaaagctgaagatgctgtataagc agatcctgagcgatacaaaacacgctgtcattcatcgccgaaggctttgag accgatgacgaggttctggaatcgcttaatattttctacgacgtgttcaa cgagaacatcctggacgaggacctgggtataatcaacctgctgagaaaca tcgataagttctctcctacgatgggatctacatcaagaatgacaaggccctg atcgacatcagcaactacctgttcggtgactggcactacatcaaaaacgc catcaataaaaaatatgagatcgataaccctggcaagaacacagagaagt acatcgtgaaaagaaataaattcatcaagagcttcgactctttcagcctg aagtacctgcaggactgtacaggcagcaagttcaacgagcacatcctgat caagatcaacaacctgatcgacgacgtgaagaaggcttacaacagcgtcg ccctgctgatcaagaacaagtacgagggaaccaacctgatcaacgacaag gacgccatcgagaagatcaagcaatttctggacagcatgaagagcctggt gtccttcatcagatgcttcgaaggcacaggccaggagcctgacagagatg aaatcttctacggcgagttcgataccggcaagaagaccttctactacctg aacaacatctacaacaagaccagaaactacgtgaccaagaagccctacag catcgagaaatacaagctgaacttcgacaatgccgaactgctgagaggat |

-continued

| ID | Protein coding sequence |
|---|---|
| | gggatctgaacagagagacatctaaggcctccatcattctgaagaaggac
aatctgtactatctcggaatcatgaagaagtctgatagacgggtgttcct
gaacgtgccagaaaccgagagcacctacaactgctacgagaagatggagt
acaaactgctcccgggccctaacaaaatgctgcctaaggtcttcttcgcc
aaaagtaacatcgactactacgaccctagccccgagattatgcggatcta
caaggagggcaccttcaaaaaggggggataacttcaacattgacgactgcc
acgacttaatcgactacttcaaagagagcctggacaagaacgacgattgg
aaaatcttcgattttgacttcagcgagacaagcagctacaaggacatcgg
agaattctataaggaagttcagcagcagggctacaaaatcagctttaaga
acatcgccagcagctatgtggacgagcttgtggagaacggaaagctgtac
ctgttccagatctacaacaaggacttttctaagaactctaaaggcaccga
gaacctgcacacaatgtactggcgggccctgttcgacgaggagaacctgg
aaaatgtgatctacaagctgaacggcgacgccgagatcttttttcagaaga
aaatccatatccgagaacgagaagatcgtgcacccagcccacgtggagat
tgagaataaaaatgacgagactcggaaggaaaaaaagacaagcatcttta
actacgacatcatcaaggataagagattcaccgtggacaaatttcagttt
cacgtgcccatcaccctgaactttcaggccatcgatcggaagagcgatat
caacctcagaatgcggcaggagatcaaaaagaacaaggacatgcacatca
tcggcatagacagaggcgagagaaaccttctgtatatcagcatcatcgac
ctggacggcaatatcgttaagcaggagagcctcaacaccatcaccaacga
atacgacggcaagatttataccacagactatcacaagctgctcgacaaga
aggaggagaagcgcaaagtcgccagacagacctggaacaccatcgagaat
atcaaggaactgaaagctggatacatgagccaggtggtgcataaaattac
acagctgatgatgaatacaacgcaatcgtcgtgctggaagatctaaaca
ccggcttcaagcggggcaggcaaaaggtggaaaagcagatctaccaggcc
ttcgagaaagccctgatcaacaagctgaactactacgtggacaagaaggt
ggataagaacgaaataagcggcctgtacaagcctctgcagctgaccaagg
agttcgaaagctttaaaaaagctgggcaagcagtctggagccatcttctat
gtgcctgcttggaacacaagcaagatggaccccaccaccggcttcgtgaa
tctgctgtctgtcaagtacgagaacatggaaaagtccaaagagttcatca
acaaaatcaaggacatcaacttcaaggaggatgactgcggcaaatactac
gaatttcacatcgatttcaacgaattcaccgacaagggcaaggacaccaa
gaccgattggaatatctgcagctttggcaagcggatcgacaacgcaagaa
atcagaaaggagatttcgagtccaagatgatcgacctgacaaacgagttc
cacaacctgttcaagaagtacggcatcaacgacaacagcaatctgaagga
ggacatcctgaatgtgaaggaagctaaattttacaaggaattcatcaacc
tgttcaagctgatgctgcaaatccggaattctgagagcaatgaaaaggtg
gacttcctgcaaagtcctgtgaaaaacaacaagggcgagttcttcaactc
taacaacgtgaacggcaacgaggcccctgagaatgccgacgccaacggcg
cctacaacatagctagaaagggcctgtggatcgtgaaccagatcaagacc
atgcctgatagccagatgcacaaaattaagctggccatgaagaaccagga
atggctgctgttcgcccagaagggcaacgtg (SEQ ID NO: 580) |
| 418-4
(N527
R/Q79
9L) | atgaaggccgagctgttcaagacattcgtggacgaataccccgtgtctaa
gacactgcggttcagcctgattcctgtgggcagaacccctggaaaacatcg
aaaaggacggcatcctggattgtgatgagaagcgatctgaagaatacaag
agagtgaagaagctgctggatgaatactacaagacattcatcgagcacgc
cctgaccaatgtagaactggatatcaactccctggaagaatacgagagac
tctacaacatcaaaaacaagtcagacaaggaaaaggccgattttgacagc
gtgcagaaaaacctaaggaaacagattgtgaaggccctgaaggaggatga
gaagtacaagttccttttcaagaaggaaatcatcgagaaggaactggtag
atttctgaacggcagagacagcgatgtggagctggtcaagtccttcaag
ggctacgctaccatgttccaaggcttctgggacgctagaaagaatatctt
cagcgacgaagagaaaagcaccgccatcgcctacagaatcatcaacgaaa
atctgcctaagtttatctctaataaaaacatctacttcaccaagatccag
cctgagatggatgccgagctggaccagctgacactgagcaacaacagcaa
tgagatcagagatatctttaagctggagtatttcagcaaaaccatcaccc
agacaggcatcgagatctataatgaattctgggcggatacaccatcgat
gaacaggtgaaactgcagggaatcaacgagatcgtgaacctgcataatca
gaagaacaaggacagtggcaagatcccaaagctgaagatgctgtataagc
agatcctgagcgatacaaacacgctgtcattcatcgccgaaggctttgag
accgatgacgaggttctggaatcgcttaatattttctacgacgtgttcaa
cgagaacatcctggacgaggacctgggtataatcaacctgctgagaaaca
tcgataagttctcctacgatgggatctacatcaagaatgacaaggccctg
atcgacatcagcaactacctgttcggtgactggcactacatcaaaaacgc
catcaataaaaaatatgagatcgataaccctggcaagaacacagagaagt
acatcgtgaaaagaaataaattcatcaagagcttcgactcttttcagcctg
aagtacctgcaggactgtacaggcagcaagttcaacgagcacatcctgat
caagatcaacacctgatcgacgacgtgaagaaggcttacaacagcgtcg
ccctgctgatcaagaacaagtacgagggaaccaacctgatcaacgacaag
gacgccatcgagaagatcaagcaatttctggacagcatgaagagcctggt
gtccttcatcagatgcttcgaaggcacaggccaggagcctgacagagatg
aaatcttctacggcgagttcgataccggcaagaagaccttctactacctg
aacaacatctacaacaagaccagaaactacgtgaccaagaagccctacag
catcgagaaatacaagctgaacttcgacgagccgagctcctgaccggat
gggatctgaacaaggagacatctaaggcctccatcattctgaagaaggac
aatctgtactatctcggaatcatgaagaagtctgatagacgggtgttcct |

-continued

| ID | Protein coding sequence |
|---|---|
| | gaacgtgccagaaaccgagagcacctacaactgctacgagaagatggagt
acaaactgctccccggccctaacaaaatgctgcctaaggtcttcttcgcc
aaaagtaacatcgactactacgaccctagccccgagattatgcggatcta
caaggagggcaccttcaaaaaggggggataacttcaacattgacgactgcc
acgacttaatcgactacttcaaagagagcctggacaagaacgacgattgg
aaaatcttcgattttgacttcagcgagacaagcagctacaaggacatcgg
agaattctataaggaagttcagcagcagggctacaaaatcagctttaaga
acatcgccagcagctatgtggacgagcttgtggagaacggaaagctgtac
ctgttccagatctacaacaaggacttttctaagaactctaaaggcaccga
gaacctgcacacaatgtactggggccctgttcgacgaggagaacctgga
aaatgtgatctacaagctgaacggcgacgccgagatcttttcagaagaa
aatccatatccgagaacgagaagatcgtgcacccagcccacgtggagatt
gagaataaaaatgacgagactcggaaggaaaaaaagactagtatctttaa
ctacgacatcatcaaggataagagattcaccgtggacaaatttctgtttc
acgtgcccatcaccctgaactttcaggccatcgatcggaagagcgatatc
aacctcagaatgcggcaggagatcaaaaagaacaaggacatgcacatcat
cggcatagacagaggcgagagaaaccttctgtatatcagcatcatcgacc
tggacggcaatatcgttaagcaggagagcctcaacaccatcaccaacgaa
tacgacggcaagattttataccacagactatcacaagctgctcgacaagaa
ggaggagaagcgcaaagtcgccagacagacctggaacaccatcgagaata
tcaaggaactgaaagctggatacatgagccaggtggtgcataaaattaca
cagctgatgatggaatacaacgcaatcgtcgtgctggaagatctaaacac
cggcttcaagcggggcaggcaaaaggtggaaaagcagatctaccaggcct
tcgagaaagccctgatcaacaagctgaactactacgtggacaagaaggtg
gataagaacgaaataagcggcctgtacaagcctctgcagctgaccaagga
gttcgaaagctttaaaaagctgggcaagcagtctggagccatcttctatg
tgcctgcttggaacacaagcaagatggaccccaccaccggcttcgtgaat
ctgctgtctgtcaagtacgagaacatggaaaagtccaaagagttcatcaa
caaaatcaaggacatcaacttcaaggaggatgactgcggcaaatactacg
aatttcacatcgatttcaacgaattcaccgacaagggcaaggacaccaag
accgattggaatatctgcagctttggcaagcggatcgacaacgcaagaaa
tcagaaaggagatttcgagtccaagatgatcgacctgacaaacgagttcc
acaacctgttcaagaagtacggcatcaacgcaacagcaatctgaaggag
gacatcctgaatgtgaaggaagctaaattttacaaggaattcatcaacct
gttcaagctgatgctgcaaatccggaattctgagagcaatgaaaaggtgg
acttcctgcaaagtcctgtgaaaaacaacaagggcgagttcttcaactct
aacaacgtgaacggcaacgaggccctgagaatgccgacgccaacggcgc
ctacaacatagctagaaagggcctgtggatcgtgaaccagatcaagacca
tgcctgatagccagatgcacaaaattaagctggccatgaagaaccaggaa
tggctgctgttcgcccagaagggcaacgtg (SEQ ID NO: 581) |
| 418-5
(N527
R) | atgaaggccgagctgttcaagacattcgtggacgaatacccgtgtctaa
gacactgcggttcagcctgattcctgtgggcagaaccctggaaaacatcg
aaaaggacggcatcctggattgtgatgagaagcgatctgaagaatacaag
agagtgaagaagctgctggatgaatactacaagacattcatcgagcacgc
cctgaccaatgtagaactggatatcaactccctggaagaatacgagagac
tctacaacatcaaaaacaagtcagacaaggaaaaggccgattttgacagc
gtgcagaaaaacctaaggaaacagattgtgaaggccctgaaggaggatga
gaagtacaagttcctttcaagaaggaaatcatcgaagaagaactggtag
atttttctgaacggcagagacagcgatgtggagctggtcaagtccttcaag
ggctacgctaccatgttccaaggcttctgggacgctagaaagaatatctt
cagcgacgaagagaaaagcaccgccatcgcctacagaatcatcaacgaaa
atctgcctaagtttatctctaataaaaacatctacttcaccaagatccag
cctgagatggatgccgagctggaccagctgacactgagcaacaacagcaa
tgagatcagagatatcttaagctggagtattcagcaaaaccatcaccc
agacaggcatcgagatctataatggaattctgggcggatacaccatcgat
gaacaggtgaaactgcagggaatcaacgagatcgtgaacctgcataatca
gaagaacaaggacagtggcaagatcccaaagctgaagatgctgtataagc
agatcctgagcgatacaaacacgctgtcattcatcgccaaggctttgag
accgatgacgaggttctggaatcgcttaatattttctacgacgtgttcaa
cgagaacatcctggacgaggacctgggtataatcaacctgctgagaaaca
tcgataagttctcctacgatgggatctacatcaagaatgacaaggccctg
atcgacatcagcaactacctgttcggtgactggcactacatcaaaaacgc
catcaataaaaaatatgagatcgataaccctggcaagaacacagagaagt
acatcgtgaaaagaaataaattcatcaagagcttcgactctttcagcctg
aagtacctgcaggactgtacaggcagcaagttcaacgagcacatcctgat
caagatcaacaacctgatcgacgacgtgaagaaggcttacaacagcgtcg
ccctgctgatcaagaacaagtacgagggaaccaacctgatcaacgacaag
gacgccatcgagaagatcaagcaatttctggacagcatgaagagcctggt
gtccttcatcagatgcttcgaaggcacaggccaggagcctgacagagatg
aaatcttctacggcgagttcgataccggcaagaagaccttctactacctg
aacaacatctacaacaagaccagaaactacgtgaccaagaagcccctacag
catcgagaaatacaagctgaacttcgacagaccgagctcctgaccggat
gggatctgaacaaggagacatctaaggcctccatcattctgaagaaggac
aatctgtactatctcggaatcatgaagaagtctgatagacgggtgttcct
gaacgtgccagaaaccgagagcacctacaactgctacgagaagatggagt
acaaactgctccccggccctaacaaaatgctgcctaaggtcttcttcgcc |

-continued

| ID | Protein coding sequence |
|---|---|
| | aaaagtaacatcgactactacgaccctagccccgagattatgcggatcta<br>caaggagggcaccttcaaaaggggggataacttcaacattgacgactgcc<br>acgacttaatcgactacttcaaagagagcctggacaagaacgacgattgg<br>aaaatcttcgattttgacttcagcgagacaagcagctacaaggacatcgg<br>agaattctataaggaagttcagcagcagggctacaaaatcagcttttaaga<br>acatcgccagcagctatgtggacgagcttgtggagaacggaaagctgtac<br>ctgttccagatctacaacaaggacttttctaagaactctaaaggcaccga<br>gaacctgcacacaatgtactggcggggccctgttcgacgaggagaacctgg<br>aaaatgtgatctacaagctgaacggcgacgccgagatcttttttcagaaga<br>aaatccatatccgagaacgagaagatcgtgcacccagcccacgtggagat<br>tgagaataaaaatgacgagactcggaaggaaaaaaagacaagcatccttta<br>actacgacatcatcaaggataagagattcaccgtggacaaatttcagttt<br>cacgtgcccatcaccctgaactttcaggccatcgatcggaagagcgatat<br>caacctcagaatgcggcaggagatcaaaaagaacaaggacatgcacatca<br>tcggcatagacagaggcgagagaaaccttctgtatatcagcatcatcgac<br>ctggacggcaatatcgttaagcaggagagcctcaacaccatcaccaacga<br>atacgacggcaagatttataccacagactatcacaagctgctcgacaaga<br>aggaggagaagcgcaaagtcgccagacagacctggaacaccatcgagaat<br>atcaaggaactgaaagctggatacatgagccaggtggtgcataaaattac<br>acagctgatgatggaatacaacgcaatcgtcgtgctggaagatctaaaca<br>ccggcttcaagcggggcaggcaaaaggtggaaaagcagatctaccaggcc<br>ttcgagaaagccctgatcaacaagctgaactactacgtggacaagaaggt<br>ggataagaacgaaataagcggcctgtacaagcctctgcagctgaccaagg<br>agttcgaaagctttaaaaagctgggcaagcagtctggagccatcttctat<br>gtgcctgcttggaacacaagcaagatggaccccaccaccggcttcgtgaa<br>tctgctgtctgtcaagtacgagaacatggaaaagtccaaagagttcatca<br>acaaaatcaaggacatcaacttcaaggaggatgactgcggcaaatactac<br>gaatttcacatcgatttcaacgaattcaccgacaagggcaaggacaccaa<br>gaccgattggaatatctgcagctttggcaagcggatcgacaacgcaagaa<br>atcagaaaggagatttcgagtccaagatgatcgacctgacaaacgagttc<br>cacaacctgttcaagaagtacggcatcaacgacaacagcaatctgaagga<br>ggacatcctgaatgtgaaggaagctaaattttacaaggaattcatcaacc<br>tgttcaagctgatgctgcaaatccggaattctgagagcaatgaaaaggtg<br>gacttcctgcaaagtcctgtgaaaaacaacaagggcgagttcttcaactc<br>taacaacgtgaacggcaacgaggcccctgagaatgccgacgccaacggcg<br>cctacaacatagctagaaagggcctgtggatcgtgaaccagatcaagacc<br>atgcctgatagccagatgcacaaaattaagctggccatgaagaaccagga<br>atggctgctgttcgcccagaagggcaacgtg (SEQ ID NO: 582) |
| 418-6<br>(Q799<br>L) | atgaaggccgagctgttcaagacattcgtggacgaataccccgtgtctaa<br>gacactgcggttcagcctgattcctgtgggcagaaccctgaaaacatcg<br>aaaaggacggcatcctggattgtgatgagaagcgatctgaagaatacaag<br>agagtgaagaagctgctggatgaatactacaagacattcatcgagcacgc<br>cctgaccaatgtagaactggatatcaactccctggaagaatacgagagac<br>tctacaacatcaaaaacaagtcagacaaggaaaaggccgattttgacagc<br>gtgcagaaaaacctaaggaaacagattgtgaaggccctgaaggaggatga<br>gaagtacaagttcctttttcaagaaggaaatcatcgagaaggaactggtag<br>attttctgaacggcagagacagcgatgtggagctggtcaagtccttcaag<br>ggctacgctaccatgttccaaggcttctgggacgctagaaagaatatctt<br>cagcgacgaagagaaaagcaccgccatcgcctacagaatcatcaacgaaa<br>atctgcctaagtttatctctaataaaaacatctacttcaccaagatccag<br>cctgagatggatgccgagctggaccagctgacactgagcaacaacagcaa<br>tgagatcagagatatctttaagctggagtatttcagcaaaaccatcacccc<br>agacaggcatcgagatctataatgaattctgggcggatacaccatcgat<br>gaacaggtgaaactgcagggaatcaacgagatcgtgaacctgcataatca<br>gaagaacaaggacagtggcaagatcccaaagctgaagatgctgtataagc<br>agatcctgagcgatacaaacacgctgtcattcatcgccgaaggctttgag<br>accgatgacgaggttctggaatcgcttaatattttctacgacgtgttcaa<br>cgagaacatcctggacgaggacctgggtataatcaacctgctgagaaaca<br>tcgataagttctcctacgatgggatctacatcaagaatgacaaggccctg<br>atcgacatcagcaactacctgttcggtgactggcactacatcaaaaacgc<br>catcaataaaaaatatgagatcgataaccctggcaagaacacagagaagt<br>acatcgtgaaaagaaataaattcatcaagagcttcgactcttttcagcctg<br>aagtacctgcaggactgtacaggcagcaagttcaacgagcacatcctgat<br>caagatcaacaacctgatcgacgacgtgaagaaggcttacaacagcgtcg<br>ccctgctgatcaagaacaagtacgagggaaccaacctgatcaacgacaag<br>gacgccatcgagaagatcaagcaatttctggacagcatgaagagcctggt<br>gtccttcatcagatgcttcgaaggcacaggccaggagcctgacagagatg<br>aaatcttctacggcgagttcgataccggcaagaagaccttctactacctg<br>aacaacatctacaacaagaccagaaactacgtgaccaagaagccctacag<br>catcgagaaatacaagctgaacttcgacaatgccgaactgctgaccggat<br>gggatctgaacaaggagacatctaaggcctccatcattctgaagaaggac<br>aatctgtactatctcggaatcatgaagaagtctgatagacgggtgttcct<br>gaacgtgccagaaaccgagagcacctacaactgctacgaagatgggagt<br>acaaactgctccccggccctaacaaaatgctgcctaaggtcttcttcgcc<br>aaaagtaacatcgactactacgaccctagccccgagattatgcggatcta<br>caaggagggcaccttcaaaaggggggataacttcaacattgacgactgcc |

| ID | Protein coding sequence |
|---|---|
| | acgacttaatcgactacttcaaagagagcctggacaagaacgacgattgg<br>aaaatcttcgatttgacttcagcgagacaagcagctacaaggacatcgg<br>agaattctataaggaagttcagcagcagggctacaaaatcagcttttaaga<br>acatcgccagcagctatgtggacgagcttgtggagaacggaaagctgtac<br>ctgttccagatctacaacaaggacttttctaagaactctaaaggcaccga<br>gaacctgcacacaatgtactggcgggccctgttcgacgaggagaacctgg<br>aaaatgtgatctacaagctgaacggcgacgccagatcttttcagaaga<br>aaatccatatccgagaacgagaagatcgtgcacccagcccacgtggagat<br>tgagaataaaaatgacgagactcggaaggaaaaaaagactagtatcttta<br>actacgacatcatcaaggataagagattcaccgtggacaaatttctgttt<br>cacgtgcccatcaccctgaactttcaggccatcgatcggaagagcgatat<br>caacctcagaatgcggcaggagatcaaaaagaacaaggacatgcacatca<br>tcggcatagacagaggcgagagaaaccttctgtatatcagcatcatcgac<br>ctggacggcaatatcgttaagcaggagagcctcaacaccatcaccaacga<br>atacgacggcaagatttataccacagactatcacaagctgctcgacaaga<br>aggaggagaagcgcaaagtcgccagacagacctgaacaccatcgagaat<br>atcaaggaactgaaagctggatacatgagccaggtggtgcataaaattac<br>acagctgatgatggaatacaacgcaatcgtcgtgctggaagatctaaaca<br>ccggcttcaagcggggcaggcaaaaggtggaaagcagatctaccaggcc<br>ttcgagaaagccctgatcaacaagctgaactactacgtggacaaagctca<br>ggataagaacgaaataagcggcctgtacaagcctctgcagctgaccaagg<br>agttcgaaagctttaaaaagctgggcaagcagtctggagccatcttctat<br>gtgcctgcttggaacacaagcaagatggaccccaccaccggcttcgtgaa<br>tctgctgtcgtcaagtacgagaacatggaaaagtccaaagagttcaatca<br>acaaaatcaaggacatcaacttcaaggaggatgactgcggcaaatactac<br>gaatttcacatcgatttcaacgaattcaccgacaagggcaaggacaccaa<br>gaccgattggaatatctgcagctttggcaagcggatcgacaacgcaagaa<br>atcagaaaggagatttcgagtccaagatgatcgacctgacaaacgagttc<br>cacaacctgttcaagaagtacggcatcaacgacaacagcaatctgaagga<br>ggacatcctgaatgtgaaggaagctaaatttttacaaggaattcatcaacc<br>tgttcaagctgatgctgcaaatccggaattctgagagcaatgaaaaggtg<br>gacttcctgcaaagtcctgtgaaaaacaacaagggcgagttcttcaactc<br>taacaacgtgaacggcaacgaggcccctgagaatgccgacgccaacggcg<br>cctacaacatagctagaaagggcctgtggatcgtgaaccagatcaagacc<br>atgcctgatagccagatgcacaaaattaagctggccatgaagaaccagga<br>atggctgctgttcgcccagaagggcaacgtg (SEQ ID NO: 583) |

2. Protein Sequences (SEQ ID Nos: 584-602)

| ID | Protein sequence |
|---|---|
| 405<br>wild-<br>type | MARIIDEFCGQMNGYSRSITLRNRLVPIGK<br>TEENLKQFLEKDLERATAYPDIKNLIDAIH<br>RNVIEDTLSKVALNWNEIFNILATYQNEKD<br>KKKKAAIKKDLEKLQSGARKKIVEAFKKNP<br>DFEKLFKEGLFKELLPELIKSAPVDEIAVK<br>TKALECFNRFSTYFTGFHDNRKNMYSEEAK<br>STAISYRIVNENFPKFFANIKLFNYLKEHF<br>PRIIIDTEESLKDYLKGKKLDSVFSIDGFN<br>SVLAQSGIDFYNTVIGGISGEAGTKKTQGL<br>NEKINLARQQLSKEEKNKLRGKMVVLFKQI<br>LSDRETSSFIPVGFANKEEVYSTVKEFNNS<br>IAEKAVSKVRDLFLHREEFTLNEIFVPAKS<br>LTDFSQAIFGSWSILSEGLFLLEKDSMKKA<br>LSESQEEKINKEIAKKDCSFTELQLAYERY<br>CTEHNLPVEKFCKDYFDIVDYRGNGAKSEK<br>TKVSILSEILETFLQLDFDHIQDLQQEKNA<br>AIPIKAYLDEVQNLYHHLKLVDYRGEEQKD<br>STFYSKHDEILTDLSQIVPLYNKVRNFVTK<br>KLGESKKIKLNFDCPTLANGWDENQESSND<br>AIILRKDGKYYLGIYNPNNKPKFAKKDSIV<br>GDCYEKMAYKQIALPMGLGAFVRKCFGTAQ<br>KYGWGCPENCLNSEGKIIIKDEEAKGNLEA<br>IIDCYKDFLNKYEKDGFKYDYNFSFLDSA<br>SYEKLSDFFNDVKPQGYKLSFTSIPLSEID<br>KMIDEGKLFLFQIYNKDFAKKATGKKNLHT<br>LYWENLFSVENLQDVVLKLNGEAELFWREA<br>SIKKDKVIVHKKGSILVNRTTTDGKSIPEA<br>IYQEIYQLKNKMADSISDEAKRLLESGTVV<br>CKVATHDIVKDKHFTENTYLFHCPITMNFK<br>AKDRTNKEFNNVHLEVLNKNPDIKVIGLDR<br>GERHLLYLSLINQKGEIECQKTLNLVEQVR<br>NDKTVSVNYHEKLVHKEGSRDAARKNWQTI<br>GNIKELKEGYLSAVVHEIASLMVKHNAIVV<br>MEDLNFGFKRGRFAVERQIYQKFENMLIEK<br>LNYLVFKDRKVTEPGGVLNAYQLANKSAKV<br>TDVYKQCGWLFYIPAAYTSKIDPRTGFANL<br>FITKGLTNVEKKKEFFGKFDSIRYDATESC<br>FVFSFDYAKICDNADYKKKWDVYTRGTRLV<br>YNKTERKNVSVNPTEELQCVFDEFGIKWNT<br>GEDLIESISLIPAEKSNAKFFDVLLRMFNA<br>TLQMRNSVPNTDTDYLVSPVKAEDGSFFDS<br>REEFKKGGDARLPIDCDANGAYHIALKGLY<br>LLLNDFNRDNKGVIQNISNKDWFKFVQEKV<br>YKD (SEQ ID NO: 584) |
| 405-1<br>(D169<br>R) | MARIIDEFCGQMNGYSRSITLRNRLVPIGK<br>TEENLKQFLEKDLERATAYPDIKNLIDAIH<br>RNVIEDTLSKVALNWNEIFNILATYQNEKD<br>KKKKAAIKKDLEKLQSGARKKIVEAFKKNP<br>DFEKLFKEGLFKELLPELIKSAPVDEIAVK<br>TKALECFNRFSTYFTGFHRNRKNMYSEEAK<br>STAISYRIVNENFPKFFANIKLFNYLKEHF<br>PRIIIDTEESLKDYLKGKKLDSVFSIDGFN<br>SVLAQSGIDFYNTVIGGISGEAGTKKTQGL<br>NEKINLARQQLSKEEKNKLRGKMVVLFKQI<br>LSDRETSSFIPVGFANKEEVYSTVKEFNNS<br>IAEKAVSKVRDLFLHREEFTLNEIFVPAKS<br>LTDFSQAIFGSWSILSEGLFLLEKDSMKKA<br>LSESQEEKINKEIAKKDCSFTELQLAYERY<br>CTEHNLPVEKFCKDYFDIVDYRGNGAKSEK<br>TKVSILSEILETFLQLDFDHIQDLQQEKNA<br>AIPIKAYLDEVQNLYHHLKLVDYRGEEQKD<br>STFYSKHDEILTDLSQIVPLYNKVRNFVTK<br>KLGESKKIKLNFDCPTLANGWDENQESSND<br>AIILRKDGKYYLGIYNPNNKPKFAKKDSIV<br>GDCYEKMAYKQIALPMGLGAFVRKCFGTAQ<br>KYGWGCPENCLNSEGKIIIKDEEAKGNLEA |

| ID | Protein sequence |
|---|---|
| | IIDCYKDFLNKYEKDGFKYDYNFSFLDSA
SYEKLSDFFNDVKPQGYKLSFTSIPLSEID
KMIDEGKLFLFQIYNKDFAKKATGKKNLHT
LYWENLFSVENLQDVVLKLNGEAELFWREA
SIKKDKVIVHKKGSILVNRTTTDGKSIPEA
IYQEIYQLKNKMADSISDEAKRLLESGTVV
CKVATHDIVKDKHFTENTYLFHCPITMNFK
AKDRTNKEFNNHVLEVLNKNPDIKVIGLDR
GERHLLYLSLINQKGEIECQKTLNLVEQVR
NDKTVSVNYHEKLVHKEGSRDAARKNWQTI
GNIKELKEGYLSAVVHEIASLMVKHNAIVV
MEDLNFGFKRGRFAVERQIYQKFENMLIEK
LNYLVFKDRKVTEPGGVLNAYQLANKSAKV
TDVYKQCGWLFYIPAAYTSKIDPRTGFANL
FITKGLTNVEKKKEFFGKFDSIRYDATESC
FVFSFDYAKICDNADYKKKWDVYTRGTRLV
YNKTERKNVSVNPTEELQCVFDEFGIKWNT
GEDLIESISLIPAEKSNAKFFDVLLRMFNA
TLQMRNSVPNTDTDYLVSPVKAEDGSFFDS
REEFKKGGDARLPIDCDANGAYHIALKGLY
LLLNDFNRDNKGVIQNISNKDWFKFVQEKVY
KD (SEQ ID NO: 585) |
| 405-2
(D169
R/R95
OK/R9
54A) | MARIIDEFCGQMNGYSRSITLRNRLVPIGK
TEENLKQFLEKDLERATAYPDIKNLIDAIH
RNVIEDTLSKVALNWNEIFNILATYQNEKD
KKKKAAIKKDLEKLQSGARKKIVEAFKKNP
DFEKLFKEGLFKELLPELIKSAPVDEIAVK
TKALECFNRFSTYFTGFHRNRKNMYSEEAK
STAISYRIVNENFPKFFANIKLFNYLKEHF
PRIIIDTEESLKDYLKGKKLDSVFSIDGFN
SVLAQSGIDFYNTVIGGISGEAGTKKTQGL
NEKINLARQQLSKEEKNKLRGKMVVLFKQI
LSDRETSSFIPVGFANKEEVYSTVKEFNNS
IAEKAVSKVRDLFLHREEFTLNEIFVPAKS
LTDFSQAIFGSWSILSEGLFLLEKDSMKKA
LSESQEEKINKEIAKKDCSFTELQLAYERY
CTEHNLPVEKFCKDYFDIVDYRGNGAKSEK
TKVSILSEILETFLQLDFDHIQDLQQEKNA
AIPIKAYLDEVQNLYHHLKLVDYRGEEQKD
STFYSKHDEILTDLSQIVPLYNKVRNFVTK
KLGESKKIKLNFDCPTLANGWDENQESSND
AIILRKDGKYYLGIYNPNNKPKFAKKDSIV
GDCYEKMAYKQIALPMGLGAFVRKCFGTAQ
KYGWGCPENCLNSEGKIIIKDEEAKGNLEA
IIDCYKDFLNKYEKDGFKYDYNFSFLDSA
SYEKLSDFFNDVKPQGYKLSFTSIPLSEID
KMIDEGKLFLFQIYNKDFAKKATGKKNLHT
LYWENLFSVENLQDVVLKLNGEAELFWREA
SIKKDKVIVHKKGSILVNRTTTDGKSIPEA
IYQEIYQLKNKMADSISDEAKRLLESGTVV
CKVATHDIVKDKHFTENTYLFHCPITMNFK
AKDRTNKEFNNHVLEVLNKNPDIKVIGLDR
GERHLLYLSLINQKGEIECQKTLNLVEQVR
NDKTVSVNYHEKLVHKEGSKDAAAKNWQTI
GNIKELKEGYLSAVVHEIASLMVKHNAIVV
MEDLNFGFKRGRFAVERQIYQKFENMLIEK
LNYLVFKDRKVTEPGGVLNAYQLANKSAKV
TDVYKQCGWLFYIPAAYTSKIDPRTGFANL
FITKGLTNVEKKKEFFGKFDSIRYDATESC
FVFSFDYAKICDNADYKKKWDVYTRGTRLV
YNKTERKNVSVNPTEELQCVFDEFGIKWNT
GEDLIESISLIPAEKSNAKFFDVLLRMFNA
TLQMRNSVPNTDTDYLVSPVKAEDGSFFDS
REEFKKGGDARLPIDCDANGAYHIALKGLY
LLLNDFNRDNKGVIQNISNKDWFKFVQEKV
YKD (SEQ ID NO: 586) |
| 405-3
(D169
R/N55
9R/Q5
65R) | MARIIDEFCGQMNGYSRSITLRNRLVPIGK
TEENLKQFLEKDLERATAYPDIKNLIDAIH
RNVIEDTLSKVALNWNEIFNILATYQNEKD
KKKKAAIKKDLEKLQSGARKKIVEAFKKNP
DFEKLFKEGLFKELLPELIKSAPVDEIAVK
TKALECFNRFSTYFTGFHRNRKNMYSEEAK
STAISYRIVNENFPKFFANIKLFNYLKEHF
PRIIIDTEESLKDYLKGKKLDSVFSIDGFN
SVLAQSGIDFYNTVIGGISGEAGTKKTQGL
NEKINLARQQLSKEEKNKLRGKMVVLFKQI
LSDRETSSFIPVGFANKEEVYSTVKEFNNS
IAEKAVSKVRDLFLHREEFTLNEIFVPAKS
LTDFSQAIFGSWSILSEGLFLLEKDSMKKA
LSESQEEKINKEIAKKDCSFTELQLAYERY
CTEHNLPVEKFCKDYFDIVDYRGNGAKSEK
TKVSILSEILETFLQLDFDHIQDLQQEKNA
AIPIKAYLDEVQNLYHHLKLVDYRGEEQKD
STFYSKHDEILTDLSQIVPLYNKVRNFVTK
KLGESKKIKLNFDCPTLARGWDENRESSND
AIILRKDGKYYLGIYNPNNKPKFAKKDSIV
GDCYEKMAYKQIALPMGLGAFVRKCFGTAQ
KYGWGCPENCLNSEGKIIIKDEEAKGNLEA
IIDCYKDFLNKYEKDGFKYDYNFSFLDSA
SYEKLSDFFNDVKPQGYKLSFTSIPLSEID
KMIDEGKLFLFQIYNKDFAKKATGKKNLHT
LYWENLFSVENLQDVVLKLNGEAELFWREA
SIKKDKVIVHKKGSILVNRTTTDGKSIPEA
IYQEIYQLKNKMADSISDEAKRLLESGTVV
CKVATHDIVKDKHFTENTYLFHCPITMNFK
AKDRTNKEFNNHVLEVLNKNPDIKVIGLDR
GERHLLYLSLINQKGEIECQKTLNLVEQVR
NDKTVSVNYHEKLVHKEGSRDAARKNWQTI
GNIKELKEGYLSAVVHEIASLMVKHNAIVV
MEDLNFGFKRGRFAVERQIYQKFENMLIEK
LNYLVFKDRKVTEPGGVLNAYQLANKSAKV
TDVYKQCGWLFYIPAAYTSKIDPRTGFANL
FITKGLTNVEKKKEFFGKFDSIRYDATESC
FVFSFDYAKICDNADYKKKWDVYTRGTRLV
YNKTERKNVSVNPTEELQCVFDEFGIKWNT
GEDLIESISLIPAEKSNAKFFDVLLRMFNA
TLQMRNSVPNTDTDYLVSPVKAEDGSFFDS
REEFKKGGDARLPIDCDANGAYHIALKGLY
LLLNDFNRDNKGVIQNISNKDWFKFVQEK
VYKD (SEQ ID NO: 587) |
| 405-4
(C554
R) | MARIIDEFCGQMNGYSRSITLRNRLVPIGK
TEENLKQFLEKDLERATAYPDIKNLIDAIH
RNVIEDTLSKVALNWNEIFNILATYQNEKD
KKKKAAIKKDLEKLQSGARKKIVEAFKKNP
DFEKLFKEGLFKELLPELIKSAPVDEIAVK
TKALECFNRFSTYFTGFHDNRKNMYSEEAK
STAISYRIVNENFPKFFANIKLFNYLKEHF
PRIIIDTEESLKDYLKGKKLDSVFSIDGFN
SVLAQSGIDFYNTVIGGISGEAGTKKTQGL
NEKINLARQQLSKEEKNKLRGKMVVLFKQI
LSDRETSSFIPVGFANKEEVYSTVKEFNNS
IAEKAVSKVRDLFLHREEFTLNEIFVPAKS
LTDFSQAIFGSWSILSEGLFLLEKDSMKKA
LSESQEEKINKEIAKKDCSFTELQLAYERY
CTEHNLPVEKFCKDYFDIVDYRGNGAKSEK
TKVSILSEILETFLQLDFDHIQDLQQEKNA
AIPIKAYLDEVQNLYHHLKLVDYRGEEQKD
STFYSKHDEILTDLSQIVPLYNKVRNFVTK
KLGESKKIKLNFDRPTLANGWDENQESSND
AIILRKDGKYYLGIYNPNNKPKFAKKDSIV
GDCYEKMAYKQIALPMGLGAFVRKCFGTAQ
KYGWGCPENCLNSEGKIIIKDEEAKGNLEA
IIDCYKDFLNKYEKDGFKYDYNFSFLDSA
SYEKLSDFFNDVKPQGYKLSFTSIPLSEID
KMIDEGKLFLFQIYNKDFAKKATGKKNLHT
LYWENLFSVENLQDVVLKLNGEAELFWREA
SIKKDKVIVHKKGSILVNRTTTDGKSIPEA
IYQEIYQLKNKMADSISDEAKRLLESGTVV
CKVATHDIVKDKHFTENTYLFHCPITMNFK
AKDRTNKEFNNHVLEVLNKNPDIKVIGLDR
GERHLLYLSLINQKGEIECQKTLNLVEQVR
NDKTVSVNYHEKLVHKEGSRDAARKNWQTI
GNIKELKEGYLSAVVHEIASLMVKHNAIVV
MEDLNFGFKRGRFAVERQIYQKFENMLIEK
LNYLVFKDRKVTEPGGVLNAYQLANKSAKV
TDVYKQCGWLFYIPAAYTSKIDPRTGFANL
FITKGLTNVEKKKEFFGKFDSIRYDATESC
FVFSFDYAKICDNADYKKKWDVYTRGTRLV
YNKTERKNVSVNPTEELQCVFDEFGIKWNT
GEDLIESISLIPAEKSNAKFFDVLLRMFNA
TLQMRNSVPNTDTDYLVSPVKAEDGSFFDS |

| ID | Protein sequence |
|---|---|
|  | REEFKKGGDARLPIDCDANGAYHIALKGLY LLLNDFNRDNKGVIQNISNKDWFKFVQEKV YKD (SEQ ID NO: 588) |
| 405-5 (C554 N) | MARIIDEFCGQMNGYSRSITLRNRLVPIGK TEENLKQFLEKDLERATAYPDIKNLIDAIH RNVIEDTLSKVALNWNEIFNILATYQNEKD KKKKAAIKKDLEKLQSGARKKIVEAFKKNP DFEKLFKEGLFKELLPELIKSAPVDEIAVK TKALECFNRFSTYFTGFHDNRKNMYSEEAK STAISYRIVNENFPKFFANIKLFNYLKEHF PRIIIDTEESLKDYLKGKKLDSVFSIDGFN SVLAQSGIDFYNTVIGGISGEAGTKKTQGL NEKINLARQQLSKEEKNKLRGKMVVLFKQI LSDRETSSFIPVGFANKEEVYSTVKEFNNS IAEKAVSKVRDLFLHREEFTLNEIFVPAKS LTDFSQAIFGSWSILSEGLFLLEKDSMKKA LSESQEEKINKEIAKKDCSFTELQLAYERY CTEHNLPVEKFCKDYFDIVDYRGNGAKSEK TKVSILSEILETFLQLDFDHIQDLQQEKNA AIPIKAYLDEVQNLYHHLKLVDYRGEEQKD STFYSKHDEILTDLSQIVPLYNKVRNFVTK KLGESKKIKLNFDNPTLANGWDENQESSND AIILRKDGKYYLGIYNPNNKPKFAKKDSIV GDCYEKMAYKQIALPMGLGAFVRKCFGTAQ KYGWGCPENCLNSEGKIIIKDEEAKGNLEA IIDCYKDFLNKYEKDGFKYKDYNFSFLDSA SYEKLSDFFNDVKPQGYKLSFTSIPLSEID KMIDEGKLFLFQIYNKDFAKKATGKKNLHT LYWENLFSVENLQDVVKLNGEAELFWREA SIKKDKVIVHKKGSILVNRTTTDGKSIPEA IYQEIYQLKNKMADSISDEAKRLLESGTVV CKVATHDIVKDKHFTENTYLFHCPITMNFK AKDRTNKEFNNHVLEVLNKNPDIKVIGLDR GERHLLYLSLINQKGEIECQKTLNLVEQVR NDKTVSVNYHEKLVHKEGSRDAARKNWQTI GNIKELKEGYLSAVVHEIASLMVKHNAIVV MEDLNFGFKRGRFAVERQIYQKFENMLIEK LNYLVFKDRKVTEPGGVLNAYQLANKSAKV TDVYKQCGWLFYIPAAYTSKIDPRTGFANL FITKGLTNVEKKKEFFGKFDSIRYDATESC FVFSFDYAKICDNADYKKKWDVYTRGTRLV YNKTERKNVSVNPTEELQCVFDEFGIKWNT GEDLIESISLIPAEKSNAKFFDVLLRMFNA TLQMRNSVPNTDTDYLVSPVKAEDGSFFDS REEFKKGGDARLPIDCDANGAYHIALKGLY LLLNDFNRDNKGVIQNISNKDWFKFVQEKV YKD (SEQ ID NO: 589) |
| 405-6 (L860 Q) | MARIIDEFCGQMNGYSRSITLRNRLVPIGK TEENLKQFLEKDLERATAYPDIKNLIDAIH RNVIEDTLSKVALNWNEIFNILATYQNEKD KKKKAAIKKDLEKLQSGARKKIVEAFKKNP DFEKLFKEGLFKELLPELIKSAPVDEIAVK TKALECFNRFSTYFTGFHDNRKNMYSEEAK STAISYRIVNENFPKFFANIKLFNYLKEHF PRIIIDTEESLKDYLKGKKLDSVFSIDGFN SVLAQSGIDFYNTVIGGISGEAGTKKTQGL NEKINLARQQLSKEEKNKLRGKMVVLFKQI LSDRETSSFIPVGFANKEEVYSTVKEFNNS IAEKAVSKVRDLFLHREEFTLNEIFVPAKS LTDFSQAIFGSWSILSEGLFLLEKDSMKKA LSESQEEKINKEIAKKDCSFTELQLAYERY CTEHNLPVEKFCKDYFDIVDYRGNGAKSEK TKVSILSEILETFLQLDFDHIQDLQQEKNA AIPIKAYLDEVQNLYHHLKLVDYRGEEQKD STFYSKHDEILTDLSQIVPLYNKVRNFVTK KLGESKKIKLNFDCPTLANGWDENQESSND AIILRKDGKYYLGIYNPNNKPKFAKKDSIV GDCYEKMAYKQIALPMGLGAFVRKCFGTAQ KYGWGCPENCLNSEGKIIIKDEEAKGNLEA IIDCYKDFLNKYEKDGFKYKDYNFSFLDSA SYEKLSDFFNDVKPQGYKLSFTSIPLSEID KMIDEGKLFLFQIYNKDFAKKATGKKNLHT LYWENLFSVENLQDVVKLNGEAELFWREA SIKKDKVIVHKKGSILVNRTTTDGKSIPEA IYQEIYQLKNKMADSISDEAKRLLESGTVV CKVATHDIVKDKHFTENTYQFHCPITMNFK AKDRTNKEFNNHVLEVLNKNPDIKVIGLDR GERHLLYLSLINQKGEIECQKTLNLVEQVR NDKTVSVNYHEKLVHKEGSRDAARKNWQTI GNIKELKEGYLSAVVHEIASLMVKHNAIVV MEDLNFGFKRGRFAVERQIYQKFENMLIEK LNYLVFKDRKVTEPGGVLNAYQLANKSAKV TDVYKQCGWLFYIPAAYTSKIDPRTGFANL FITKGLTNVEKKKEFFGKFDSIRYDATESC FVFSFDYAKICDNADYKKKWDVYTRGTRLV YNKTERKNVSVNPTEELQCVFDEFGIKWNT GEDLIESISLIPAEKSNAKFFDVLLRMFNA TLQMRNSVPNTDTDYLVSPVKAEDGSFFDS REEFKKGGDARLPIDCDANGAYHIALKGLY LLLNDFNRDNKGVIQNISNKDWFKFVQEK VYKD (SEQ ID NO: 590) |
| 414-1 (T154 R) | MKEQFINCYPLSKTLRFSLIPVGKTEDNFN KKLLLESDKQRAENYENVKSYIDRFHKEYI KSALANARIEKINEYAALYWKNNKDDSDAK AMESLEDDIRKQISKQLTSTANFKRLFGKE LICEDLPAFLTDENEKETVECFRSFTTYFN GFNRNRKNMYSSEKKSTAIAYRCVNDNLPR FLDNIKTFQKIFDNLSDETITKLNTDLYNI FGRKIEDIFSVDYFDFVLTQSGIDIYNYMI GGYTCSDGTKIQGLNECINLYNQQVAKNEK SKRLPLMKPLRKQILSEKDSVSFIPEKFNS DNEVLLAIEEYYNNHISDIDSLTELLQSLN TYNANGIFIKSGAAVSDISNAAFNSWNVLR LAWNEKYEALHPVTSTTKIDKYIEKRDKVY KSIKSFSLFELQELGAENGNEITDWYISSI NECNRKIKETYLQARELLESDYEKDYDKRL YKNEKATELVKNLLDAIKEFQQLVKLINGT GKEENKDELFYGKFTSLYDSVADIDRLYDK VRNYITQRPYSKDKIKLNFDNPQLLGGWDK NKESDYRTVLIRKNDFYYLAVMDKSHSKVF VNAPEITSEDEDYYEKMEYKLLPGPNKMLP KVFFASRNIDKFQPSDRILDIRKRESFKKG ATFNKSECHEFIDYFKESIKKHDDWSKFGF EFSPTESYNDISEFYREVSDQGYYISFSKI SKNYIDKLVENGYLYLFKIYNKDFSKYSKG TPNLHTLYFKMLFDERNLSNVVYKLNGEAE MFYREASINDKEKITHHANQPIKNKNPDNE KKESVFEYDIVKDKRFTKRQFSLHVSVTIN FKAHGQEFLNYDVRKAVKYKDDNYVIGIDR GERNLIYISVINSNGEIVEQMSLNEIIGDN GYSVDYQKLLDKKEKERDKARKNWTSVENI KELKEGYISQVVHKICELVVKYDAVIAMED LNFGFKRGRFPVEKQVYQKFENMLISKLNL LIDKKAEPTETGGLLRAYQLTNKFDGVNKA KQNGIIFYVPAWDTSKIDPVTGFVNLLKPK YTSVREAKKLFETIDDIKYNTNTDMFEFCI DYGKFPRCNSDFKKTWTVCTNSSRILSFRN EKKNNEWDNKQIVLTDEFKSLFNEFGIDYT SDLKASILSISNADFYNRLIRLLSLTLQMR NSIIGSTLPEDDYLISPVANDRGEFYDSRN YKGSNAALPCDADANGAYNIARKALWAINV LKDTPDDMLQKAKLSITNAEWLEYTQR (SEQ ID NO: 591) |
| 414-2 (T154 R/R88 7K/R8 91A) | MKEQFINCYPLSKTLRFSLIPVGKTEDNFN KKLLLESDKQRAENYENVKSYIDRFHKEYI KSALANARIEKINEYAALYWKNNKDDSDAK AMESLEDDIRKQISKQLTSTANFKRLFGKE LICEDLPAFLTDENEKETVECFRSFTTYFN GFNRNRKNMYSSEKKSTAIAYRCVNDNLPR FLDNIKTFQKIFDNLSDETITKLNTDLYNI FGRKIEDIFSVDYFDFVLTQSGIDIYNYMI GGYTCSDGTKIQGLNECINLYNQQVAKNEK SKRLPLMKPLRKQILSEKDSVSFIPEKFNS DNEVLLAIEEYYNNHISDIDSLTELLQSLN TYNANGIFIKSGAAVSDISNAAFNSWNVLR LAWNEKYEALHPVTSTTKIDKYIEKRDKVY KSIKSFSLFELQELGAENGNEITDWYISSI NECNRKIKETYLQARELLESDYEKDYDKRL YKNEKATELVKNLLDAIKEFQQLVKLLNGT GKEENKDELFYGKFTSLYDSVADIDRLYDK |

| ID | Protein sequence |
|---|---|
| | VRNYITQRPYSKDKIKLNFDNPQLLGGWDK
NKESDYRTVILRKNDFYYLAVMDKSHSKVF
VNAPEITSEDEDYYEKMEYKLLPGPNKMLP
KVFFASRNIDKFQPSDRILDIRKRESFKKG
ATFNKSECHEFIDYFKESIKKHDDWSKFGF
EFSPTESYNDISEFYREVSDQGYYISFSKI
SKNYIDKLVENGYLYLFKIYNKDFSKYSKG
TPNLHTLYFKMLFDERNLSNVVYKLNGEAE
MFYREASINDKEKITHHANQPIKNKNPDNE
KKESVFEYDIVKDKRFTKRQFSLHVSVTIN
FKAHGQEFLNYDVRKAVKYKDDNYVIGIDR
GERNLIYISVINSNGEIVEQMSLNEIIGDN
GYSVDYQKLLDKKEKEKDKAAKNWTSVENI
KELKEGYISQVVHKICELVVKYDAVIAMED
LNFGFKRGRFPVEKQVYQKFENMLISKLNL
LIDKKAEPTETGGLLRAYQLTNKFDGVNKA
KQNGIIFYVPAWDTSKIDPVTGFVNLLKPK
YTSVREAKKLFETIDDIKYNTNTDMFEFCI
DYGKFPRCNSDFKKTWTVCTNSSRILSFRN
EKKNNEWDNKQIVLTDEFKSLFNEFGIDYT
SDLKASILSISNADFYNRLIRLLSLTLQMR
NSIIGSTLPEDDYLISPVANDRGEFYDSRN
YKGSNAALPCDADANGAYNIARKALWAINV
LKDTPDDMLQKAKLSITNAEWLEYTQR
(SEQ ID NO: 592) |
| 414-3
(T154
R/G53
6R/K5
42R) | MKEQFINCYPLSKTLRFSLIPVGKTEDNFN
KKLLLESDKQRAENYENVKSYIDRFHKEYI
KSALANARIEKINEYAALYWKNNKDDSDAK
AMESLEDDIRKQISKQLTSTANFKRLFGKE
LICEDLPAFLTDENEKETVECFRSFTTYFN
GFNTNRKNMYSSEKKSTAIAYRCVNDNLPR
FLDNIKTFQKIFDNLSDETITKLNTDLYNI
FGRKIEDIFSVDYFDFVLTQSGIDIYNYMI
GGYTCSDGTKIQGLNECINLYNQQVAKNEK
SKRLPLMKPLRKQILSEKDSVSFIPEKFNS
DNEVLLAIEEYYNNHISDIDSLTELLQSLN
TYNANGIFIKSGAAVSDISNAAFNSWNVLR
LAWNEKYEALHPVTSTTKIDKYIEKRDKVY
KSIKSFSLFELQELGAENGNEITDWYISSI
NECNRKIKETYLQARELLESDYEKDYDKRL
YKNEKATELVKNLLDAIKEFQQLVKLLNGT
GKEENKDELFYGKFTSLYDSVADIDRLYDK
VRNYITQRPYSKDKIKLNFDNPQLLRGWDK
NRESDYRTVILRKNDFYYLAVMDKSHSKVF
VNAPEITSEDEDYYEKMEYKLLPGPNKMLP
KVFFASRNIDKFQPSDRILDIRKRESFKKG
ATFNKSECHEFIDYFKESIKKHDDWSKFGF
EFSPTESYNDISEFYREVSDQGYYISFSKI
SKNYIDKLVENGYLYLFKIYNKDFSKYSKG
TPNLHTLYFKMLFDERNLSNVVYKLNGEAE
MFYREASINDKEKITHHANQPIKNKNPDNE
KKESVFEYDIVKDKRFTKRQFSLHVSVTIN
FKAHGQEFLNYDVRKAVKYKDDNYVIGIDR
GERNLIYISVINSNGEIVEQMSLNEIIGDN
GYSVDYQKLLDKKEKERDKARKNWTSVENI
KELKEGYISQVVHKICELVVKYDAVIAMED
LNFGFKRGRFPVEKQVYQKFENMLISKLNL
LIDKKAEPTETGGLLRAYQLTNKFDGVNKA
KQNGIIFYVPAWDTSKIDPVTGFVNLLKPK
YTSVREAKKLFETIDDIKYNTNTDMFEFCI
DYGKFPRCNSDFKKTWTVCTNSSRILSFRN
EKKNNEWDNKQIVLTDEFKSLFNEFGIDYT
SDLKASILSISNADFYNRLIRLLSLTLQMR
NSIIGSTLPEDDYLISPVANDRGEFYDSRN
YKGSNAALPCDADANGAYNIARKALWAINV
LKDTPDDMLQKAKLSITNAEWLEYTQR
(SEQ ID NO: 593) |
| 414-4
(TN53
1R/S8
02L) | MKEQFINCYPLSKTLRFSLIPVGKTEDNFN
KKLLLESDKQRAENYENVKSYIDRFHKEYI
KSALANARIEKINEYAALYWKNNKDDSDAK
AMESLEDDIRKQISKQLTSTANFKRLFGKE
LICEDLPAFLTDENEKETVECFRSFTTYFN
GFNTNRKNMYSSEKKSTAIAYRCVNDNLPR
FLDNIKTFQKIFDNLSDETITKLNTDLYNI
FGRKIEDIFSVDYFDFVLTQSGIDIYNYMI
GGYTCSDGTKIQGLNECINLYNQQVAKNEK
SKRLPLMKPLRKQILSEKDSVSFIPEKFNS
DNEVLLAIEEYYNNHISDIDSLTELLQSLN
TYNANGIFIKSGAAVSDISNAAFNSWNVLR
LAWNEKYEALHPVTSTTKIDKYIEKRDKVY
KSIKSFSLFELQELGAENGNEITDWYISSI
NECNRKIKETYLQARELLESDYEKDYDKRL
YKNEKATELVKNLLDAIKEFQQLVKLINGT
GKEENKDELFYGKFTSLYDSVADIDRLYDK
VRNYITQRPYSKDKIKLNFDRPQLLGGWDK
NKESDYRTVILRKNDFYYLAVMDKSHSKVF
VNAPEITSEDEDYYEKMEYKLLPGPNKMLP
KVFFASRNIDKFQPSDRILDIRKRESFKKG
ATFNKSECHEFIDYFKESIKKHDDWSKFGF
EFSPTESYNDISEFYREVSDQGYYISFSKI
SKNYIDKLVENGYLYLFKIYNKDFSKYSKG
TPNLHTLYFKMLFDERNLSNVVYKLNGEAE
MFYREASINDKEKITHHANQPIKNKNPDNE
KKESVFEYDIVKDKRFTKRQFLLHVSVTIN
FKAHGQEFLNYDVRKAVKYKDDNYVIGIDR
GERNLIYISVINSNGEIVEQMSLNEIIGDN
GYSVDYQKLLDKKEKERDKARKNWTSVENI
KELKEGYISQVVHKICELVVKYDAVIAMED
LNFGFKRGRFPVEKQVYQKFENMLISKLNL
LIDKKAEPTETGGLLRAYQLTNKFDGVNKA
KQNGIIFYVPAWDTSKIDPVTGFVNLLKPK
YTSVREAKKLFETIDDIKYNTNTDMFEFCI
DYGKFPRCNSDFKKTWTVCTNSSRILSFRN
EKKNNEWDNKQIVLTDEFKSLFNEFGIDYT
SDLKASILSISNADFYNRLIRLLSLTLQMR
NSIIGSTLPEDDYLISPVANDRGEFYDSRN
YKGSNAALPCDADANGAYNIARKALWAINV
LKDTPDDMLQKAKLSITNAEWLEYTQR
(SEQ ID NO: 594) |
| 414-5
(N531
R) | MKEQFINCYPLSKTLRFSLIPVGKTEDNFN
KKLLLESDKQRAENYENVKSYIDRFHKEYI
KSALANARIEKINEYAALYWKNNKDDSDAK
AMESLEDDIRKQISKQLTSTANFKRLFGKE
LICEDLPAFLTDENEKETVECFRSFTTYFN
GFNTNRKNMYSSEKKSTAIAYRCVNDNLPR
FLDNIKTFQKIFDNLSDETITKLNTDLYNI
FGRKIEDIFSVDYFDFVLTQSGIDIYNYMI
GGYTCSDGTKIQGLNECINLYNQQVAKNEK
SKRLPLMKPLRKQILSEKDSVSFIPEKFNS
DNEVLLAIEEYYNNHISDIDSLTELLQSLN
TYNANGIFIKSGAAVSDISNAAFNSWNVLR
LAWNEKYEALHPVTSTTKIDKYIEKRDKVY
KSIKSFSLFELQELGAENGNEITDWYISSI
NECNRKIKETYLQARELLESDYEKDYDKRL
YKNEKATELVKNLLDAIKEFQQLVKLLNGT
GKEENKDELFYGKFTSLYDSVADIDRLYDK
VRNYITQRPYSKDKIKLNFDRPQLLGGWDK
NKESDYRTVILRKNDFYYLAVMDKSHSKVF
VNAPEITSEDEDYYEKMEYKLLPGPNKMLP
KVFFASRNIDKFQPSDRILDIRKRESFKKG
ATFNKSECHEFIDYFKESIKKHDDWSKFGF
EFSPTESYNDISEFYREVSDQGYYISFSKI
SKNYIDKLVENGYLYLFKIYNKDFSKYSKG
TPNLHTLYFKMLFDERNLSNVVYKLNGEAE
MFYREASINDKEKITHHANQPIKNKNPDNE
KKESVFEYDIVKDKRFTKRQFSLHVSVTIN
FKAHGQEFLNYDVRKAVKYKDDNYVIGIDR
GERNLIYISVINSNGEIVEQMSLNEIIGDN
GYSVDYQKLLDKKEKERDKARKNWTSVENI
KELKEGYISQVVHKICELVVKYDAVIAMED
LNFGFKRGRFPVEKQVYQKFENMLISKLNL
LIDKKAEPTETGGLLRAYQLTNKFDGVNKA
KQNGIIFYVPAWDTSKIDPVTGFVNLLKPK
YTSVREAKKLFETIDDIKYNTNTDMFEFCI
DYGKFPRCNSDFKKTWTVCTNSSRILSFRN
EKKNNEWDNKQIVLTDEFKSLFNEFGIDYT
SDLKASILSISNADFYNRLIRLLSLTLQMR
NSIIGSTLPEDDYLISPVANDRGEFYDSRN
YKGSNAALPCDADANGAYNIARKALWAINV
LKDTPDDMLQKAKLSITNAEWLEYTQR
(SEQ ID NO: 595) |

| ID | Protein sequence |
|---|---|
| 414-6 (S802L) | MKEQFINCYPLSKTLRFSLIPVGKTEDNFN KKLLLESDKQRAENYENVKSYIDRFHKEYI KSALANARIEKINEYAALYWKNNKDDSDAK AMESLEDDIRKQISKQLTSTANFKRLFGKE LICEDLPAFLTDENEKETVECFRSFTTYFN GPNTNRKNMYSSEKKSTAIAYRCVNDNLPR FLDNIKTFQKIFDNLSDETITKLNTDLYNI FGRKIEDIFSVDYFDFVLTQSGIDIYNYMI GGYTCSDGTKIQGLNECINLYNQQVAKNEK SKRLPLMKPLRKQILSEKDSVSFIPEKFNS DNEVLLAIEEYYNNHISDIDSLTELLQSLN TYNANGIFIKSGAAVSDISNAAFNSWNVLR LAWNEKYEALHPVTSTTKIDKYIEKRDKVY KSIKSFSLFELQELGAENGNEITDWYISSI NECNRKIKETYLQARELLESDYEKDYDKRL YKNEKATELVKNLLDAIKEFQQLVKLINGT GKEENKDELFYGKFTSLYDSVADIDRLYDK VRNYITQRPYSKDKIKLNFDNPQLLGGWDK NKESDYRTVILRKNDFYYLAVMDKSHSKVF VNAPEITSEDEDYYEKMEYKLLPGPNKMLP KVFFASRNIDKFQPSDRILDIRKRESFKKG ATFNKSECHEFIDYFKESIKKHDDWSKFGF EFSPTESYNDISEFYREVSDQGYYISFSKI SKNYIDKLVENGYLYLFKIYNKDFSKYSKG TPNLHTLYFKMLFDERNLSNVVYKLNGEAE MFYREASINDKEKITHHANQPIKNKNPDNE KKESVFEYDIVKDKRFTKRQFLLHVSVTIN FKAHGQEFLNYDVRKAVKYKDDNYVIGIDR GERNLIYISVINSNGEIVEQMSLNEIIGDN GYSVDYQKLLDKKEKERDKARKNWTSVENI KELKEGYISQVVHKICELVVKYDAVIAMED LNFGPKRGRFPVEKQVYQKFENMLISKLNL LIDKKAEPTETGGLLRAYQLTNKFDGVNKA KQNGIIFYVPAWDTSKIDPVTGFVNLLKPK YTSVREAKKLFETIDDIKYNTNTDMFEFCI DYGKFPRCNSDFKKTWTVCTNSSRILSFRN EKKNNEWDNKQIVLTDEFKSLFNEFGIDYT SDLKASILSISNADFYNRLIRLLSLTLQMR NSIIGSTLPEDDYLISPVANDRGEFYDSRN YKGSNAALPCDADANGAYNIARKALWAINV LKDTPDDMLQKAKLSITNAEWLEYTQR (SEQ ID NO: 596) |
| 418-1 (D161R) | MKAELFKTFVDEYPVSKTLRFSLIPVGRTL ENIEKDGILDCDEKRSEEYKRVKKLLDEYY KTFIEHALTNVELDINSLEEYERLYNIKNK SDKEKADFDSVQKNLRKQIVKALKEDEKYK FLFKKEIIEKELVDFLNGRDSDVELVKSFK GYATMFQGFWRARKNIFSDEEKSTAIAYRI INENLPKFISNKNIYFTKIQPEMDAELDQL TLSNNSNEIRDIFKLEYFSKTITQTGIEIY NGILGGYTIDEQVKLQGINEIVNLHNQKNK DSGKIPKLKMLYKQILSDTNTLSFIAEGFE TDDEVLESLNIFYDVFNENILDEDLGIINL LRNIDKFSYDGIYIKNDKALIDISNYLFGD WHYIKNAINKKYEIDNPGKNTEKYIVKRNK FIKSFDSFSLKYLQDCTGSKFNEHILIKIN NLIDDVKKAYNSVALLIKNKYEGTNLINDK DAIEKIKQFLDSMKSLVSFIRCFEGTGQEP DRDEIFYGEFDTGKKTFYYLNNIYNKTRNY VTKKPYSIEKYKLNFDNAELLTGWDLNKET SKASIILKKDNLYYLGIMKKSDRRVFLNVP ETESTYNCYEKMEYKLLPGPNKMLPKVFFA KSNIDYYDPSPEIMRIYKEGTFKKGDNFNI DDCHDLIDYFKESLDKNDDWKIFDFDFSET SSYKDIGEFYKEVQQQGYKISFKNIASSYV DELVENGKLYLFQIYNKDFSKNSKGTENLH TMYWRALFDEENLENVIYKLNGDAEIFFRR KSISENEKIVHPAHVEIENKNDETRKEKKT SIFNYDIIKDKRFTVDKFQPHVPITLNFQA IDRKSDINLRMRQEIKKNKDMHIIGIDRGE RNLLYISIIDLDGNIVKQESLNTITNEYDG KIYTTDYHKLLDKKEEKRKVARQTWNTIEN IKELKAGYMSQVVHKITQLMMEYNAIVVLE DLNTGFKRGRQKVEKQIYQAFEKALINKLN YYVDKKVDKNEISGLYKPLQLTKEFESFKK |
| 418-2 (D161R/R888K/R892A) | LGKQSGAIFYVPAWNTSKMDPTTGFVNLLS VKYENMEKSKEFINKIKDINFKEDDCGKYY EFHIDFNEFTDKGKDTKTDWNICSFGKRID NARNQKGDFESKMIDLTNEFHNLFKKYGIN DNSNLKEDILNVKEAKFYKEFINLFKLMLQ IRNSESNEKVDFLQSPVKNNKGEFFNSNNV NGNEAPENADANGAYNIARKGLWIVNQIKT MPDSQMHKIKLAMKNQEWLLFAQKGNV (SEQ ID NO: 597) |
| 418-2 (D161R/R888K/R892A) | MKAELFKTFVDEYPVSKTLRFSLIPVGRTL ENIEKDGILDCDEKRSEEYKRVKKLLDEYY KTFIEHALTNVELDINSLEEYERLYNIKNK SDKEKADFDSVQKNLRKQIVKALKEDEKYK FLFKKEIIEKELVDFLNGRDSDVELVKSFK GYATMFQGFWRARKNIFSDEEKSTAIAYRI INENLPKFISNKNIYFTKIQPEMDAELDQL TLSNNSNEIRDIFKLEYFSKTITQTGIEIY NGILGGYTIDEQVKLQGINEIVNLHNQKNK DSGKIPKLKMLYKQILSDTNTLSFIAEGFE TDDEVLESLNIFYDVFNENILDEDLGIINL LRNIDKFSYDGIYIKNDKALIDISNYLFGD WHYIKNAINKKYEIDNPGKNTEKYIVKRNK FIKSFDSFSLKYLQDCTGSKFNEHILIKIN NLIDDVKKAYNSVALLIKNKYEGTNLINDK DAIEKIKQFLDSMKSLVSFIRCFEGTGQEP DRDEIFYGEFDTGKKTFYYLNNIYNKTRNY VTKKPYSIEKYKLNFDNAELLTGWDLNKET SKASIILKKDNLYYLGIMKKSDRRVFLNVP ETESTYNCYEKMEYKLLPGPNKMLPKVFFA KSNIDYYDPSPEIMRIYKEGTFKKGDNFNI DDCHDLIDYFKESLDKNDDWKIFDFDFSET SSYKDIGEFYKEVQQQGYKISFKNIASSYV DELVENGKLYLFQIYNKDFSKNSKGTENLH TMYWRALFDEENLENVIYKLNGDAEIFFRR KSISENEKIVHPAHVEIENKNDETRKEKKT SIFNYDIIKDKRFTVDKFQPHVPITLNFQA IDRKSDINLRMRQEIKKNKDMHIIGIDRGE RNLLYISIIDLDGNIVKQESLNTITNEYDG KIYTTDYHKLLDKKEEKKKVAAQTWNTIEN IKELKAGYMSQVVHKITQLMMEYNAIVVLE DLNTGFKRGRQKVEKQIYQAFEKALINKLN YYVDKKVDKNEISGLYKPLQLTKEFESFKK LGKQSGAIFYVPAWNTSKMDPTTGFVNLLS VKYENMEKSKEFINKIKDINFKEDDCGKYY EFHIDFNEFTDKGKDTKTDWNICSFGKRID NARNQKGDFESKMIDLTNEFHNLFKKYGIN DNSNLKEDILNVKEAKFYKEFINLFKLMLQ IRNSESNEKVDFLQSPVKNNKGEFFNSNNV NGNEAPENADANGAYNIARKGLWIVNQIKT MPDSQMHKIKLAMKNQEWLLFAQKGNV (SEQ ID NO: 598) |
| 418-3 (D161R/T532R/K538R) | MKAELFKTFVDEYPVSKTLRFSLIPVGRTL ENIEKDGILDCDEKRSEEYKRVKKLLDEYY KTFIEHALTNVELDINSLEEYERLYNIKNK SDKEKADFDSVQKNLRKQIVKALKEDEKYK FLFKKEIIEKELVDFLNGRDSDVELVKSFK GYATMFQGFWRARKNIFSDEEKSTAIAYRI INENLPKFISNKNIYFTKIQPEMDAELDQL TLSNNSNEIRDIFKLEYFSKTITQTGIEIY NGILGGYTIDEQVKLQGINEIVNLHNQKNK DSGKIPKLKMLYKQILSDTNTLSFIAEGFE TDDEVLESLNIFYDVFNENILDEDLGIINL LRNIDKFSYDGIYIKNDKALIDISNYLFGD WHYIKNAINKKYEIDNPGKNTEKYIVKRNK FIKSFDSFSLKYLQDCTGSKFNEHILIKIN NLIDDVKKAYNSVALLIKNKYEGTNLINDK DAIEKIKQFLDSMKSLVSFIRCFEGTGQEP DRDEIFYGEFDTGKKTFYYLNNIYNKTRNY VTKKPYSIEKYKLNFDNAELLRGWDLNKET SKASIILKKDNLYYLGIMKKSDRRVFLNVP ETESTYNCYEKMEYKLLPGPNKMLPKVFFA KSNIDYYDPSPEIMRIYKEGTFKKGDNFNI DDCHDLIDYFKESLDKNDDWKIFDFDFSET SSYKDIGEFYKEVQQQGYKISFKNIASSYV DELVENGKLYLFQIYNKDFSKNSKGTENLH |

| ID | Protein sequence |
|---|---|
| | TMYWRALFDEENLENVIYKLNGDAEIFFRR KSISENEKIVHPAHVEIENKNDETRKEKKT SIFNYDIIKDKRFTVDKFQFHVPITLNFQA IDRKSDINLRMRQEIKKNKDMHIIGIDRGE RNLLYISIIDLDGNIVQESLNTITNEYDG KIYTTDYHKLLDKKEEKRKVARQTWNTIEN IKELKAGYMSQVVHKITQLMMEYNAIVVLE DLNTGFKRGRQKVEKQIYQAFEKALINKLN YYVDKKVDKNEISGLYKPLQLTKEFESFKK LGKQSGAIFYVPAWNTSKMDPTTGFVNLLS VKYENMEKSKEFINKIKDINFKEDDCGKYY EFHIDFNEFTDKGKDTKTDWNICSFGKRID NARNQKGDFESKMIDLTNEFHNLFKKYGIN DNSNLKEDILNVKEAKFYKEFINLFKLMLQ IRNSESNEKVDFLQSPVKNNKGEFFNSNNV NGNEAPENADANGAYNIARKGLWIVNQIKT MPDSQMHKIKLAMKNQEWLLFAQKGNV (SEQ ID NO: 599) |
| 418-4 (N527 R/Q79 9L) | MKAELFKTFVDEYPVSKTLRFSLIPVGRTL ENIEKDGILDCDEKRSEEYKRVKKLLDEYY KTFIEHALTNVELDINSLEEYERLYNIKNK SDKEKADFDSVQKNLRKQIVKALKEDEKYK FLFKKEIIEKELVDFLNGRDSDVELVKSFK GYATMFQGFWDARKNIFSDEEKSTAIAYRI INENLPKFISNKNIYFTKIQPEMDAELDQL TLSNNSNEIRDIFKLEYFSKTITQTGIEIY NGILGGYTIDEQVKLQGINEIVNLHNQKNK DSGKIPKLKMLYKQILSDTNTLSFIAEGFE TDDEVLESLNIFYDVFNENILDEDLGIINL LRNIDKFSYDGIYIKNDKALIDISNYLFGD WHYIKNAINKKYEIDNPGKNTEKYIVKRNK FIKSFDSFSLKYLQDCTGSKFNEHILIKIN NLIDDVKKAYNSVALLIKNKYEGTNLINDK DAIEKIKQFLDSMKSLVSFIRCFEGTGQEP DRDEIFYGEFDTGKKTFYYLNNIYNKTRNY VTKKPYSIEKYKLNFDRAELLTGWDLNKET SKASIILKKDNLYYLGIMKKSDRRVFLNVP ETESTYNCYEKMEYKLLPGPNKMLPKVFFA KSNIDYYDPSPEIMRIYKEGTFKKGDNFNI DDCHDLIDYFKESLDKNDDWKIFDFDFSET SSYKDIGEFYKEVQQQGYKISFKNIASSYV DELVENGKLYLFQIYNKDFSKNSKGTENLH TMYWRALFDEENLENVIYKLNGDAEIFFRR KSISENEKIVHPAHVEIENKNDETRKEKKT SIFNYDIIKDKRFTVDKFLFHVPITLNFQA IDRKSDINLRMRQEIKKNKDMHIIGIDRGE RNLLYISIIDLDGNIVQESLNTITNEYDG KIYTTDYHKLLDKKEEKRKVARQTWNTIEN IKELKAGYMSQVVHKITQLMMEYNAIVVLE DLNTGFKRGRQKVEKQIYQAFEKALINKLN YYVDKKVDKNEISGLYKPLQLTKEFESFKK LGKQSGAIFYVPAWNTSKMDPTTGFVNLLS VKYENMEKSKEFINKIKDINFKEDDCGKYY EFHIDFNEFTDKGKDTKTDWNICSFGKRID NARNQKGDFESKMIDLTNEFHNLFKKYGIN DNSNLKEDILNVKEAKFYKEFINLFKLMLQ IRNSESNEKVDFLQSPVKNNKGEFFNSNNV NGNEAPENADANGAYNIARKGLWIVNQIKT MPDSQMHKIKLAMKNQEWLLFAQKGNV (SEQ ID NO: 600) |
| 418-5 (N527 R) | MKAELFKTFVDEYPVSKTLRFSLIPVGRTL ENIEKDGILDCDEKRSEEYKRVKKLLDEYY KTFIEHALTNVELDINSLEEYERLYNIKNK SDKEKADFDSVQKNLRKQIVKALKEDEKYK FLFKKEIIEKELVDFLNGRDSDVELVKSFK GYATMFQGFWDARKNIFSDEEKSTAIAYRI INENLPKFISNKNIYFTKIQPEMDAELDQL TLSNNSNEIRDIFKLEYFSKTITQTGIEIY NGILGGYTIDEQVKLQGINEIVNLHNQKNK DSGKIPKLKMLYKQILSDTNTLSFIAEGFE TDDEVLESLNIFYDVFNENILDEDLGIINL LRNIDKFSYDGIYIKNDKALIDISNYLFGD WHYIKNAINKKYEIDNPGKNTEKYIVKRNK FIKSFDSFSLKYLQDCTGSKFNEHILIKIN NLIDDVKKAYNSVALLIKNKYEGTNLINDK DAIEKIKQFLDSMKSLVSFIRCFEGTGQEP DRDEIFYGEFDTGKKTFYYLNNIYNKTRNY VTKKPYSIEKYKLNFDRAELLTGWDLNKET SKASIILKKDNLYYLGIMKKSDRRVFLNVP ETESTYNCYEKMEYKLLPGPNKMLPKVFFA KSNIDYYDPSPEIMRIYKEGTFKKGDNFNI DDCHDLIDYFKESLDKNDDWKIFDFDFSET SSYKDIGEFYKEVQQQGYKISFKNIASSYV DELVENGKLYLFQIYNKDFSKNSKGTENLH TMYWRALFDEENLENVIYKLNGDAEIFFRR KSISENEKIVHPAHVEIENKNDETRKEKKT SIFNYDIIKDKRFTVDKFQFHVPITLNFQA IDRKSDINLRMRQEIKKNKDMHIIGIDRGE RNLLYISIIDLDGNIVQESLNTITNEYDG KIYTTDYHKLLDKKEEKRKVARQTWNTIEN IKELKAGYMSQVVHKITQLMMEYNAIVVLE DLNTGFKRGRQKVEKQIYQAFEKALINKLN YYVDKKVDKNEISGLYKPLQLTKEFESFKK LGKQSGAIFYVPAWNTSKMDPTTGFVNLLS VKYENMEKSKEFINKIKDINFKEDDCGKYY EFHIDFNEFTDKGKDTKTDWNICSFGKRID NARNQKGDFESKMIDLTNEFHNLFKKYGIN DNSNLKEDILNVKEAKFYKEFINLFKLMLQ IRNSESNEKVDFLQSPVKNNKGEFFNSNNV NGNEAPENADANGAYNIARKGLWIVNQIKT MPDSQMHKIKLAMKNQEWLLFAQKGNV (SEQ ID NO: 601) |
| 418-6 (Q799 L) | MKAELFKTFVDEYPVSKTLRFSLIPVGRTL ENIEKDGILDCDEKRSEEYKRVKKLLDEYY KTFIEHALTNVELDINSLEEYERLYNIKNK SDKEKADFDSVQKNLRKQIVKALKEDEKYK FLFKKEIIEKELVDFLNGRDSDVELVKSFK GYATMFQGFWDARKNIFSDEEKSTAIAYRI INENLPKFISNKNIYFTKIQPEMDAELDQL TLSNNSNEIRDIFKLEYFSKTITQTGIEIY NGILGGYTIDEQVKLQGINEIVNLHNQKNK DSGKIPKLKMLYKQILSDTNTLSFIAEGFE TDDEVLESLNIFYDVFNENILDEDLGIINL LRNIDKFSYDGIYIKNDKALIDISNYLFGD WHYIKNAINKKYEIDNPGKNTEKYIVKRNK FIKSFDSFSLKYLQDCTGSKFNEHILIKIN NLIDDVKKAYNSVALLIKNKYEGTNLINDK DAIEKIKQFLDSMKSLVSFIRCFEGTGQEP DRDEIFYGEFDTGKKTFYYLNNIYNKTRNY VTKKPYSIEKYKLNFDNAELLTGWDLNKET SKASIILKKDNLYYLGIMKKSDRRVFLNVP ETESTYNCYEKMEYKLLPGPNKMLPKVFFA KSNIDYYDPSPEIMRIYKEGTFKKGDNFNI DDCHDLIDYFKESLDKNDDWKIFDFDFSET SSYKDIGEFYKEVQQQGYKISFKNIASSYV DELVENGKLYLFQIYNKDFSKNSKGTENLH TMYWRALFDEENLENVIYKLNGDAEIFFRR KSISENEKIVHPAHVEIENKNDETRKEKKT SIFNYDIIKDKRFTVDKFLFHVPITLNFQA IDRKSDINLRMRQEIKKNKDMHIIGIDRGE RNLLYISIIDLDGNIVQESLNTITNEYDG KIYTTDYHKLLDKKEEKRKVARQTWNTIEN IKELKAGYMSQVVHKITQLMMEYNAIVVLE DLNTGFKRGRQKVEKQIYQAFEKALINKLN YYVDKKVDKNEISGLYKPLQLTKEFESFKK LGKQSGAIFYVPAWNTSKMDPTTGFVNLLS VKYENMEKSKEFINKIKDINFKEDDCGKYY EFHIDFNEFTDKGKDTKTDWNICSFGKRID NARNQKGDFESKMIDLTNEFHNLFKKYGIN DNSNLKEDILNVKEAKFYKEFINLFKLMLQ |

3. Full mRNA Sequences of ID405, ID414, and ID418 Type V Nucleases (Wildtype) (SEQ ID Nos: 603-607)

| ID | Protein sequence |
|---|---|
| | IRNSESNEKVDFLQSPVKNNKGEFFNSNNV NGNEAPENADANGAYNIARKGLWIVNQIKT MPDSQMHKIKLAMKNQEWLLFAQKGNV (SEQ ID NO: 602) |

| Nuclease | Full mRNA sequence (with 5' and 3' UTRs) | SEQ ID NO: |
|---|---|---|
| LbaCas12a | GGAAAUAAGAGAGAAAAGAAGAGUAAGAAG AAAUAUAAGAGCCACCAUGAGCAAGCUGGA GAAGUUUACAAACUGCUACUCCCUGUCUAA GACCCUGAGGUUCAAGGCCAUCCCUGUGGG CAAGACCCAGGAGAACAUCGACAAUAAGCG GCUGCUGGUGGAGGACGAGAAGAGAGCCGA GGAUUAUAAGGGCGUGAAGAAGCUGCUGGA UCGCUACUAUCUAUCUUUUAUCAACGACGU GCUGCACAGCAUCAAGCUGAAGAAUCUGAA CAAUUACAUCAGCCUGUUCCGGAAGAAAAC CAGAACCGAGAAGGAGAAUAAGGAGCUGGA GAACCUGGAGAUCAAUCUGCGGAAGGAGAU CGCCAAGGCCUUCAAGGGCAACGAGGGCUA CAAGUCCCUGUUUAAGAAGGAUAUCAUCGA GACAAUCCUGCCAGAGUUCCUGGACGAUAA GGACGAGAUCGCCCUGGUGAACAGCUUCAA UGGCUUUACCACAGCCUUCACCGGCUUCUU UGAUAACAGAGAGAAUAUGUUUUCCGAGGA GGCCAAGAGCACAUCCAUCGCCUUCAGGUG UAUCAACGAGAAUCUGACCCGCUACAUCUC UAAUAUGGACAUCUUCGAGAAGGUGGACGC CAUCUUUGAUAAGCACGAGGUGCAGGAGAU CAAGGAGAAGAUCCUGAACAGCGACUAUGA UGUGGAGGAUUUCUUUGAGGGCGAGUUCUU UAACUUUGUGCUGACACAGGAGGGCAUCGA CGUGUAUAACGCCAUCAUCGGCGGCUUCGU GACCGAGAGCGGCGAGAAGAUCAAGGGCCU GAACGAGUACAUCAACCUGUAUAAUCAGAA AACCAAGCAGAAGCUGCCUAAGUUUAAGCC ACUGUAUAAGCAGGUGCUGAGCGAUCGGGA GUCUCUGAGCUUCUACGGCGAGGGCUAUAC AUCCGAUGAGGAGGUGCUGGAGGUGUUUAG AAACACCCUGAACAAGAACAGCGAGAUCUU CAGCUCCAUCAAGAAGCUGGAGAAGCUGUU CAAGAAUUUUGACGAGUACUCUAGCGCCGG CAUCUUUGUGAAGAACGGCCCCGCCAUCAG CACAAUCUCCAAGGAUAUCUUCGGCGAGUG GAACGUGAUCCGGGACAAGUGGAAUGCCGA GUAUGACGAUAUCCACCUGAAGAAGAAGGC CGUGGUGACCGAGAAGUACGAGGACGAUCG GAGAAAGUCCUUCAAGAAGAUCGGCUCCUU UUCUCUGGAGCAGCUGCAGGAGUACGCCGA CGCCGAUCUGAGUGUGGGCGAGAAGCUGGA GGAGAUCAUCAUCCAGAAGGUGGAUGAGAU CUACAAGGUGUAUGGCUCCUCUGAGAAGCU GUUCGACGCCGAUUUUGUGCUGGAGAAGAG CCUGAAGAAGAACGACGCCGUGGUGGCCAU CAUGAAGGACCUGCUGGAUUCUGUGAAGAG CUUCGAGAAUUACAUCAAGGCCUUCUUUGG CGAGGGCAAGGAGACAAACAGGGACGAGUC CUUCUAUGGCGAUUUUGUGCUGGCCUACGA CAUCCUGCUGAAGGUGGACCACAUCUACGA UGCCAUCCGCAAUUAUGUGACCCAGAAGCC CUACUCUAAGGAUAAGUUCAAGCUGUAUUU UCAGAACCCUCAGUUCAUGGGCGGCUGGGA CAAGGAUAAGGAGACAGACUAUCGGGCCAC CAUCCUGAGAUACGGCUCCAAGUACUAUCU GGCCAUCAUGGAUAAGAAGUACGCCAAGUG CCUGCAGAAGAUCGACAAGGAUGAUGUGAA CGGCAAUUACGAGAAGAUCAACUAUAAGCU GCUGCCCGGCCCUAAUAAGAUGCUGCCAAA GGUGUUCUUUUCUAAGAAGUGGAUGGCUUA CUAUAACCCCAGCGAGGACAUCCAGAAGAU CUACAAGAAUGGCACAUUCAAGAAGGGCGA | SEQ ID NO: 603 |
| | UAUGUUUAACCUGAAUGACUGUCACAAGCU GAUCGACUUCUUUAAGGAUAGCAUCUCCCG GUAUCCAAAGUGGUCCAAUGCCUACGAUUU CAACUUUUCUGAGACAGAGAAGUAUAAGGA CAUCGCCGGCUUUUACAGAGAGGUGGAGGA GCAGGGCUAUAAGGUGAGCUUCGAGUCUGC CAGCAAGAAGGAGGUGGAUAAGCUGGUGGA GGAGGGCAAGCUGUAUAUGUUCCAGAUCUA UAACAAGGACUUUUCCGAUAAGUCUCACGG CACACCCAAUCUGCACCAUGUACUUUCAA GCUGCUGUUUGACGAGAACAAUCACGGACA GAUCAGGCUGAGCGAGGAGCAGAGCUGUU CAUGAGGCGCGCCUCCCUGAAGAAGGAGGA GCUGGUGGUGCACCCAGCCAACUCCCCUAU CGCCAACAAGAAUCCAGAUAAUCCCAAGAA AACCACAACCCUGUCCUACGACGUGUAUAA GGAUAAGAGGUUUUCUGAGGACCAGUACGA GCUGCACAUCCCAAUCGCCAUCAAUAAGUG CCCCAAGAACAUCUUCAAGAUCAAUACAGA GGGUGCGCUGCUGAAGCACGACGAUAA CCCCUAUGUGAUCGGCAUCGAUAGGGGCGA GCGCAAUCUGCUGUAUAUCGUGGUGGUGGA CGGCAAGGGCAACAUCGUGGAGCAGUAUUC CCUGAACGAGAUCAUCAACAACUUCAACGG CAUCAGGAUCAAGACAGAUUACCACUCUCU GCUGGACAAGAAGGAGAAGGAGAGGUUCGA GGCCCGCCAGACAUGGACCUCCAUCGAGAA UAUCAAGGAGCUGAAGGCCGGCUAUAUCUC UCAGGUGGUGCACAAGAUCUGCGAGCUGGU GGAGAAGUACGAUGCCGUGAUCGCCCUGGA GGACCUGAACUCUGGCUUUAAGAAUAUCCG CGUGAAGGUGGAGAAGCAGGUGUAUCAGAA GUUCGAGAAGAUGCUGAUCGAUAAGCUGAA CUACAUGGUGGACAAGAAGUCUAAUCCUUG UGCAACAGGCGGCGCCCUGAAGGGCUAUCA GAUCACCAAUAAGUUCGAGAGCUUUAAGUC CAUGUCUACCCAGAACGGCUUCAUCUUUUA CAUCCCUGCCUGGCUGACAUCCAAGAUCGA UCCAUCUACCGGCUUUGUGAACCUGCUGAA AACCAAGUAUACCAGCAUCGCCGAUUCCAA GAAGUUCAUCAGCUCCUUUGACAGGAUCAU GUACGUGCCCGAGGAGGAUCUAUUCGAGUU UGCCCUGGACUAUAAGAACUUCUCUCGCAC AGACGCCGAUUACAUCAAGAAGUGGAAGCU GUACUCCUACGGCAACCGGAUCAGAAUCUU CCGGAAUCCUAAGAAGAACAACGUGUUCGA CUGGGAGGAGGUGUGCCUGACCAGCGCCUA UAAGGAGCUGUUCAACAAGUACGGCAUCAA UUAUCAGCAGGGCGAUAUCAGAGCCCUGCU GUGCGAGCAGUCCGACAAGGCCUUCUACUC UAGCUUUAUGGCCCUGAUGAGCCUGAUGCU GCAGAUGCGGAACAGCAUCACAGGCCGCAC CGACGUGGAUUUUCUGAUCAGCCCUGUGAA GAACUCCGACGGCAUCUUCUACGAUAGCCG GAACUAUGAGGCCCAGGAGAAUGCCAUCCU GCCAAAGAACGCGCCAAUGGGCGCCUA UAACAUCGCCAGAAAGGUGCUGUGGGCCAU CGGCCAGUUCAAGAAGGCCGAGGACGAGAA GCUGGAUAAGGUGAAGAUCGCCAUCUCUAA CAAGGAGUGGCUGGAGUACGCCCAGACCAG CGUGAAGCACAAAAGGCCGGCGGCCACGAA AAAGGCCGGCCAGGCAAAAAAGAAAAAGUA AUGUAAUAGGCUGGAGCCUCGGUGGCCAU GCUUCUUGCCCCUUGGGCCUCCCCCAGCC CCUCCUCCCCUUCCUGCACCCGUACCCCCG UGGUCUUUGAAUAAAGUCUGA | |
| ID405 | GGAAAUAAGAGAGAAAAGAAGAGUAAGAAG AAAUAUAAGAGCCACCAUGGCCAGAAUAAU UGACGAAUUCUGCGGACAGAUGAACGGGUA UUCAAGAAGCAUAACACUGAGAAACCGGUC GGUCCCUAUCGGCAAGACAGAGGAGAAUCU GAAGCAAUUCUGGAGAAGGACCUGGAGCG GGCCACGCCUAUCCUGACAUCAAGAACCU GAUCGAUGCCAUCCACCGGAACGUGAUUGA GGACACCCUGAGCAAGGUGGCCCUGAACUG | SEQ ID NO: 604 |

| Nuclease | Full mRNA sequence (with 5' and 3' UTRs) | SEQ ID NO: |
|---|---|---|
| | GAAUGAAAUUUCAAUAUCCUGGCCACCUA CCAGAACGAGAAGGAUAAGAAAAAAAAAGC UGCCAUUAAGAAGGACCUGGAAAAGCUCCA AAGCGGCGCCAGAAAAAGAUAGUGGAGGC UUUUAAGAAGAACCCCGAUUUCGAGAAGCU GUUCAAGGAAGGACUGUUCAAGGAACUGCU GCCUGAGCUGAUCAAAAGCGCUCCUGUGGA CGAGAUCGCCGUUAAGACCAAGGCUCUGGA GUGCUUCAACAGGUUCAGCACCUACUUUAC CGGCUUCCACGACAACAGAAAGAACAUGUA CAGCGAAGAAGCCAAGAGCACAGCCAUCUC UUAUAGAAUCGUGAACGAAAAUUUCCCCAA GUUCUUCGCAAACAUCAAGCUAUUCAACUA CCUGAAGGAGCACUUCCCUAGAAUCAUAAU CGAUACCGAGGAAUCUCUGAAGGACUACCU GAAGGGCAAGAAGCUGGAUAGCGUGUUCUC UAUCGAUGGCUUCAACUCUGUGCUGGCUCA GAGCGGCAUCGAUUUCUACAACACCGUGAU CGGAGGAAUUAGCGGAGAGGCCGGCACCA GAAGACACAGGGCUUAAAUGAGAAGAUUAA CCUGGCCAGACAGCAGCUGAGCAAGGAAGA GAAGAAUAAGCUGAGAGGAAAGAUGGUGGU GCUGUUUAAACGAUCCUGAGCGACAGAGA AACCUCUUCUUUCAUCCCCUGUUGGCUUUGC CAAUAAGGAAGAGGCUACAGCACCGUGAA GGAGUUCAAUAACAGCAUCGCUGAGAAAGC CGUGAGCAAGGUGCGGGACUUGUUCCUGCA CAGAGAGGAAUUCACCCUGAAUGAGAUCUU CGUUCCUGCCAAAAGCCUGACAGAUUUCUC UCAGGCCAUCUUUGGAAGCUGGAGCAUCCU GUCUGUAGGGCCUGUUCCUGCUUGAAAGGA CAGCAUGAAGAAAGCCCUGUCUGAAAGCCA GGAGGAAAAGAUCAACAAGGAAAUCGCCAA GAAGGACUGCAGCUUCACCGAACUGCAGCU CGCCUACGAGAGAUACUGCACCGAGCACAA CCUACCCGUGGAGAAAUUCUGUAAAGAUUA CUUUGACAUCGUUGACUAUAGAGGCAACGG AGCUAAGAGCGAGAAGACGAAGGUGAGCAU CCUGUCCGAGAACUCUGGAAACAUUCCUCCA ACUGGACUUUGACCACACUCAGGACCUGCA ACAGGAGAAGAACGCCGCCAUCCCCAUCAA GGCAUACCUGGACGAAGUGCAGAACCUGUA CCACCACCUGAAGCUGGUGGACUACCGGGG AGAGGAACAGAAGGAUUCUACCUUCUACAG CAAGCACGACGAGAUUCUCACCGAUCUGAG CCAGAUUGUGCCUCUGUACAACAAGGUACG GAACUUUGUGACCAAAAAGCUGGGCGAGAG CAAGAAGAUUAAGCUGAACGAAUUCGACUG UCCUACCCUGGCCAACGGCUGGGAUGAGAAUCA GGAGAGCAGCAACGACGCGAUCAUCCUGCG GAAGGACGGCAAGUACUACCUGGGCAUCUA CAACCCUAAUAACAAGCCCAAGUUCGCCAA GAAAGACAGUAUCGUGGGCGACUGCUACGA GAAGAUGGCCUACAAGCAGAUUGCCCUGCC AAUGGGCUCCGGCGCCUUCGUGAGAAAGUG CUUCCGCACCGCACAGAGACGGCGCUGGGG AUGUCCUAGAACUGCCUGAACUCCGAAGG CAAGAUCAUCAUCAAGGACGAGGAAGCCAA GGGCAACCUCGAAGCCAUCAUCGACUGCUA CAAAGACUUCCUGAACAAGCGAGAAGGA UGGAUUCAAGUACAAGGACUACAACUUCAG CUUCCUGGACUCUGCCAGCUACGAGAAACU GAGCGACUUCUUCAACGACGUCAAGCCUCA GGGCUACAAGCUGAGCUUUACCAGCAUCCC ACUGAGCGAAAUCGAUAAGAUGAUCGACGA GGGCAAACUGUUUCUGUUUCAGAUCUACAA UAAAGACUUCGCCAAGAAGGCCACAGGCAA AAAGAACCUGCACACCCUGUACUGGGAGAA UCUAUUUCUGUCGAGAACCUGCAAGAUGU GGUGCUGAAGUUGAACGGCGAGGCCGAACU GUUCGGCGGGAGGCUAGUAUCAAGGAGGA UAAGGUGAUCUGCAUAAGAA | |
| ID414 | GGGCAGUAUCCUUGUGAACCGAACCACCAC CGACGGCAAGAGCAUCCCAGAAGCCAUCUA CCAGGAGAUUUACCAGCUGAAGAACAAGAU | SEQ ID NO: 605 |

| Nuclease | Full mRNA sequence (with 5' and 3' UTRs) | SEQ ID NO: |
|---|---|---|
| | GGCCGAUAGCAUCAGCGACGAGGCCAAAAG ACUGCUGGAGUCCGGCACAGUGGUGUGCAA GGUCGCGACACACGAUAUCGUGAAGGACAA ACACUUCACAGAGAACACAUACCUGUUCCA CUGUCCUAUCACCAUGAACUUUAAGGCCAA GGACAGAACAAAUAAAGAAAUUCAACAACCA CGUGCUGGAGGUGCUGAACAAGAACCCCGA UAUCAAAGUGAUCGGACUGGACAGAGGAGA GAGACACCUGCUGUACCUGUCCCUGAUCAA CCAGAAAGGCGAGAUCGAGUGUCAGAAAAC ACUGAACCUGGUCGAGCAGGUGCGGAACGA CAAGACCGUGUCCUGAAUUACCAUGAGAA GCUGGUGCACAAGGAGGGGUCCCGUGACGC CGCCCGCAAGAACUGGCAGACCAUCGGCAA UAUCAAGGAGCUGAAAGAAGGCUACCUGAG CGCUGUGGUGCAUGAGAUCGCUAGCCUGAU GGUCAAACACAACGCCAUCGUGGUGAUGGA AGAUCUGAAUUUCGGCUUUAAGCGGGGUAG AUUCGCUGUGGAACGGCAGAUCUACCAAAA GUUCGAGAAUAUGCUGAUCGAGAAACUUAA CUACCUGGUAUUCAAAGAUAGGAAGGUGAC CGAGCCCGGCGGAGUGCUGAACGCCUAUCA GCUCGCUAAACAAGAGCGCCAAGGUGACAGA CGUGUACAAGCAGUGUGCCUGUGUUCUA CAUCCCUGCUGCCUACACCAGCAAGAUCGA CCCCAGAACCGGCUUCGCCAAUCUAUUCAU CACCAAGGGUCUGACCAACGUGGAAAAGAA GAAAGAAUUCUUCGGCAAGUUUGACUCGAU AAGGUACGACGCCAGAGAGCUGCUUCGU GUUCAGCUUCGAUUACGCCAAAAUCUGCGA CAACGCCGUCAUAUAAGAAAAAGUGGGACGU GUAUACAAGAGGCACCAGACUUGUGUACAA CAAAAACCGAAAGAAAAACGUGUCAGUGAA CCCUACAGAGGAACUGCAGUGCGUGUUCGA UGAAUUCGCAUCAAGUGGAACAACCACGU GGAUCUGAUCGAGAGCAUCAGCCUGAUCCC CGCCGAGAAGUCUAACGCCAAGUUCUUCGA CGUGCUGCUGAGAAUGUUCAACGCCACACU GCAGAUGAGAAACAGCGGCGUGCAAACCAA CACCGACUACUGGGGUCCCCUGAAGGC CAGGACGGCAGCUUCUUUGAUAGCAGAGA GGAAUUCAAAAAGGGCGGCGAUGCCCCGGCU GCCUAUCGAUUGCGACGCCAACGGCGCCUA CCACAAUGCCCAGAUGGGCCUGUACCUGCG GCUGAACGAUUUCAAUAGAGAUAAUAAAGG CGUGAUCCAAAACAUCUCUAACAAGGACUG GCUCAAGUGCGUGCAGGAGAAGGUGUACAA GGACAAAAGGCCGGCCUGCACCAAAAAGGC CGGCCAGGCAAAAAAGAAAAAGUAAUGAUA AUAGGCUGGAGCCUCGGUGGCCAUGCUUCU UGCCCCUUGGGCCUCCCCCAGCCCCUCCUU CCCCUUCCUGCACCCGUACCCCCGUGGUCU UUGAAUAAAGUCUGAGUGGGCGGCUU | |

| Nuclease | Full mRNA sequence (with 5' and 3' UTRs) | SEQ ID NO: |
|---|---|---|
| | CGUGGACUAUUUCGAUUUCGUACUGACCCA<br>GUCCGGCAUUGACAUCUACAACUACAUGAU<br>CGGCGGAUACACCUGCAGCGACGGCACCAA<br>AAUUCAGGGCCUAAAUGAGUGUAUCAACCU<br>GUAUAACCAGCAGGUGGCCAAGAAUGAGAA<br>AAGCAAGCGCCUGCCUCUGAUGAAGCCACU<br>GAGAAAGCAGAUCCUGUCUGAAAAAGAUUC<br>UGUGUCUUUCAUCCCCGAAAAGUUCAACAG<br>CGACAACGAGGUGCUGCUCGCCAUCGAAGA<br>GUAUUACAACAACCACAUCUCCGACAUCGA<br>CAGCCUGACCGAGCUGCUGCAGAGCCUGAA<br>UACCUACAACGCCAACGGCAUCUUCAUCAA<br>AUCAGGCGCCGCCGUGUCAGACAUCAGCAA<br>CGCCGCUUUUAACGCUGGAACGUGCUGAG<br>GCUGGCCUGGAACGAAAAGUACGAGGCCCU<br>GCAUCCUGUGACCAGCACCACCAAGAUCGA<br>CAAAUACAUCGAGAAAGGGACAAGGUGUA<br>CAAGAGCAUCAAGUCCUUCAGCCUGUUCGA<br>GCUGCAAGAGCUGGGAGCUGGAACAGGCAA<br>CGAGAUCACCGACUGGUACAUCUCCAGCAU<br>CAACGAGUGCAACAGAAAAUAAAAGAAAC<br>CUACCUGCAGGCCAGAGAGCUGCUGGAGAG<br>CGACUAUGAGAGGAAACAAGGAUAAACGGCU<br>GUACAAAAACGAAAAGGCCACAGAGCUGGU<br>GAAGAAUCUGCUGGACGCCAUCAAGGAAUU<br>UCAGCAACUGGUGAAGCUCCUGAACGGUAC<br>AGGCAAGGAGGAAAACAAGGAAGAGCUCUU<br>UUACGGCAAGUUCACAUCUCUCUACGACAG<br>CGUUGCCGAUAUCGAUAGACUUUACGACAA<br>AGUGCGGAACUACAUUACACAGCGGCCUUA<br>CUCUAAGGACAAAAUCAAGCUGAACUUCGA<br>CAACCCCCAGUUGCUGGGCGGAUGGGAUAA<br>AAACAAGGAAAGCGACUACAGAACCGUGAU<br>CCUGAGGAAGAACGACUUUUAUUACCUGGC<br>UGUGAUGGACAAAAGCCAAGGUGUU<br>CGUGAACGCCCUGAGAUCACCAGCGAAGA<br>UGAGGACUACUACGAGAAGAUGGAAUAUAA<br>GCUGCUGCCAGGCCCCAAUAAGAUGCUGCC<br>UAAGGUGUUCUUCGCCUCCCGGAAUAUCA<br>CAAGUUCCAGCCUAGCGACCGCAUCCUGGA<br>UAUUCGGAAGCGGGAAUCUUUUAAGAAGGG<br>CGCCACCUUCAACAAGUCCGAAUGCCACGA<br>GUUUAUCGACUACUUCAAGGAAUCAAUUAA<br>GAAGCACGACGACUGGUCCAAGUUCGGCUU<br>UGAGUUCUCUCCUACCGAGAGCUACAACGA<br>UAUCAGUGAGUUCUACAGAGAGGUGAGCGA<br>UCAGGGCUACUACAUCAGCUUCAGCAAGAU<br>CAGUAAGAACAUCGACAAACUUGUGGA<br>GAAUGGCUACCUGUACCUGUUUAAAUCUA<br>CAACAAGGACUUCAGCAAAUACUCCAAGGG<br>CACACCUAACCUGCAUACCCUGUACUUCAA<br>GAUGCUGUUCGACGAGCGAACCUCAGCA<br>CGUGGUCUACAAACUGAACGGAGAGGCCGA<br>GAUGUUCUACAGAGAAGCUAGCAUUACGA<br>CAAGGAAAAGAUCACCCACCACGCCAACCA<br>GCCUAUCAAGAACAAGCCUGAUAACGA<br>GAAAAGGAAAGCGUGUUUGAGUACGACAU<br>CGUGAAGGAUAAGAGAUUCACCAAGCGGCA<br>GUUCAGCCUGCACGUGUCUGUCACAAUCAA<br>UUUCAAAGCCCACGGACAGGAGUUCCUGAA<br>CUACGACGUGCGGAAGGCUGUGAAGUACAA<br>GGACGACAACUACGUGAUCGGCAUCGAUAG<br>AGGCGAGAGAAACCUGAUCUACAUCAGCGU<br>UAUCAACAGCAACGGCGAGAUCGUGGAACA<br>GAUGCAACUGAACAAAAUCAUUGGCACAA<br>CGGCUACUCUGUGGACUAUCAGAAGCUGCU<br>GGACAAGAAAGAAGGAAAGAGAUAAGGC<br>GAGAAAGAAUUGGACCUCCGUCGAGAACAU<br>CAAGGAACUGAAGGAGGGCUACAUCAGCCA<br>GGUGGUGCACAAGAUAUGAACUGGUGGU<br>GAAGUACGAUGCCGUGAUCGCCAUGGAAGA<br>UCUGAACUUCGGAUUCAAAAGAGGCAGAUU<br>CCCCGUGAAAAGCAAGUGUACCAGAAGUU<br>CGAAAACAUGCUGAUCAGCAAGCUGAACCU<br>GCUGAUUGACAAGAAAGCAGAGCCUACAGA<br>GACCGGCGGCCUGCUGCGGGCCUACCAACU | |

| Nuclease | Full mRNA sequence (with 5' and 3' UTRs) | SEQ ID NO: |
|---|---|---|
| | GACAAACAAGUUCGACGGCUGAACAAAGC<br>CAAGCAGAACGGCAUCAUCUUCUACGUGCC<br>UGCCUGGGACACCUCUAAGAUCGACCCUGU<br>GACUGGCUUCGUGAACCUGCUGAAGCCCAA<br>GUAUACCUCGGUGCGGGAGGCCAAGAAGCU<br>GUUCGAGACCAUCGACGAUAUCAAGUACGA<br>CACCAACACAGACAUGUUCGAGUUCUGCAU<br>CGAUUACGGCAAAUUCCCUAGAUGUAACAG<br>CGACUUCAAGAAAACCUGGACAGUGUGCAC<br>CAACUCUAGCCGGAUCCUGAGCUUCAGAAA<br>CGAAAAGAAAAACAACGAGUGGGACAACAA<br>GCAAAUCGUCCUGACCGACGAAUUCAAGUC<br>UCUGUUCAACGAGUUUGGCAUCGAUUACAC<br>CUCGGACCUGAAAGCUAGCAUCCUGUCUAU<br>CAGCAGCGACUGGUUCUACAAUAGACUGAU<br>CCGGCUGCUAUCUCUGACACUGCAGAUGCG<br>UAACAGCAUCAUCGGUAGCACCCUGCCCGA<br>GGACGACUACCUGAUCAGCCCUGUGGCCAA<br>CGACCGGGAGAAUUCUACGACAGCAGAAA<br>CUACAAAGGCUCCAACGCCGCCCUUCCAUG<br>UGACGCCGACGCCAACGGCGCUUACAAUAU<br>CGCCCGGAAAGCCCUGUGGGCUAUCAACGU<br>GCUGAAGGAUACCCUGACGAUAUGCUGCA<br>GAAGGCCAAGCUCAGCAUCACCAAUGCCGA<br>GUGGCUGGAAUACACCCAGAGAAAAGGCC<br>GGCGGCCACGAAAAAGGCCGGCCAGGCAAA<br>AAAGAAAAGUAAUGAUAAUGGCUGGAGC<br>CUCGGUGGCCAUGCUUCUUGCCCCUUGGGC<br>CUCCCCCCAGCCCCUCCUCCCCCUUCCUGCA<br>CCCGUACCCCCGUGGUCUUUGAAUAAAGUC<br>UGA | |
| ID418 | GGGAAAUAAGAGAGAAAAGAAGAGUAAGAA<br>GAAAUAUAAGAGCCACCAUGAAGGCCGAGC<br>UGUUCAAGACAUUCGUGGACGAAUACCCCG<br>UGUCUAAGACACUGCGGUUCAGCCUGAUUC<br>CUGUGGGCAGAACCCUGGAAAACAUCGAAA<br>AGGACGGCAUCCUGGAUUGUGAUGAGAAGC<br>GAUCUGAAGAAUACAAGAGAGUGAAGAAGC<br>UGCUGGAUGAACUACAACAAGACAUUCAUCG<br>AGCACGCCCUGACCAAUGUAGAACUGGAUA<br>UCAACUCCCUGGAAGAAUACGAGAGACUCU<br>ACAACAUCAAAACCAAGUCAGACAAGGAAA<br>AGGCCGAUUUUGACAGCGUGCAGAAAACCG<br>UAAGGAAACAGAUUGUGAAGGCCCUGAAGG<br>AGGAUGAGAAGUACAAGUUCCUUUUCAAGA<br>AGGAAAUCAUCGAGAAGGAACUGGUAGAUU<br>UUCUGAACGACGAGAGCAGCGAUGUGGAGC<br>UGGUCAAGUCCUUCAAGGGCUACGCUACCA<br>UGUUCCAAGGCUUCUGGGACGCUAGAAAGA<br>AUAUCUUCAGCGACGAAGAGAAAGCACCG<br>CCAUCGCUCACAGAAUCAUCAACGAAAAUC<br>UGCCUAAGUUUAUCUCUAAUAAAAACAUCU<br>ACUUCACCAAGAUCCAGCCUGAGAUGGAUU<br>CCGAGCUGGACCAGCUGACACUGAGCAACA<br>ACAGCAAUGAGAACAGAGAGAUAUCUUUAAGC<br>UGGAGUAUUUCAGCAAAACCAUCACCCAGA<br>CAGGCAUCGAGAUCUAUAAUGGAAUUCUGG<br>GCGGAUACACCAUCGAUGAACAGGUGAAAC<br>UGCAGGGAACAACGAGAUCGUGAACCUGC<br>AUAAUCAGAAGAACAAGGCAGUGGCAAGA<br>UCCCAAAGCUGAAGAUGCUGUAUAAGCAGA<br>UCCUGAGCGAUACAAACACGCUGUCAUUCA<br>UCGCCGAGGCUUUGAGACCGAUGACGAGG<br>UUCUGGAAUCGCUUAAAUUUUCUACGACG<br>UGUUCAACGAGAACAUCCUGGACGAGGACC<br>UGGGUAUAAUCAACCUGCUGAGAAACAUCG<br>AUAAGUUCUCCUACGAUGGGAUCUACAUCA<br>AGAAUGACAAGGCCCUGAUCGACAUCAGCA<br>ACUACCUGUCGACUGGCUGGCCAUCAGCA<br>AAAACGCCAUCAAUAAAAAUGAGAUCG<br>AUAACCCUGGCAAGAACACAGAGAAGUACA<br>UCGUGAAAAGAAUAAAUUCAUCAAGAGCU<br>UCGACUCUUUCAGCCUGAAGUACCUGCAGG<br>ACUGUACAGGCAGCAAGUUCAACGAGCACA<br>UCCUGAUCAAGAUCAACAACCUGAUCGACG | SEQ ID NO: 606 |

| Nuclease | Full mRNA sequence (with 5' and 3' UTRs) | SEQ ID NO: |
|---|---|---|
| | ACGUGAAGAAGGCUUACAACAGCGUCGCCC UGCUGAUCAAGAACAAGUACGAGGGAACCA ACCUGAUCAACGACAAGGACGCCAUCGAGA AGAUCAAGCAAUUUCUGGACAGCAUGAAGA GCCUGGUGUCCUUCAUCAGAUGCUUCGAAG GCACAGGCCAGGAGCCUGACGAGAUGAAA UCUUCUACGGCGAGUUCGAUACCGGCAAGA AGACCUUCUACUACCUGAACAACAUCUACA ACAAGACCAGAAACUACGUGACCAAGAAGC CCUACAGCAUCGGAAAAUACAAGCUGAACU UCGACAAUGCCGAACUGCUGACCGGAUGGG AUCUGAACAAGGAGACAUCUAAGGCCUCCA UCAUUCUGAAGAAGGACAAUCUAUACUAUC UCGGAAUCAUGAACAAGCAUGAGACGGG UGUUCCUGAACGUGCCAGAAACCGAGAGCA CCUACAACUGCUACGAGAAGAUGGAGUACA AACUGCUCCCCGGCCCUAACAAAAUGCUGC CUAAGGUCUUCUUCGCCAAAAGUAACAUCG ACUACUACGACCCUAGCCCCGAAGAUUAUGC GGAUCUACAAGGAGGGCACCUUCAAAAAGG GGGAUAACUUCAACAUUGACGACUGCCACG ACUUAAUCGACUACUUCAAAGAGAGCCUGG ACAAGAACGAGCCACAUCUUCGAUU UUGACUUCAGCGAGACAAGCAGCUACAAGG ACAUCGGAGAAUUCUAUAAGGAAGUUCAGC AGCAGGGCUACAAAAUCAGCUUUAAGAACA UCGCCAGCAGCUAUGUGGAC GAGCUUGUGGAGAACGGAAAGCUGUACCUG UUCCAGAUCUACAACAAGGACUUUUCUAAG AACUCUAAAGGCACCGAGAACCUGCACACA AUGUACUGGCCCCUGUUCGACGAGGAG AACCUGGAAAAUGUGAUCUACAAGCUGAAC GGCGACGCCGAGAUCUUUUCAGAAGAAAA UCCAUAUCCGAGAACGAGAAGAUCGUGCAC CCAGCCCACGUGGAUGGAAGAAUAAAAAAU GACGAGACUCGGAAGGAAAAAAAAGACAAGC AUCUUUAACUACGACAUCAUCAAGGAUAAG AGAUUCACCGUGGACAAAUUUCAGUUUCAC GUGCCCAUCACCCUGAACUUUCAGGCCAUC GAUCGGAAGAGCGAUAUCAACUCAGAAUG CGGCAGGAGAUCAAAAAGAACAAGGACAUG CACAUCAUCGGCAUAGACAGAGGCGAGAGA AACCUUCUGUAUAUCAGCAUCAUCGACCUG GACGGCAAUGCGUAAGCAGGAGAGCCUC AACACCAUCACCAACGAAUACGACGGCAAG AUUUAUACCACAGACUAUCACAAGCUGCUC GACAAGAAGGAGGAGAAGCGCAAAGUCGCC AGACAACUGGAACACCAUCCGAGAAUAUC AAGGAACUGAAAGCUGGAUACAUGAGCCAG GUGGUGCAUAAAAUUACACAGCUGAUGAUG GAAUACAACGCAAUCGUCGUGCUGGAAGAU CUAAACACCGGCUUCAAGCGGGGCAGGCAA AAGGUGGAAAAGCAGAUCUACCAGGCCUUC GAGAAAGCCCUGAUCAACAAGCUGAACUAC UACGUGGACAAGAAGGUGGAUAAGAACGAA AUAAGCGGCCUGCUCUAUCUGUCAGCUG ACCAAGGAGUUCGAAAGCUUAAAAAAGCUG GGCAAGCAGUCUGGAGCCAUCUUCUAUGUG CCUGCUUGGAACACAAGCAAGAUGGACCCC ACCACCGGCUUCGUGAACCUGCUGUCUGC AAGUACGAGAACAUGGAAAAGUCCAAAGAG UUCAUCAACAAAAUCAAGGACAUCAACUUC AAGGAGGAUGACUGCGGCAAAUACUACGAA UUUCACAUCGAUUUCAACGAAUUCACCGAC AAGGGCAAGACCUGCAAGGACCGAUUGGAU AUCUGCAGCUUUGGCAAGCGGAUCGACAAC GCAAGAAAUCAGAAAGGAGAUUUCGAGUCC AAGAUGAUCGACCUGACAAACGAGUUCCAC AACCUGUUCAAGAAGUACGGCAUCAACGAC AACGACAAUCUGAAGGAGCAUGACCCUGAAU GUGAAGGAAGCUAAAUUUUACAAGGAAUUC AUCAACCUGUUCAAGCUGAUGCUGCAAAUC CGGAAUUCUGAGAGCAAUGAAAAGGUGGAC UUCCUGCAAAGUCCGUGUGAAAAACAACAAG GGCAGAGUUCUUCAACUCUAACAACGUGAAC GGCAACGAGGGCCCCUGAGAAUGCCGACGCC | |

| Nuclease | Full mRNA sequence (with 5' and 3' UTRs) | SEQ ID NO: |
|---|---|---|
| | AACGGCGCCUACAACAUAGCUAGAAAGGGC CUGUGGGAUCGGAACCAGAUCAAGACCAUG CCUGAUAGCCAGAUGCACAAAAUUAAGCUG GCCAUGAAGAACCAGGAAUGGCUGCUGUUC GCCCAGAAGGGCAACGUGAAAAGGCCGGCG GCCACGAAAAAGGCCGGCCAGGCAAAAAAG AAAAAAGUAAUGAUAAUAGGCUGGAGCCUCG GUGGCCAUGCUUCUUGCCCCUUGGGCCUCC CCCCAGCCCCUCCUCCCCCUUCCUGCACCCG UACCCCCGUGGCUUUUGAAUAAAGUCUGA | |
| AsCas12a Ultra | GGAAAUAAGAGAGAAAAGAAGAGUAAGAAG AAAUAUAAGAGCCACCAUGACCCAGUUCGA AGGCUUCACCAACCUGUACCAGGUGUCCAA GACACUGCGCUUCGAGCUGAUCCCACAGGG CAAAACCCUGAAACACAUCCAGGAGCAGGG AUUCAUCGAAGAGGACAAGGCCAGAAACGA CCACUACAAGGAACUGAAGCCCAUCAUCGA CCGGAUCUACAACACGCUGAUCAAUG UCUGCAGCUGGUGCAGCUGGAUGGGGAGAA CCUGAGCGCCGCCAUCGAUAGCUACCGGAA GGAAAAAACCGAAGAAACCCGGAACGCCCU GAUCGAGGAACAGGCCACAUACAGAAACGC CAUCCACGAUUACUUCAUCGGCAGAACCGA CAACCUGACAGAUGCUAUCAACAAGCGCCA CGCCGAAAUCUACAAAGGCCUGUUCAAGGC CGAGCUGUUCAACGGUAAGGUGCUGAAACA GCUGGGCACCGUGACAACGACGGAACACGA GAACGCCUGCUGAGAGCUUUGACAAGUU CACCACCUACUUCUCUGGCUUUUACGAGAA CAGAAAGAAUGUGUUCAGCGCCGAAGAUAU UAGCACCGCCAUCCCUCACAGAAUAGUCCA GGACAAUUUCCCUAAGUUCAAGGAAAACUG CCACAUCUUUACCAGACUCAUCACCGCUGU GCCUUCUCUGAGAGAACACUUCGAGAACGU GAAGAAGGCAAUCGGCAUCUUCGUGUCUAC CUCCAUCGAGGAGGUCUUUAGCUUCCCUUU CUACAACCAGCUGCUGACACAGACACAGAU CG ACCUGUACAACCAGCUGUUGGGCGGCAUCA GCCGGGAGGCCGGCACCGAGAAGAUCAAAG GUCUGAAUGAGGUUCUGAACCUGGCAAUCC AGAAGAACGACGAGACAGCCCACAUCAUCG CCUCCCUGCCUCACAGAUUCAUCCCCCUCUGU UCAAGCAGAUCCUGAGUGACAGAAACACCC UGAGCUUCAUUCUGGAAGAAUUCAAGAGCG ACGAGGAAGUGAUCCAGAGCUUCUGCAAGU ACAAGACCCUGCUGAGAAACGAAAAAGUGC UGGAGACCGCCGAGGCCCUGUUCAACGAGC UGAACAGCAUCGACCUGACCCACAUCUUCA UCAGCCACAAGAAGCUGGAGACCAUCAGCA GCGCCCUGUGUGACCACUGGGACACCCUGC GGAACGCGCUGUACGAGAGACGGAUCAGCG AGCUGACCGGAAAGAUCACAAAGUCUGCCA AGGAAAAGGUGCAGCGGUCCCUUAAACACG AGGACAUAAACCUGCAGGAGAUCAUCCUCUG CUGCUGGAAGGAACUGAGCGAGGCCUUCA ACAGAGAACAAGCGAAAUCCUGAGCCAUG CCCAUGCUGCCCUGGAUCAGCCUCUGCCUA CCACACUGAAAAAGCAGGAGGAAAAGGAAA UCCUGAAGUCUCAGCUGGAUAGCCUGCUCG GCCUGUACCACCUGCUCGAUUGGUUCGCCG UGGAUGAGAGCAACGAGGUGGACCCCGAAU UCUCCGCUCGGCUGACCGGCAUUAAGCUGG AAAUGGAACCGAGCCUGAGUUUUUAUAACA AGGCCCGCAACUACGCCACCAAGAAGCCUU ACAGCGUCGAGAAGUUUAAGUUGAACUUCC AGAGACCGACACUGGCCAGCGGCUGGGAUG UCAACAAAGAAAAGAACAACGGCGCCAUCC UGUUUGUGAAGAACGGCCUGUACUACCUGG GCAUCAUGCCUAAACAGAAGGGCAGAUACA AGGCCCUGAGCUUCGAGCCAACAGAGAAGA CCUCUGAAGGCUUUGAUAAAAUGUACUACG AUUACUUCCCCGAUGCAGCUAAGAUGAUCC CAAAUGCAGCACCCAACUGAAAGCCGUGA CCGCUCACUUCCAGACACACACAACCCCUA | SEQ ID NO: 607 |

| Nuclease | Full mRNA sequence (with 5' and 3' UTRs) | SEQ ID NO: |
|---|---|---|
| | UCCUGCUGUCCAACAACUUCAUUGAACCUC UGGAAAUCACCAAAGAAAUCUACGACCUGA ACAACCCGAGAAGGAACCCAAGAAAUUCC AGACCGCUUACGCGAAGAAAACUGGAGACC AGAAGGGCUACCGAGAGGCCCUGUGCAAGU GGAUCGACUUCACCAGAGAUUUCCUGAGCA AGUACACCAAGACAACCAGCAUCGACCUUU CCUCUCUGCGGCCUAGCUCUCAGUACAAGG ACCUGGGCGAAUAUUACGCCGAGCUGAACC CUCUGCUGUACCACAUCAGCUUUCAGCGGA UCGCCGAAAGGAGAUCAUGGAUGCUGUGG AAACAGGAAAGCUCUACCUGUUUCAAAUCU ACAACAAGGACUUUGCGAAAGGCCACCACG GCAAACCCAACCUGCACACCUUAUACUGGA CCGGACUGUUCUCUCCUGAGAAUCUGGCCA AGACCAGCAUCAAGCUGAACGGCCAGGCCG AACUCUUCUACAGACCCAAGAGCAGAAUGA AGAGAAUGGCCCACAGACUGGGCGAGAAGA UGCUGAACAAGAAGCGAGAAGACCAGAAGAA CACCCAUUCCUGACACCCUGUACCAAGAGC UGUACGACUACGUGAAUCACAGACUGAGCC ACGACCUGUCCGACGAAGCCAGAGCCCUGC UGCCUAAUGUUAUCACAAAAGAGGUAUCCC ACGAGAUCAUCAAGGAUAGAAGAUUCCACA GCGACAAGUUCCUCUUCCACGUGCCCAUCA CGCUGAAUUACCAGGCCGCUAACUCUCCAA GCAAAUUCAACCAGAGGGUGAACGCCUACC UGAAGGAGCACCCUGAGACCCCUAUCAUCG GCAUCGACCGGGGCGAGAGGAAUCUGAUAU ACAUCACCGUGAUCGACAGCACAGGAAAGA UCCUGGAACAGCGGAGCCUGAACACCAUCC AACAGUUUGACUACCAAAAGAAACUGGAUA AUAGAGAAGGAAAGAGUGGCUGCCAGAC AGGCUUGGAGCGUGGUGGGAACCAUUAAGG ACCUGAAACAGGGCUACCUGUCUCAAGUGA UCCAUGAGAUCGUGGACCUGAUGAUCCAUU ACCAGGCCGUAGUGGUGCUGGAAAACCUGA AUUUCGGCUUCAAGAGCAAGAGAACAGGGA UCGCCGAGAAGGCCGUGUACCAGCAGUUCG AGAAGAUGCUGAUCGAUAAGCUAAACUGCC UGGUGCUGAAGGACUACCCUGCCGAAAAG UGGGCGGUGUGCUGAACCCCUACCAGCUGA CCGACCAAUUCACCAGCUUCGCCAAGAUGG GAACCCAGAGCGGCUUCCUGUUCUACGUGC CUGCCCCUUAUACAUCUAAAAUUGAUCCAC UGACAGGCUUCUGGGACCCAUUUGUGUGGA AGACAAUAAAGAACCACGAAAGCCGCAAGC ACUUCUUGGAGGGCUUCGACUUCCUGCAUU ACGACGUCAAGACCGGAGAUUUUAUCCUGC ACUUCAAGAUGAACCGGAACCUGCUCUUUCC AGCGGGGCCUGCCCGGCUUUAUGCCAGCCU GGGACAUCGUGUUCGAGAAAAAUGAAACCC AAUUUGAUGCUAAGGGCACACCCUUCAUCG CCGGCAAGAGAAUCGUGCCUGUGAUCGAGA ACCAUAGAUUUACCGGCAGAUACCGCAGCC UGUAUCCAGCCAAUGAGCUCAUCGCGCUCC UGGAGGAAAAGGGAAUUGUGUUCAGAGAUG GCAGCAACAUCCUGCCUAAGCUGCUUGAGA ACGACGACAGCCACGCCAUCGACACCAUGG UGGCCCUGAUUCGGUCCGUCUGCAGAUGA GAAAUAGCAAUGCCGCCACCGGCGAGGACU ACAUCAACAGCCCUGUGCGGGACCUGAACG GCGUGUGCUUCGACAGCAGAUUCCAAAACC CUGAGUGGCCUAUGGACGCCGACGCCAACG GCGCCUAUCACAUCGCCUGAAGGGCCAGC UGCUGCUGAAUCACCUGAGGAAGAAACUAAAG ACUUGAAGCUGCAGAAUGGCAUCUCAAAUC AAGAUUGGCUGGCUUAUAUCCAGGAGCUCC GGAACUCCAGAGCCGAUCCUAAGAAGAAGA GAAAGGUGAAAGGCCGGCGGCCACGAAAA AGGCCGGCCAGGCAAAAAGAAAAGUAAU GAUAAUAGGCUGGAGCCUCGCUGGCCAUGC | |
|---|---|---|
| | UUCUUGCCCCUUGGGCUCCCCCCAGCCCC UCCUCCCCUUCCUGCACCCGUACCCCCGUG GUCUUUGAAUAAAGUCUGA | |

Q. Canonical LbCas12a (SEQ ID NO: 1385)

Source: Lachnospiraceae bacterium. As published in: Peng et al., "Structural insight into multistage inhibition of CRISPR-Cas12a by AcrVA4," PNAS, 2019, Vol. 116(38), pp. 18928-18936 (incorporated herein by reference)

MSKLEKFTNCYSLSKTLRFKAIPVGKTQENIDNKRLLVED

EKRAEDYKGVKKLLDRYYLSFINDVLHSIKLKNLNNYISL

FRKKTRTEKENKELENLEINLRKEIAKAFKGNEGYKSLFK

KDIIETILPEFLDDKDEIALVNSFNGFTTAFTGFFDNREN

MFSEEAKSTSIAFRCINENLTRYISNMDIFEKVDAIFDKH

EVQEIKEKILNSDYDVEDFFEGEFFNFVLTQEGIDVYNAI

IGGFVTESGEKIKGLNEYINLYNQKTKQKLPKFKPLYKQV

LSDRESLSFYGEGYTSDEEVLEVERNTLNKNSEIFSSIKK

LEKLFKNFDEYSSAGIFVKNGPAISTISKDIFGEWNVIRD

KWNAEYDDIHLKKKAVVTEKYEDDRRKSFKKIGSFSLEQL

QEYADADLSVVEKLKEIIQKVDEIYKVYGSSEKLFDADF

VLEKSLKKNDAVVAIMKDLLDSVKSFENYIKAFFGEGKET

NRDESFYGDFVLAYDILLKVDHIYDAIRNYVTQKPYSKDK

FKLYFQNPQFMGGWDKDKETDYRATILRYGSKYYLAIMDK

KYAKCLQKIDKDDVNGNYEKINYKLLPGPNKMLPKVFFSK

KWMAYYNPSEDIQKIYKNGTFKKGDMENLNDCHKLIDFFK

DSISRYPKWSNAYDENFSETEKYKDIAGFYREVEEQGYKV

SFESASKKEVDKLVEEGKLYMFQIYNKDFSDKSHGTPNLH

TMYFKLLFDENNHGQIRLSGGAELFMRRASLKKEELVVHP

ANSPIANKNPDNPKKTTTLSYDVYKDKRFSEDQYELHIPI

AINKCPKNIFKINTEVRVLLKHDDNPYVIGIDRGERNLLY

IVVVDGKGNIVEQYSLNEIINNFNGIRIKTDYHSLLDKKE

KERFEARQNWTSIENIKELKAGYISQVVHKICELVEKYDA

VIALEDLNSGFKNSRVKVEKQVYQKFEKMLIDKLNYMVDK

KSNPCATGGALKGYQITNKFESFKSMSTQNGFIFYIPAWL

TSKIDPSTGFVNLLKTKYTSIADSKKFISSEDRIMYVPEE

DLFEFALDYKNFSRTDADYIKKWKLYSYGNRIRIFRNPKK

NNVFDWEEVCLTSAYKELFNKYGINYQQGDIRALLCEQSD

KAFYSSFMALMSLMLQMRNSITGRTDVDFLISPVKNSDGI

FYDSRNYEAQENAILPKNADANGAYNIARKVLWAIGQFKK

AEDEKLDKVKIAISNKEWLEYAQTSVKH

The bold/underlined residues are conserved amino acids as compared to each of the Cas12a orthologs of Table S15A as determined by way of a multi-sequence alignment using Clustal Omega multi-sequence alignment tool available online at the European Molecular Biology Laboratory (EMBL). The following amino acids appearing in the canonical LbCas12a amino acid sequence of SEQ ID ON: 1385 are conserved among each of the Table S15A enzymes at corresponding residues as determined by the alignment of FIG. 31 (as shown by an asterisk beneath each conserved residue in the alignment).

The conserved amino acids are:

| | | |
|---|---|---|
| T16 | R747 | K960 |
| P23 | H797 | Q975 |
| T27 | I829 | Q989 |
| D40 | G830 | G991 |
| K51 | D832 | Y995 |
| F144 | R833 | A998 |
| R158 | G834 | T1001 |
| N160 | E835 | D1005 |
| T169 | L838 | P1006 |
| R174 | Y840 | T1008 |
| N179 | L876 | G1009 |
| Q231 | W890 | W1063 |
| I234 | K900 | R1152 |
| N238 | G902 | N1153 |
| L276 | S905 | S1154 |

-continued

| | | |
|---|---|---|
| Q279 | A920 | S1166 |
| Y504 | E925 | P1167 |
| R508 | L927 | D1180 |
| T512 | N928 | G1183 |
| F525 | E939 | A1184 |
| L555 | Y943 | I1187 |
| F702 | E947 | A1188 |
| K707 | L950 | K1190 |
| D708 | K953 | W1218 |
| F745 | L954 | |

In addition, the multiple sequence alignment of FIG. 31 also identifies the above-underlined regions as containing (a) at least one fully conserved residue (as marked with an asterisk "*A") throughout all the aligned sequences, and (b) at least one highly similar conserved residue (as marked with a colon ":") or moderately conserved resided (as marked with a period "."). The wholly conserved residues are identical in all the aligned sequences. The highly similar conserved residues are those where the substitutions among the sequences have strongly similar properties. The moderately conserved residues are those where the substitutions among the sequence have weakly similar properties. The underlined regions are referred to as "highly conserved regions."

| Highly conserved region No. | Sequence (bold residues are conserved residues. Alignment of FIG. 31 shows positions of conserved "*", highly conserved ":", and moderately conserved "." within these sequence regions | SEQ ID NO: |
|---|---|---|
| 1 | YSLSKTLRFKAIPVGKTQENIDNKRLLVEDEKRAEDYKGVK | SEQ ID NO: 1386 |
| 2 | VNSFNGFTTAFTGFFDNRENMFSEEAKSTSIAFRCINENLTRYISN | SEQ ID NO: 1387 |
| 3 | FNFVLTQEGIDVYNA | SEQ ID NO: 1388 |
| 4 | FKPLYKQV | SEQ ID NO: 1389 |
| 5 | YDAIRNYVTQKPYSKDKFKLYFQN | SEQ ID NO: 1390 |
| 6 | YLA | SEQ ID NO: 1391 |
| 7 | LYMFQIYNKD | SEQ ID NO: 1392 |
| 8 | LHTMYFKLLFDENNHGQIRLSGGAELFMR | SEQ ID NO: 1393 |
| 9 | LHIPIAIN | SEQ ID NO: 1394 |
| 10 | IGIDRGERNLLYIVVVDGKGNIVEQYSLNEIINNFNGIRIKTDYHSLL | SEQ ID NO: 1395 |
| 11 | RFEARQNWTSIENIKELKAGYISQVVHKICELVEKYDAVIALEDLN | SEQ ID NO: 1396 |
| 12 | EKQVYQKFEKMLIDKLNYMVDKKSNPCATGGALKGYQIT | SEQ ID NO: 1397 |
| 13 | QNGFIFYIPAWLTSKIDPSTGFVNLLKTKYTSIADSKKFISSFDRI | SEQ ID NO: 1398 |
| 14 | WKL | SEQ ID NO: 1399 |
| 15 | FMALMSLMLQMRNSITGRTDVDFLISPV | SEQ ID NO: 1400 |
| 16 | NADANGAYNIARKV | SEQ ID NO: 1401 |
| 17 | ISNKEWLEY | SEQ ID NO: 1402 |

In certain embodiments, the Cas12a orthologs disclosed herein (e.g., including, but not limited to those sequences of Table S15A) include variants that may have at least 50%, 55%, 60%, 65%, 70%, 75%, 80%, 85%, 90%, 95%, 99%, or up to 100% sequence identity with any reference sequence (e.g., the orthologs of Table S15A) over their full length.

In certain other embodiments, the percent identity variation between reference ortholog (e.g., any ortholog in Table S15A) and a variant of said ortholog is with respect only to the variable regions of the reference protein as determined by an alignment of multiple related sequences (e.g., as shown in the alignment of FIG. 31). The variable regions, for purposes of this application, can be considered to be those regions of the alignment of FIG. 31 that are not identified as a highly conserved region (underlined regions shown above), i.e., the non-underlined regions above.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least one conserved amino acid corresponding to the conserved amino acids identified in the alignment of FIG. 31 (those residues marked with an asterisk "*"), which includes at least one of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least two conserved amino acids corresponding to the conserved amino acids identified in the alignment of FIG. 31 (those residues marked with an asterisk "*"), which includes at least two of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least three conserved amino acids corresponding to the conserved amino acids identified in the alignment of FIG. 31 (those residues marked with an asterisk "*"), which includes at least three of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least four conserved amino acids corresponding to the conserved amino acids identified in the alignment of FIG. 31 (those residues marked with an asterisk "*"), which includes at least four of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least five conserved amino acids corresponding to the conserved amino acids identified in the alignment of FIG. 31 (those residues marked with an asterisk "*"), which includes at least five of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least six conserved amino acids corresponding to the conserved amino acids identified in the alignment of FIG. 31 (those residues marked with an asterisk "*"), which includes at least six of the following conserved amino acids (relative to the amino acid numbering of canonical LbCas12a sequence): T16; P23; T27; D40; K51; F144; R158; N160;

T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least eight conserved amino acids corresponding to the conserved amino acids identified in the alignment of FIG. 31 (those residues marked with an asterisk "*"), which includes at least eight of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least nine conserved amino acids corresponding to the conserved amino acids identified in the alignment of FIG. 31 (those residues marked with an asterisk "*"), which includes at least nine of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least ten conserved amino acids corresponding to the conserved amino acids identified in the alignment of FIG. 31 (those residues marked with an asterisk "*"), which includes at least ten of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least eleven conserved amino acids corresponding to the conserved amino acids identified in the alignment of FIG. 31 (those residues marked with an asterisk "*"), which includes at least eleven of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least twelve conserved amino acids corresponding to the conserved amino acids identified in the alignment of FIG. 31 (those residues marked with an asterisk "*"), which includes at least twelve of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006;

T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least thirteen conserved amino acids corresponding to the conserved amino acids identified in the alignment of FIG. 31 (those residues marked with an asterisk "*"), which includes at least thirteen of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise at least fourteen conserved amino acids corresponding to the conserved amino acids identified in the alignment of FIG. 31 (those residues marked with an asterisk "*"), which includes at least fourteen of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise between 1-10 conserved amino acids corresponding to the conserved amino acids identified in the alignment of FIG. 31 (those residues marked with an asterisk "*"), which includes between 1-10 of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise between 5-15 conserved amino acids corresponding to the conserved amino acids identified in the alignment of FIG. 31 (those residues marked with an asterisk "*"), which includes between 5-15 of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise between 15-25 conserved amino acids corresponding to the conserved amino acids identified in the alignment of FIG. 31 (those residues marked with an asterisk "*"), which includes between 15-25 of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise between 25-35 conserved amino acids corresponding to the conserved amino acids identified in the alignment of FIG. 31 (those residues marked with an asterisk "*"), which includes between 25-35 of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise between 30-60 conserved amino acids corresponding to the conserved amino acids identified in the alignment of FIG. 31 (those residues marked with an asterisk "*"), which includes between 30-60 of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

In still other embodiments, the Cas12a orthologs disclosed herein (e.g., including, but not limited to those sequences of Table S15A) include variants thereof that may have at least 50%, 55%, 60%, 65%, 70%, 75%, 80%, 85%, 90%, 95%, 99%, or up to 100% sequence identity with any reference sequence (e.g., the orthologs of Table S15A) over their full length, but which also must comprise between 40-75 conserved amino acids corresponding to the conserved amino acids identified in the alignment of FIG. 31 (those residues marked with an asterisk "*"), which includes between 40-75 of the following conserved amino acids (relative to the amino acid numbering of canonical LbCas12a sequence): T16; P23; T27; D40; K51; F144; R158; N160; T169; R174; N179; Q231; I234; N238; L276; Q279; Y504; R508; T512; F525; L555; F702; K707; D708; F745; R747; H797; I829; G830; D832; R833; G834; E835; L838; Y840; L876; W890; K900; G902; S905; A920; E925; L927; N928; E939; Y943; E947; L950; K953; L954; K960; Q975; Q989; G991; Y995; A998; T1001; D1005; P1006; T1008; G1009; W1063; R1152; N1153; S1154; S1166; P1167; D1180; G1183; A1184; I1187; A1188; K1190; or W1218.

Numbered Paragraphs

Without limitation, the following numbered paragraphs are contemplated by the instant specification and disclosure.

Paragraph 1. An isolated or recombinant polynucleotide comprising or consisting of a nucleic acid sequence selected from the group consisting of:
 (a) a nucleic acid sequence that encodes a polypeptide having the amino acid sequence of: (Group 1) SEQ ID NO:1-3; (Group 2) SEQ ID NO:20-21; (Group 3) SEQ ID NO:32-33; (Group 4) SEQ ID NO:45-46; (Group 5) SEQ ID NO:57-59; (Group 6) SEQ ID NO:76-79; (Group 7) SEQ ID NO:100-102; (Group 8) SEQ ID NO:118-119; (Group 9) SEQ ID NO:131-170; (Group 10) SEQ ID NO:331-340; (Group 11) SEQ ID NO:368-370; (Group 12) SEQ ID NO:386-387; (Group 13) SEQ ID NO:399-404; and (Group 14) SEQ ID NO:436-456;
 (b) a nucleic acid sequence that encodes a polypeptide at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to: (Group 1) SEQ ID NO:1-3; (Group 2) SEQ ID NO:20-21; (Group 3) SEQ ID NO:32-33; (Group 4) SEQ ID NO:45-46; (Group 5) SEQ ID NO:57-59; (Group 6) SEQ ID NO:76-79; (Group 7) SEQ ID NO:100-102; (Group 8) SEQ ID NO:118-119; (Group 9) SEQ ID NO:131-170; (Group 10) SEQ ID NO:331-340; (Group 11) SEQ ID NO:368-370; (Group 12) SEQ ID NO:386-387; (Group 13) SEQ ID NO:399-404; and (Group 14) SEQ ID NO:436-456;
 (c) a codon optimized nucleotide sequence selected from (Group 1) SEQ ID NO:4; (Group 2) SEQ ID NO:22; (Group 3) SEQ ID NO:34; (Group 4) SEQ ID NO:47; (Group 5) SEQ ID NO:60; (Group 6) SEQ ID NO:80; (Group 7) SEQ ID NO:103-105; (Group 8) SEQ ID NO: 120; (Group 9) SEQ ID NO:171-173, 180, 189, 198, 201, and 208; (Group 10) SEQ ID NO:338; (Group 11) SEQ ID NO:373; (Group 12) SEQ ID NO:388; (Group 13) SEQ ID NO:405-406; and (Group 14) SEQ ID NO:457;
 (d) a nucleic acid sequence at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to a sequence selected from (Group 1) SEQ ID NO:17-19; (Group 2) SEQ ID NO:30; (Group 3) SEQ ID NO:43-44; (Group 4) SEQ ID NO:47; (Group 5) SEQ ID NO:73-75; (Group 6) SEQ ID NO:96-99; (Group 7) SEQ ID NO:103-105; (Group 8) SEQ ID NO:129-130; (Group 9) SEQ ID NO:171-173, 180, 189, 198, 201, and 208; (Group 10) SEQ ID NO:362, 364-367; (Group 11) SEQ ID NO:373; (Group 12) SEQ ID NO:397-398; (Group 13) SEQ ID NO:430-435; and (Group 14) SEQ ID NO:482, 484-485, 487-490, and 492;
 (e) a nucleic acid sequence encoding a polypeptide having a consensus amino acid sequence generated from (Group 1) SEQ ID NO:1-3; (Group 2) SEQ ID NO:20-21; (Group 3) SEQ ID NO:32-33; (Group 4) SEQ ID NO:45-46; (Group 5) SEQ ID NO:57-59; (Group 6) SEQ ID NO:76-79; (Group 7) SEQ ID NO:100-102; (Group 8) SEQ ID NO:118-119; (Group 9) SEQ ID NO:131-170; (Group 10) SEQ ID NO:331-340; (Group 11) SEQ ID NO:368-370; (Group 12) SEQ ID NO:386-387; (Group 13) SEQ ID NO:399-404; and (Group 14) SEQ ID Nos:436-456;
 (f) a nucleic acid sequence that is a degenerate variant of the nucleic acid sequence in (a), (b), (c), (d) or (e); and
 (g) a nucleic acid sequence that hybridizes under stringent conditions to the nucleic acid sequence in in (a), (b), (c), (d) or (e).

Paragraph 2. The isolated or recombinant nucleic acid sequence of paragraph 1, wherein the nucleic acid sequence encodes a polypeptide having at least one activity selected from endonuclease activity; endoribonuclease activity, or RNA-guided DNase activity.

Paragraph 3. The isolated or recombinant nucleic acid sequence of Paragraph 1, wherein the nucleic acid sequence comprises
 a. one or more α-helical recognition lobe (REC) and a nuclease lobe (NUC);
 b. a Wedge (WED), α-helical recognition lobe (REC), PAM-interacting (PI), RuvC nuclease, Bridge Helix (BH) and NUC domains; or c. one or more domains selected from RuvC, REC, WED, BH, PI and NUC domains.

Paragraph 4. The isolated or recombinant nucleic acid sequence of Paragraph 1, wherein the nucleic acid sequence encodes a polypeptide that recognizes or binds to a targeted polynucleotide sequence.

Paragraph 5. The isolated or recombinant nucleic acid sequence of Paragraph 1, wherein the nucleic acid sequence encodes a polypeptide that cleaves a targeted polynucleotide sequence.

Paragraph 6. The isolated or recombinant nucleic acid sequence of Paragraph 1, wherein the nucleic acid sequence encodes a polypeptide that recognizes or binds crRNAs.

Paragraph 7. The isolated or recombinant nucleic acid sequence of Paragraph 6, wherein the crRNA is:
  a. derived from one or more direct repeat sequences, or a reverse complement selected from: (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO:122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541;
  b. the direct repeat sequences of a. with 20 to 35 nucleotides, 12 to 40 nucleotides, or up to the length of the crRNA from the 3' end of the direct repeat, wherein the direct repeat sequences are linked to a targeting guide linked to the 3' end of the direct repeat sequence that is of 16-30 nucleotides in length; or
  c. (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563.

Paragraph 8. The isolated or recombinant nucleic acid sequence of Paragraph 1, wherein the nucleic acid sequence encodes a polypeptide that modifies one or more genomes.

Paragraph 9. The isolated or recombinant nucleic acid sequence of Paragraph 8, wherein the modification comprises genome editing.

Paragraph 10. The isolated or recombinant nucleic acid sequence of Paragraph 1, wherein the polypeptide comprises one or more mutations.

Paragraph 11. The isolated or recombinant nucleic acid sequence of Paragraph 10, wherein the mutation is selected from one or more RuvC, REC, WED, BH, PI and NUC domains.

Paragraph 12. The isolated or recombinant nucleic acid sequence of Paragraph 1, 10 or 11, wherein the nucleic acid sequence encodes a polypeptide comprising a nickase activity.

Paragraph 13. The isolated or recombinant nucleic acid sequence of Paragraph 1, 10 or 11, wherein the nucleic acid sequence encodes a nuclease-deficient polypeptide.

Paragraph 14. The isolated or recombinant nucleic acid sequence of Paragraph 12 or 13, wherein the nucleic acid sequence is operably fused to a nucleic acid encoding one or more deaminases.

Paragraph 15. The isolated or recombinant nucleic acid sequence of Paragraph 14, wherein the one or more deaminases is selected from adenine deaminase or cytosine deaminase.

Paragraph 16. The isolated or recombinant nucleic acid sequence of Paragraph 15, wherein the deaminases modify a targeted polynucleotide sequence.

Paragraph 17. The isolated or recombinant nucleic acid sequence of Paragraph 16, wherein the modification comprises base editing.

Paragraph 18. The isolated or recombinant nucleic acid sequence of Paragraph 12 or 13, wherein
  a. the nucleic acid sequence encoding the polypeptide comprising a nickase activity; or
  b. the nucleic acid sequence encoding a nuclease-deficient polypeptide, is operably fused to a nucleic acid sequence encoding one or more reverse transcriptases.

Paragraph 19. The isolated or recombinant nucleic acid sequence of Paragraph 12 or 13, wherein
  a. the nucleic acid sequence encoding the polypeptide comprising a nickase activity; or
  b. the nucleic acid sequence encoding a nuclease-deficient polypeptide, is not operably fused to a nucleic acid sequence encoding one or more reverse transcriptases.

Paragraph 20. The isolated or recombinant nucleic acid sequence of Paragraph 18 or 19, further comprising a prime editing guide RNA (pegRNA).

Paragraph 21. The isolated or recombinant nucleic acid sequence of Paragraph 20, wherein the pegRNA hybridizes to a targeted polynucleotide sequence and acts as a primer to the one or more reverse transcriptases.

Paragraph 22. The isolated or recombinant nucleic acid sequence of Paragraph 20, wherein the pegRNA binds to a nicked strand for initiation of repair through one or more reverse transcriptases.

Paragraph 23. The isolated or recombinant nucleic acid sequence of Paragraph 1, further comprising a donor polynucleotide.

Paragraph 24. The isolated or recombinant nucleic acid sequence of Paragraph 1, wherein the nucleic acid sequence is operably linked to a nucleic acid sequence encoding one or more nuclear localization signals.

Paragraph 25. The isolated or recombinant nucleic acid sequence of Paragraph 1, wherein the nucleic acid sequence is operably linked to one or more expression control sequences.

Paragraph 26. The isolated or recombinant nucleic acid sequence of Paragraph 1, wherein the expression control sequences comprise one or more transcriptional activators or repressors.

Paragraph 27. The isolated or recombinant nucleic acid sequence of any one of the above Paragraphs wherein the polypeptide comprises improved genome editing characteristics selected from efficiency, specificity, precision, intended edits:unintended edits, indels relative to Cas9.

Paragraph 28. A vector comprising the isolated or recombinant nucleic acid sequence of any one of Paragraphs 1-27.

Paragraph 29. The vector of Paragraph 28, wherein the vector is selected from viral vectors comprising a retroviral vector, a lentiviral vector, an adenoviral, an adeno-associated viral vector, vaccinia viral vector, poxviral vector, and herpes simplex viral vector Paragraph 30. The vector of Paragraph 28, wherein the vector is selected from a non-viral vectors comprising liposomes, lipid nanoparticles (LNPs), cationic polymers, vesicles, and gold nanoparticles.

Paragraph 31. A host cell comprising the isolated or recombinant nucleic acid sequence of Paragraph 28.

Paragraph 32. The host cell of Paragraph 31, wherein the host cell is selected from one or more prokaryotic cells, mammalian cells, human cells or synthetic cells.

Paragraph 33. The host cell of Paragraph 31, wherein the host cell produces a site-specific modification of a targeted nucleic acid sequence of a host cell genome.

Paragraph 34. A polypeptide encoded by the isolated or recombinant nucleic acid sequence of any one of Paragraphs 1-34.

Paragraph 35. A fusion protein comprising an isolated polypeptide encoded by an isolated or recombinant nucleic acid sequence of Paragraph 1 fused to a heterologous amino acid sequence.

Paragraph 36. The fusion protein of Paragraph 35 wherein the fusion protein comprises a nuclease-deficient polypeptide.

Paragraph 37. An isolated or recombinant guide RNA comprising or consisting of a nucleic acid sequence selected from the group consisting of:
  (a) one or more crRNA direct repeat sequences or a reverse complement selected from: (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO:122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541;
  (b) the direct repeat sequences of (a) with 20 to 35 nucleotides, 12 to 40 nucleotides, or up to the length of the crRNA from the 3' end of the direct repeat, wherein the direct repeat sequences are linked to a targeting guide linked to the 3' end of the direct repeat sequence that is of 16-30 nucleotides in length;
  (c) (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563
  (d) a nucleic acid sequence that is a degenerate variant of: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563
  (e) a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 90%, at least 95%, at least 98%, at least 99% or at least 99.9% identical to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563; and
  (f) a nucleic acid sequence that hybridizes under stringent conditions to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563.

Paragraph 38. A guide RNA comprising the crRNA of Paragraph 37.

Paragraph 39. The guide RNA of Paragraph 38 wherein the crRNA hybridizes to the targeted polynucleotide sequence.

Paragraph 40. A genome editing system comprising:
  a. one or more polypeptide sequences comprising at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of sequences selected from SEQ ID NOs: 1-3; SEQ ID NO: 16; and
  b. one or more polynucleotide sequences comprising a guide RNA, wherein the guide RNA comprises a complementary sequence to that of a targeted polynucleotide sequence.

Paragraph 41. The genome editing system of Paragraph 40, wherein the one or more polypeptide sequences comprise nuclease activity, endonuclease activity, endoribonuclease activity and/or RNA-guided DNase activity.

Paragraph 42. The genome editing system of Paragraph 40, wherein the guide RNA hybridizes to the targeted polynucleotide sequence.

Paragraph 43. The genome editing system of Paragraph 40, wherein the guide RNA comprises 12-40 nucleotides.

Paragraph 44. The genome editing system of Paragraph 40, wherein the targeted polynucleotide sequence comprises one or more protospacer adjacent motif (PAM) recognition domains selected from 5'-TTTN-3', 5'-TTN-3', 5'-TNN-3', 5'-TTV-3', or 5'-TTTV-3', wherein N=A, T, C or G and V=A, C or G.

Paragraph 45. The genome editing system of Paragraph 40, wherein the targeted polynucleotide sequence comprises one or more relaxed PAM recognition domains.

Paragraph 46. The genome editing system of Paragraph 40, wherein the one or more polypeptide sequences and the one or more polynucleotide sequences comprising a guide RNA form a ribonucleoprotein complex.

Paragraph 47. The genome editing system of Paragraph 40, wherein the one or more polypeptide sequences comprise
  a. one or more α-helical recognition lobe (REC) and a nuclease lobe (NUC);
  b. a Wedge (WED), α-helical recognition lobe (REC), PAM-interacting (PI), RuvC nuclease, Bridge Helix (BH) and NUC domains; or
  c. one or more domains selected from RuvC, REC, WED, BH, PI and NUC domains.

Paragraph 48. The genome editing system of Paragraph 47, wherein the REC lobe comprises REC1 and REC2 domains.

Paragraph 49. The genome editing system of Paragraph 47, wherein the NUC lobe comprises the RuvC, PI, WED, and Bridge Helix (BH) domains.

Paragraph 50. The genome editing system of Paragraph 47, wherein the one or more polypeptide sequences lack a HNH endonuclease domain.

Paragraph 51. The genome editing system of Paragraph 40, wherein the system is characterized as a Class 2, Type V Cas endonuclease.

Paragraph 52. The genome editing system of Paragraph 40, wherein the guide RNA comprises
- (a) one or more crRNA direct repeat sequences or a reverse complement selected from: (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO:122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541;
- (b) the direct repeat sequences of (a) with 20 to 35 nucleotides, 12 to 40 nucleotides, or up to the length of the crRNA from the 3' end of the direct repeat, wherein the direct repeat sequences are linked to a targeting guide linked to the 3' end of the direct repeat sequence that is of 16-30 nucleotides in length;
- (c) (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563;
- (d) a nucleic acid sequence that is a degenerate variant of: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563;
- (e) a nucleic acid sequence at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 90%, at least 95%, at least 98%, at least 99% or at least 99.9% identical to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563; and
- (f) a nucleic acid sequence that hybridizes under stringent conditions to: (Group 1) SEQ ID NO:13-15; (Group 2) SEQ ID NO:28-29; (Group 3) SEQ ID NO:40-41; (Group 4) SEQ ID NO:53-54; (Group 5) SEQ ID NO:69-71; (Group 6) SEQ ID NO:92-95; (Group 7) SEQ ID NO:112-114; (Group 8) SEQ ID NO:126-127; (Group 9) SEQ ID NO:291-330; (Group 10) SEQ ID NO:355-360; (Group 11) SEQ ID NO:380-382; (Group 12) SEQ ID NO:394-395; (Group 13) SEQ ID NO:423-428; and (Group 14) SEQ ID NO:542-563.

Paragraph 53. The genome editing system of Paragraph 52, wherein the crRNA comprises about 15-40 nucleotides or direct repeat sequences comprising about 20-30 nucleotides.

Paragraph 54. The genome editing system of Paragraph 52, wherein the direct repeat is selected from: (Group 1) SEQ ID NO:7-12; (Group 2) SEQ ID NO:24-27; (Group 3) SEQ ID NO:36-39; (Group 4) SEQ ID NO:49-52; (Group 5) SEQ ID NO:63-68; (Group 6) SEQ ID NO:84-91; (Group 7) SEQ ID NO:106-111; (Group 8) SEQ ID NO:122-125; (Group 9) SEQ ID Nos:211-290; (Group 10) SEQ ID NO:343-354; (Group 11) SEQ ID NO:374-379; (Group 12) SEQ ID NO:390-393; (Group 13) SEQ ID NO:411-422; and (Group 14) SEQ ID NO:500-541.

Paragraph 55. The genome editing system of Paragraph 52, wherein the crRNA comprises a guide segment of 16-26 nucleotides or 20-24 nucleotides.

Paragraph 56. The genome editing system of Paragraph 52 wherein the crRNA hybridizes to the targeted polynucleotide sequence.

Paragraph 57. The genome editing system of Paragraph 40, wherein the guide RNA comprises one or more chemical modifications selected from 2'-O-Me, 2'-F, and 2'F-ANA at 2'OH; 2'F-4'-Cα-OMe and 2',4'-di-Cα-OMe at 2' and 4' carbons; phosphodiester modifications comprising sulfide-based Phosphorothioate (PS) or acetate-based phosphonoacetate alterations; combinations of the ribose and phosphodiester modifications; locked nucleic acid (LNA), bridged nucleic acids (BNA), S-constrained ethyl (cEt), and unlocked nucleic acid (UNA); modifications to produce a phosphodiester bond between the 2' and 5' carbons (2',5'-RNA) of adjacent RNAs; and a butane 4-carbon chain link between adjacent RNAs.

Paragraph 58. The genome editing system of any one of Paragraphs 40-57 comprising one or more viral vectors selected from a retroviral vector, a lentiviral vector, an adenoviral, an adeno-associated viral vector, vaccinia viral vector, poxviral vector, and herpes simplex viral vector.

Paragraph 59. The genome editing system of any one of Paragraphs 40-57 comprising one or more non-viral vectors selected from liposomes, lipid nanoparticles (LNPs), cationic polymers, vesicles, and gold nanoparticles.

Paragraph 60. The genome editing system of any one of Paragraphs 40-59, wherein the guide RNA modifies the targeted polynucleotide sequence of a host cell genome.

Paragraph 61. The genome editing system of Paragraph 60, wherein the targeted polynucleotide sequence is modified by an insertion, deletion or alteration of one or more base pairs at the targeted polynucleotide sequence in the host cell genome.

Paragraph 62. The genome editing system of Paragraph 40, wherein the system further comprises one or more donor nucleic acid sequences wherein the donor nucleic acid sequence comprises: one or more desired modification sequence flanked by two sequences homologous to one or more targeted polynucleotide sequence of a host cell genome, wherein the system recognizes and/or cleaves the targeted polynucleotide sequence of the host cell genome.

Paragraph 63. The genome editing system of Paragraph 62, wherein the donor nucleic acid sequence repairs the targeted polynucleotide sequence of the host cell genome cleaved by polypeptide.

Paragraph 64. The genome editing system of any one of Paragraphs 40-62, wherein the one or more polypeptide sequences comprise about 900, about 1000, about 1100, about 1200, about 1300, about 1400 or about 1500 amino acid residues.

Paragraph 65. The genome editing system of any one of Paragraphs 40-64, wherein the system is characterized in enhanced efficiency and precision of site-directed integration.

Paragraph 66. The genome editing system of Paragraph 65, wherein the efficiency and precision of site-directed integration is enhanced by staggered overhangs on the donor nucleic acid sequence.

Paragraph 67. The genome editing system of Paragraph 40, wherein the polypeptide sequences comprise at least one activity selected from endonuclease activity; endoribonuclease activity, or RNA-guided DNase activity.

Paragraph 68. The genome editing system of Paragraph 40, wherein the system is characterized in exhibiting reduced off-target effects relative to Cas9.

Paragraph 69. The genome editing system of Paragraph 40, wherein the targeted polynucleotide sequence and/or a non-target DNA strand is cleaved is cleaved by the RuvC domain of the polypeptide.

Paragraph 70. The genome editing system of Paragraph 40, wherein the system comprises multiple copies of guide RNA expressed in a host cell.

Paragraph 71. The genome editing system of Paragraph 40, wherein the polypeptide comprises one or more mutations.

Paragraph 72. The genome editing system of Paragraph 71, wherein the mutation is selected from one or more domains selected from RuvC, REC, WED, BH, PI and NUC domains.

Paragraph 73. The genome editing system of Paragraph 71, wherein the mutation in the nucleic acid sequence encodes a nuclease-deficient polypeptide.

Paragraph 74. The genome editing system of Paragraph 71, comprising a fusion of one or more deaminases to the nuclease deficient polypeptide.

Paragraph 75. The genome editing system of Paragraph 74, wherein the one or more deaminases is selected from adenine deaminase or cytosine deaminase.

Paragraph 76. The genome editing system of Paragraph 74, wherein the fusion enables base editing on DNA and/or RNA.

Paragraph 77. The genome editing system of Paragraph 76, wherein system modifies one or more nucleobase on DNA and RNA.

Paragraph 78. The genome editing system of Paragraph 40, wherein the system enables multiplexed gene editing.

Paragraph 79. The genome editing system of Paragraph 40, wherein the polynucleotide sequences comprise a single CRISPR RNA (crRNA).

Paragraph 80. The genome editing system of Paragraph 40, wherein the system enables targeting multiple genes simultaneously.

Paragraph 81. The genome editing system of Paragraph 40, wherein the polypeptide is operably linked to a nuclear localization signal (NLS).

Paragraph 82. The genome editing system of Paragraph 81, wherein the polypeptide linked NLS further comprises crRNA to form a ribonucleoprotein complex.

Paragraph 83. The genome editing system of Paragraph 40 wherein the one or more polypeptide sequences comprises a modification.

Paragraph 84. The genome editing system of Paragraph 83 wherein the modification comprises a nuclease-deficient polypeptide (dCas).

Paragraph 85. The genome editing system of Paragraph 40 wherein the guide RNA comprises a prime editing guide RNA (pegRNA).

Paragraph 86. The genome editing system of Paragraph 85, wherein the pegRNA hybridizes to the targeted polynucleotide sequence and acts as a primer to the one or more reverse transcriptases.

Paragraph 87. The genome editing system of Paragraph 85, wherein the pegRNA binds a nicked strand for initiation of repair through one or more reverse transcriptases.

Paragraph 88. The genome editing system of Paragraph 87, wherein the nuclease-deficient polypeptide comprises nickase activity.

Paragraph 89. The genome editing system of Paragraph 84, comprising a fusion of one or more reverse transcriptases to the nuclease deficient Cas (dCas).

Paragraph 90. The genome editing system of Paragraph 89, wherein the fusion of one or more reverse transcriptases is selected from Moloney Murine Leukemia Virus (M-MLV).

Paragraph 91. The genome editing system of Paragraph 84, wherein the polynucleotide sequences comprise a guide RNA or a pegRNA.

Paragraph 92. The genome editing system of Paragraph 91, wherein the pegRNA comprises or consists of an extended single guide RNA containing a primer binding site (PBS) and a reverse transcriptase (RT) template sequence.

Paragraph 93. The genome editing system of any one of Paragraphs 40-92, wherein the system comprises improved genome editing characteristics selected from efficiency, specificity, precision, intended edits:unintended edits, indels relative to Cas9.

Paragraph 94. The genome editing system of Paragraph 40 wherein the system is characterized in exhibiting reduced off-target effects in host cells when compared to the equivalent Cas9 endonuclease in host cells relative to SpCas9.

Paragraph 95. The genome editing system of Paragraph 40 wherein the targeted polynucleotide sequence is contacted by
  (a) a polypeptide having at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of the sequences of (Group 1) SEQ ID NO:1-3; (Group 2) SEQ ID NO:20-21; (Group 3) SEQ ID NO:32-33; (Group 4) SEQ ID NO:45-46; (Group 5) SEQ ID NO:57-59; (Group 6) SEQ ID NO:76-79; (Group 7) SEQ ID NO:100-102; (Group 8) SEQ ID NO:118-119; (Group 9) SEQ ID NO:131-170; (Group 10) SEQ ID NO:331-340; (Group 11) SEQ ID NO:368-370; (Group 12) SEQ ID NO:386-387; (Group 13) SEQ ID NO:399-404; and (Group 14) SEQ ID NO:436-456; and
  (b) a guide RNA, wherein the guide RNA optionally forms a ribonucleoprotein complex with the polypeptide and the guide RNA.

Paragraph 96. A vector comprising the isolated or recombinant nucleic acid sequence of any one of Paragraphs 1-95.

Paragraph 97. The vector of Paragraph 96, wherein the vector is selected from viral vectors comprising a retroviral vector, a lentiviral vector, an adenoviral, an adeno-associated viral vector, vaccinia viral vector, poxviral vector, and herpes simplex viral vector.

Paragraph 98. The vector of Paragraph 96, wherein the vector is selected from a non-viral vectors comprising liposomes, lipid nanoparticles (LNPs), cationic polymers, vesicles, and gold nanoparticles.

Paragraph 99. A host cell comprising the isolated or recombinant nucleic acid sequence of Paragraph 1 or 37.

Paragraph 100. The host cell of Paragraph 99, wherein the host cell is selected from one or more prokaryotic cells, mammalian cells, human cells or synthetic cells.

Paragraph 101. The host cell of Paragraph 99, wherein the host cell produces a site-specific modification of a targeted polynucleotide sequence of a host cell genome.

Paragraph 102. The host cell of Paragraph 99, wherein the host cell is modified to comprise lower off-target effects relative to SpCas9.

Paragraph 103. A polypeptide encoded by the isolated or recombinant nucleic acid sequence of any one of preceding Paragraphs.

Paragraph 104. A fusion protein comprising an isolated polypeptide encoded by an isolated or recombinant nucleic acid sequence of Paragraph 1 fused to a heterologous amino acid sequence.

Paragraph 105. The fusion protein of Paragraph 104, wherein the fusion protein comprises a nuclease-deficient polypeptide.

Paragraph 106. A method of modifying a targeted polynucleotide sequence, said method comprising:
 (a) one or more polypeptide sequences comprising at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of sequences in (Group 1) SEQ ID NO:1-3; (Group 2) SEQ ID NO:20-21; (Group 3) SEQ ID NO:32-33; (Group 4) SEQ ID NO:45-46; (Group 5) SEQ ID NO:57-59; (Group 6) SEQ ID NO:76-79; (Group 7) SEQ ID NO:100-102; (Group 8) SEQ ID NO:118-119; (Group 9) SEQ ID NO:131-170; (Group 10) SEQ ID NO:331-340; (Group 11) SEQ ID NO:368-370; (Group 12) SEQ ID NO:386-387; (Group 13) SEQ ID NO:399-404; and (Group 14) SEQ ID NO:436-456;
 (b) one or more polynucleotide sequences comprising a guide RNA, wherein the guide RNA comprises a complementary sequence to that of a targeted polynucleotide sequence; and
 (c) introducing into a host cell the one or more polypeptide sequences of (a) and the one or more polynucleotide sequences of (b) in a delivery vector; wherein the polypeptide sequence is configured to form a ribonucleoprotein complex with the guide RNA, and wherein the ribonucleoprotein complex modifies targeted polynucleotide sequence.

Paragraph 107. The method of Paragraph 106, wherein the delivery vector is selected from viral vector is selected from a retroviral vector, a lentiviral vector, an adenoviral, an adeno-associated viral vector, vaccinia viral vector, poxviral vector, and herpes simplex viral vector.

Paragraph 108. The method of Paragraph 106, wherein the delivery vector comprises a non-viral vectors selected from cationic liposomes, lipid nanoparticles (LNPs), cationic polymers, vesicles, and gold nanoparticles.

Paragraph 109. A method of modifying a gene of interest comprising: culturing a host cell engineered to modify a targeted polynucleotide sequence, wherein the host cell comprises the isolated or recombinant polypeptide and the polynucleotide sequence of Paragraph 106.

Paragraph 110. A method for modifying a genome of a host cell comprising: contacting the host cell with the isolated or recombinant polypeptide sequence selected from (Group 1) SEQ ID NO:1-3; (Group 2) SEQ ID NO:20-21; (Group 3) SEQ ID NO:32-33; (Group 4) SEQ ID NO:45-46; (Group 5) SEQ ID NO:57-59; (Group 6) SEQ ID NO:76-79; (Group 7) SEQ ID NO:100-102; (Group 8) SEQ ID NO:118-119; (Group 9) SEQ ID NO: 131-170; (Group 10) SEQ ID NO:331-340; (Group 11) SEQ ID NO:368-370; (Group 12) SEQ ID NO:386-387; (Group 13) SEQ ID NO:399-404; and (Group 14) SEQ ID NO:436-456 and one or more guide RNA of Paragraph 37.

Paragraph 111. The method of Paragraph 110, wherein the genome editing system comprises enhanced transduction efficiency and/or low cytotoxicity.

Paragraph 112. The method of Paragraph 110, wherein the method comprises a high-throughput editing of the target region of the host cell genome.

Paragraph 113. The method of Paragraph 110, wherein the polypeptide displays about 50-fold higher affinity to crRNA in the presence of one or more divalent cations selected from $Mg^{2+}$, $Mn^{2+}$ or $Ca^{2+}$.

Paragraph 114. A pharmaceutical composition comprising:
 a) a lipid nanoparticle (LNP); and
 b) a biopolymer construct of any of the preceding Paragraphs.

Paragraph 115. The pharmaceutical composition of Paragraph 114, wherein the LNP encapsulates one or more elements of a biopolymer construct.

Paragraph 116. The pharmaceutical composition of any one of Paragraphs 114-115, wherein the lipid nanoparticle comprises:
 a) one or more ionizable lipids;
 b) one or more structural lipids;
 c) one or more PEGylated lipids; and
 d) one or more phospholipids.

Paragraph 117. The pharmaceutical composition of Paragraph 116, wherein the one or more ionizable lipids is selected from the group consisting of those disclosed in Table X.

Paragraph 118. The pharmaceutical composition of any one of Paragraphs 116-117, wherein the one or more structural lipids are selected from the group consisting of cholesterol, fecosterol, beta sitosterol, sitosterol, ergosterol, campesterol, stigmasterol, brassicasterol, tomatidine, tomatine, ursolic acid, alpha-tocopherol, prednisolone, dexamethasone, prednisone, and hydrocortisone.

Paragraph 119. The pharmaceutical composition of any one of Paragraphs 116-118, wherein the one or more PEGylated lipids are selected from the group consisting of PEG-c-DOMG, PEG-DMG, PEG-DLPE, PEG-DMPE, PEG-DPPC, and PEG-DSPE.

Paragraph 120. The pharmaceutical composition of any one of Paragraphs 116-119, wherein the one or more phospholipids are selected from the group consisting of 1,2-distearoyl-sn-glycero-3-phosphocholine (DSPC), 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 1-palmitoyl-2-oleoyl-sn-glycero-3-phosphocho line (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-diphytanoylsn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), and sphingomyelin.

Paragraph 121. The pharmaceutical composition of any one of Paragraphs 116-120, wherein the lipid nanoparticle comprises about 48.5 mol % ionizable lipid, about 10 mol % phospholipid, about 40 mol % structural lipid, and about 1.5 mol % of PEG lipid.

Paragraph 122. The pharmaceutical composition of any one of Paragraphs 116-121, wherein the lipid nanoparticle comprises about 48.5 mol % ionizable lipid, about 10 mol % phospholipid, about 39 mol % structural lipid, and about 2.5 mol % of PEG lipid.

Paragraph 123. The pharmaceutical composition of any one of Paragraphs 116-122 wherein the LNP further comprises a targeting moiety operably connected to the LNP.

Paragraph 124. The pharmaceutical composition of any one of Paragraphs 116-123, wherein the LNP further comprises one or more additional components selected from the group consisting of DDAB, EPC, 14PA, 18BMP, DODAP, DOTAP, and C12-200.

Paragraph 201. An isolated or recombinant polynucleotide comprising a nucleic acid sequence selected from the group consisting of:
(a) a nucleic acid sequence that encodes a polypeptide having the amino acid sequence of SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419);
(b) a nucleic acid sequence that encodes a polypeptide at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419); and
(c) a nucleic acid sequence at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% identical to a sequence selected from SEQ ID NO: 365 (No. ID405), SEQ ID NO: 74 (No. ID414), or SEQ ID NO: 565 (No. ID418), SEQ ID NO: 366 (No. ID406), SEQ ID NO: 331 (No. ID411), SEQ ID NO: 30 (No. ID415), or SEQ ID NO: 445 (No. ID419).

Paragraph 202. The isolated or recombinant nucleic acid sequence of paragraph 201, wherein the nucleic acid sequence encodes a polypeptide having at least one activity selected from endonuclease activity; endoribonuclease activity, or RNA-guided DNase activity.

Paragraph 203. The isolated or recombinant nucleic acid sequence of paragraph 201, wherein the nucleic acid sequence comprises
a. one or more α-helical recognition lobe (REC) and a nuclease lobe (NUC);
b. a Wedge (WED), α-helical recognition lobe (REC), PAM-interacting (PI), RuvC nuclease, Bridge Helix (BH) and NUC domains; or
c. one or more domains selected from RuvC, REC, WED, BH, PI and NUC domains.

Paragraph 204. The isolated or recombinant nucleic acid sequence of paragraph 201, wherein the nucleic acid sequence encodes a polypeptide that recognizes or binds to a targeted polynucleotide sequence.

Paragraph 205. The isolated or recombinant nucleic acid sequence of paragraph 201, wherein the nucleic acid sequence encodes a polypeptide that cleaves a targeted polynucleotide sequence.

Paragraph 206. The isolated or recombinant nucleic acid sequence of paragraph 201, wherein the nucleic acid sequence encodes a polypeptide that recognizes or binds crRNAs.

Paragraph 207. The isolated or recombinant nucleic acid sequence of paragraph 206, wherein the crRNA is any crRNA sequence from Table S15C.

Paragraph 208. The isolated or recombinant nucleic acid sequence of paragraph 201, wherein the nucleic acid sequence encodes a polypeptide that modifies one or more genomes.

Paragraph 209. The isolated or recombinant nucleic acid sequence of paragraph 208, wherein the modification comprises genome editing.

Paragraph 200. The isolated or recombinant nucleic acid sequence of paragraph 201, wherein the polypeptide comprises one or more mutations.

Paragraph 211. The isolated or recombinant nucleic acid sequence of paragraph 210, wherein the mutation is selected from one or more RuvC, REC, WED, BH, PI and NUC domains.

Paragraph 212. The isolated or recombinant nucleic acid sequence of paragraph 201, 210 or 211, wherein the nucleic acid sequence encodes a polypeptide comprising a nickase activity.

Paragraph 213. The isolated or recombinant nucleic acid sequence of paragraph 201, 210 or 211, wherein the nucleic acid sequence encodes a nuclease-deficient polypeptide.

Paragraph 214. The isolated or recombinant nucleic acid sequence of paragraph 212 or 213, wherein the nucleic acid sequence is operably fused to a nucleic acid encoding one or more deaminases.

Paragraph 215. The isolated or recombinant nucleic acid sequence of paragraph 214, wherein the one or more deaminases is selected from adenine deaminase or cytosine deaminase.

Paragraph 216. The isolated or recombinant nucleic acid sequence of paragraph 215, wherein the deaminases modify a targeted polynucleotide sequence.

Paragraph 217. The isolated or recombinant nucleic acid sequence of paragraph 216, wherein the modification comprises base editing.

Paragraph 218. The isolated or recombinant nucleic acid sequence of paragraph 212 or 213, wherein
  a. the nucleic acid sequence encoding the polypeptide comprising a nickase activity; or
  b. the nucleic acid sequence encoding a nuclease-deficient polypeptide, is operably fused to a nucleic acid sequence encoding one or more reverse transcriptases.

Paragraph 219. The isolated or recombinant nucleic acid sequence of paragraph 212 or 213, wherein
  a. the nucleic acid sequence encoding the polypeptide comprising a nickase activity; or
  b. the nucleic acid sequence encoding a nuclease-deficient polypeptide, is not operably fused to a nucleic acid sequence encoding one or more reverse transcriptases.

Paragraph 220. The isolated or recombinant nucleic acid sequence of paragraph 218 or 219, further comprising a prime editing guide RNA (pegRNA).

Paragraph 221. The isolated or recombinant nucleic acid sequence of paragraph 220, wherein the pegRNA hybridizes to a targeted polynucleotide sequence and acts as a primer to the one or more reverse transcriptases.

Paragraph 222. The isolated or recombinant nucleic acid sequence of paragraph 220, wherein the pegRNA binds to a nicked strand for initiation of repair through one or more reverse transcriptases.

Paragraph 223. The isolated or recombinant nucleic acid sequence of paragraph 201, further comprising a donor polynucleotide.

Paragraph 224. The isolated or recombinant nucleic acid sequence of paragraph 201, wherein the nucleic acid sequence is operably linked to a nucleic acid sequence encoding one or more nuclear localization signals.

Paragraph 225. The isolated or recombinant nucleic acid sequence of paragraph 201, wherein the nucleic acid sequence is operably linked to one or more expression control sequences.

Paragraph 226. The isolated or recombinant nucleic acid sequence of paragraph 201, wherein the expression control sequences comprise one or more transcriptional activators or repressors.

Paragraph 227. The isolated or recombinant nucleic acid sequence of any one of the above paragraphs wherein the polypeptide comprises improved genome editing characteristics selected from efficiency, specificity, precision, intended edits:unintended edits, indels relative to Cas9.

Paragraph 228. A vector comprising the isolated or recombinant nucleic acid sequence of any one of paragraphs 201-227.

Paragraph 229. The vector of paragraph 228, wherein the vector is selected from viral vectors comprising a retroviral vector, a lentiviral vector, an adenoviral, an adeno-associated viral vector, vaccinia viral vector, poxviral vector, and herpes simplex viral vector.

Paragraph 230. The vector of paragraph 228, wherein the vector is selected from a non-viral vectors comprising liposomes, lipid nanoparticles (LNPs), cationic polymers, vesicles, and gold nanoparticles.

Paragraph 231. A host cell comprising the isolated or recombinant nucleic acid sequence of paragraph 228.

Paragraph 232. The host cell of paragraph 231, wherein the host cell is selected from one or more prokaryotic cells, mammalian cells, human cells or synthetic cells.

Paragraph 233. The host cell of paragraph 231, wherein the host cell produces a site-specific modification of a targeted nucleic acid sequence of a host cell genome.

Paragraph 234. A polypeptide encoded by the isolated or recombinant nucleic acid sequence of any one of claims 1-34.

Paragraph 235. A fusion protein comprising an isolated polypeptide encoded by an isolated or recombinant nucleic acid sequence of paragraph 201 fused to a heterologous amino acid sequence.

Paragraph 236. The fusion protein of paragraph 235 wherein the fusion protein comprises a nuclease-deficient polypeptide.

Paragraph 237. An isolated or recombinant guide RNA comprising or consisting of a nucleic acid sequence from Table S15C.

Paragraph 238. A guide RNA comprising the crRNA of paragraph 237.

Paragraph 239. The guide RNA of paragraph 238 wherein the crRNA hybridizes to the targeted polynucleotide sequence.

Paragraph 240. A genome editing system comprising:
  a. one or more polypeptide sequences comprising at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of sequences selected from SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), or SEQ ID NO: 445 (No. ID419); and
  b. one or more polynucleotide sequences comprising a guide RNA, wherein the guide RNA comprises a complementary sequence to that of a targeted polynucleotide sequence.

Paragraph 241. The genome editing system of paragraph 240, wherein the one or more polypeptide sequences comprise nuclease activity, endonuclease activity, endoribonuclease activity and/or RNA-guided DNase activity.

Paragraph 242. The genome editing system of paragraph 240, wherein the guide RNA hybridizes to the targeted polynucleotide sequence.

Paragraph 243. The genome editing system of paragraph 240, wherein the guide RNA comprises 12-40 nucleotides.

Paragraph 244. The genome editing system of paragraph 240, wherein the targeted polynucleotide sequence comprises one or more protospacer adjacent motif (PAM) recognition domains selected from 5'-TTTN-3', 5'-TTN-3', 5'-TNN-3', 5'-TTV-3', or 5'-TTTV-3', wherein N=A, T, C or G and V=A, C or G.

Paragraph 245. The genome editing system of paragraph 240, wherein the targeted polynucleotide sequence comprises one or more relaxed PAM recognition domains.

Paragraph 246. The genome editing system of paragraph 240, wherein the one or more polypeptide sequences and the one or more polynucleotide sequences comprising a guide RNA form a ribonucleoprotein complex.

Paragraph 247. The genome editing system of paragraph 240, wherein the one or more polypeptide sequences comprise
  a. one or more α-helical recognition lobe (REC) and a nuclease lobe (NUC);
  b. a Wedge (WED), α-helical recognition lobe (REC), PAM-interacting (PI), RuvC nuclease, Bridge Helix (BH) and NUC domains; or
  c. one or more domains selected from RuvC, REC, WED, BH, PI and NUC domains.

Paragraph 248. The genome editing system of paragraph 247, wherein the REC lobe comprises REC1 and REC2 domains.

Paragraph 249. The genome editing system of paragraph 247, wherein the NUC lobe comprises the RuvC, PI, WED, and Bridge Helix (BH) domains.

Paragraph 250. The genome editing system of paragraph 247, wherein the one or more polypeptide sequences lack a HNH endonuclease domain.

Paragraph 251. The genome editing system of paragraph 240, wherein the system is characterized as a Class 2, Type V Cas endonuclease.

Paragraph 252. The genome editing system of paragraph 207 wherein the crRNA hybridizes to the targeted polynucleotide sequence.

Paragraph 253. The genome editing system of paragraph 240, wherein the guide RNA comprises one or more chemical modifications selected from 2'-O-Me, 2'-F, and 2'F-ANA at 2'OH; 2'F-4'-Cα-OMe and 2',4'-di-Cα-OMe at 2' and 4' carbons; phosphodiester modifications comprising sulfide-based Phosphorothioate (PS) or acetate-based phosphonoacetate alterations; combinations of the ribose and phosphodiester modifications; locked nucleic acid (LNA), bridged nucleic acids (BNA), S-constrained ethyl (cEt), and unlocked nucleic acid (UNA); modifications to produce a phosphodiester bond between the 2' and 5' carbons (2',5'-RNA) of adjacent RNAs; and a butane 4-carbon chain link between adjacent RNAs.

Paragraph 254. The genome editing system of any one of claims 40-53 comprising one or more viral vectors selected from a retroviral vector, a lentiviral vector, an adenoviral, an adeno-associated viral vector, vaccinia viral vector, poxviral vector, and herpes simplex viral vector.

Paragraph 255. The genome editing system of any one of claims 40-53 comprising one or more non-viral vectors selected from liposomes, lipid nanoparticles (LNPs), cationic polymers, vesicles, and gold nanoparticles.

Paragraph 256. The genome editing system of any one of claims 40-55, wherein the guide RNA modifies the targeted polynucleotide sequence of a host cell genome.

Paragraph 257. The genome editing system of paragraph 256, wherein the targeted polynucleotide sequence is modified by an insertion, deletion or alteration of one or more base pairs at the targeted polynucleotide sequence in the host cell genome.

Paragraph 258. The genome editing system of paragraph 240, wherein the system further comprises one or more donor nucleic acid sequences wherein the donor nucleic acid sequence comprises: one or more desired modification sequence flanked by two sequences homologous to one or more targeted polynucleotide sequence of a host cell genome, wherein the system recognizes and/or cleaves the targeted polynucleotide sequence of the host cell genome.

Paragraph 259. The genome editing system of paragraph 258, wherein the donor nucleic acid sequence repairs the targeted polynucleotide sequence of the host cell genome cleaved by polypeptide.

Paragraph 260. The genome editing system of any one of paragraphs 240-259, wherein the one or more polypeptide sequences comprise about 900, about 1000, about 1100, about 1200, about 1300, about 1400 or about 1500 amino acid residues.

Paragraph 261. The genome editing system of any one of paragraphs 240-260, wherein the system is characterized in enhanced efficiency and precision of site-directed integration.

Paragraph 262. The genome editing system of paragraph 261, wherein the efficiency and precision of site-directed integration is enhanced by staggered overhangs on the donor nucleic acid sequence.

Paragraph 263. The genome editing system of paragraph 240, wherein the polypeptide sequences comprise at least one activity selected from endonuclease activity; endoribonuclease activity, or RNA-guided DNase activity.

Paragraph 264. The genome editing system of paragraph 240, wherein the system is characterized in exhibiting reduced off-target effects relative to Cas9.

Paragraph 265. The genome editing system of paragraph 240, wherein the targeted polynucleotide sequence and/or a non-target DNA strand is cleaved is cleaved by the RuvC domain of the polypeptide.

Paragraph 266. The genome editing system of paragraph 240, wherein the system comprises multiple copies of guide RNA expressed in a host cell.

Paragraph 267. The genome editing system of paragraph 240, wherein the polypeptide comprises one or more mutations.

Paragraph 268. The genome editing system of paragraph 267, wherein the mutation is selected from one or more domains selected from RuvC, REC, WED, BH, PI and NUC domains.

Paragraph 269. The genome editing system of paragraph 267, wherein the mutation in the nucleic acid sequence encodes a nuclease-deficient polypeptide.

Paragraph 270. The genome editing system of paragraph 267, comprising a fusion of one or more deaminases to the nuclease deficient polypeptide.

Paragraph 271. The genome editing system of paragraph 267, wherein the one or more deaminases is selected from adenine deaminase or cytosine deaminase.

Paragraph 272. The genome editing system of paragraph 267, wherein the fusion enables base editing on DNA and/or RNA.

Paragraph 273. The genome editing system of paragraph 272, wherein system modifies one or more nucleobase on DNA and RNA.

Paragraph 274. The genome editing system of paragraph 240, wherein the system enables multiplexed gene editing.

Paragraph 275. The genome editing system of paragraph 240, wherein the polynucleotide sequences comprise a single CRISPR RNA (crRNA).

Paragraph 276. The genome editing system of paragraph 240, wherein the system enables targeting multiple genes simultaneously.

Paragraph 277. The genome editing system of paragraph 240, wherein the polypeptide is operably linked to a nuclear localization signal (NLS).

Paragraph 278. The genome editing system of paragraph 277, wherein the polypeptide linked NLS further comprises crRNA to form a ribonucleoprotein complex.

Paragraph 279. The genome editing system of paragraph 240 wherein the one or more polypeptide sequences comprises a modification.

Paragraph 280. The genome editing system of paragraph 279 wherein the modification comprises a nuclease-deficient polypeptide (dCas).

Paragraph 281. The genome editing system of paragraph 240 wherein the guide RNA comprises a prime editing guide RNA (pegRNA).

Paragraph 282. The genome editing system of paragraph 281, wherein the pegRNA hybridizes to the targeted polynucleotide sequence and acts as a primer to the one or more reverse transcriptases.

Paragraph 283. The genome editing system of paragraph 282, wherein the pegRNA binds a nicked strand for initiation of repair through one or more reverse transcriptases.

Paragraph 284. The genome editing system of paragraph 283, wherein the nuclease-deficient polypeptide comprises nickase activity.

Paragraph 285. The genome editing system of paragraph 280, comprising a fusion of one or more reverse transcriptases to the nuclease deficient Cas (dCas).

Paragraph 286. The genome editing system of paragraph 285, wherein the fusion of one or more reverse transcriptases is selected from Moloney Murine Leukemia Virus (M-MLV).

Paragraph 287. The genome editing system of paragraph 281, wherein the polynucleotide sequences comprise a guide RNA or a pegRNA.

Paragraph 288. The genome editing system of paragraph 287, wherein the pegRNA comprises or consists of an extended single guide RNA containing a primer binding site (PBS) and a reverse transcriptase (RT) template sequence.

Paragraph 289. The genome editing system of any one of claims 40-88, wherein the system comprises improved genome editing characteristics selected from efficiency, specificity, precision, intended edits:unintended edits, indels relative to Cas9.

Paragraph 290. The genome editing system of paragraph 240 wherein the system is characterized in exhibiting reduced off-target effects in host cells when compared to the equivalent Cas9 endonuclease in host cells relative to SpCas9.

Paragraph 291. The genome editing system of paragraph 240 wherein the targeted polynucleotide sequence is contacted by
  (a) a polypeptide having at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of the sequences in SEQ ID NOs: 1-3 or SEQ ID NO: 16; and
  (b) a guide RNA, wherein the guide RNA optionally forms a ribonucleoprotein complex with the polypeptide and the guide RNA.

Paragraph 292. A vector comprising the isolated or recombinant nucleic acid sequence of any one of paragraphs 201-291.

Paragraph 293. The vector of paragraph 292, wherein the vector is selected from viral vectors comprising a retroviral vector, a lentiviral vector, an adenoviral, an adeno-associated viral vector, vaccinia viral vector, poxviral vector, and herpes simplex viral vector.

Paragraph 294. The vector of paragraph 292, wherein the vector is selected from a non-viral vectors comprising liposomes, lipid nanoparticles (LNPs), cationic polymers, vesicles, and gold nanoparticles.

Paragraph 295. A host cell comprising the isolated or recombinant nucleic acid sequence of paragraph 201 or 237.

Paragraph 296. The host cell of paragraph 295, wherein the host cell is selected from one or more prokaryotic cells, mammalian cells, human cells or synthetic cells.

Paragraph 297. The host cell of paragraph 295, wherein the host cell produces a site-specific modification of a targeted polynucleotide sequence of a host cell genome.

Paragraph 298. The host cell of paragraph 295, wherein the host cell is modified to comprise lower off-target effects relative to SpCas9.

Paragraph 299. A polypeptide encoded by the isolated or recombinant nucleic acid sequence of any one of preceding claims.

Paragraph 300. A fusion protein comprising an isolated polypeptide encoded by an isolated or recombinant nucleic acid sequence of paragraph 201 fused to a heterologous amino acid sequence.

Paragraph 301. The fusion protein of paragraph 300, wherein the fusion protein comprises a nuclease-deficient polypeptide.

Paragraph 302. A method of modifying a targeted polynucleotide sequence, said method comprising
  a. one or more polypeptide sequences comprising at least 45%, 46%, 47%, 48%, 49%, 50%, 51%, 52%, 53%, 54%, 55%, 56%, 57%, 58%, 59%, 60%, 61%, 62%, 63%, 64%, or 65% sequence identity to any one of sequences in SEQ ID NOs: 1-3 or SEQ ID NO: 16;
  b. one or more polynucleotide sequences comprising a guide RNA, wherein the guide RNA comprises a complementary sequence to that of a targeted polynucleotide sequence; and
  c. introducing into a host cell the one or more polypeptide sequences of (a) and the one or more polynucleotide sequences of (b) in a delivery vector; wherein the polypeptide sequence is configured to form a ribonucleoprotein complex with the guide RNA, and wherein the ribonucleoprotein complex modifies targeted polynucleotide sequence.

Paragraph 303. The method of paragraph 302, wherein the delivery vector is selected from viral vector is selected from a retroviral vector, a lentiviral vector, an adenoviral, an adeno-associated viral vector, vaccinia viral vector, poxviral vector, and herpes simplex viral vector.

Paragraph 304. The method of paragraph 302, wherein the delivery vector comprises a non-viral vectors selected from cationic liposomes, lipid nanoparticles (LNPs), cationic polymers, vesicles, and gold nanoparticles.

Paragraph 305. A method of modifying a gene of interest comprising: culturing a host cell engineered to modify a targeted polynucleotide sequence, wherein the host cell comprises the isolated or recombinant polypeptide and the polynucleotide sequence of paragraph 306.

Paragraph 306. A method for modifying a genome of a host cell comprising: contacting the host cell with the isolated or recombinant polypeptide sequence selected from SEQ ID NO: 334 (No. ID405), SEQ ID NO: 58 (No. ID414), or SEQ ID NO: 564 (No. ID418), SEQ ID NO: 335 (No. ID406), SEQ ID NO: 331 (No. ID411), SEQ ID NO: 20 (No. ID415), and SEQ ID NO: 445 (No. ID419).

Paragraph 307. The method of paragraph 306, wherein the genome editing system comprises enhanced transduction efficiency and/or low cytotoxicity.

Paragraph 308. The method of paragraph 306, wherein the method comprises a high-throughput editing of the target region of the host cell genome.

Paragraph 309. The method of paragraph 306, wherein the polypeptide displays about 50-fold higher affinity to crRNA in the presence of one or more divalent cations selected from $Mg^{2+}$, $Mn^{2+}$ or $Ca^{2+}$.

Paragraph 310. A pharmaceutical composition comprising:
  a) a lipid nanoparticle (LNP); and
  b) a biopolymer construct of any of the preceding claims.

Paragraph 311. The pharmaceutical composition of paragraph 310, wherein the LNP encapsulates one or more elements of a biopolymer construct.

Paragraph 312. The pharmaceutical composition of any one of paragraphs 310-311, wherein the lipid nanoparticle comprises:
a) one or more ionizable lipids;
b) one or more structural lipids;
c) one or more PEGylated lipids; and
d) one or more phospholipids.

Paragraph 313. The pharmaceutical composition of paragraph 312, wherein the one or more ionizable lipids is selected from the group consisting of those disclosed in Table X.

Paragraph 314. The pharmaceutical composition of any one of paragraphs 312-313, wherein the one or more structural lipids are selected from the group consisting of cholesterol, fecosterol, beta sitosterol, sitosterol, ergosterol, campesterol, stigmasterol, brassicasterol, tomatidine, tomatine, ursolic acid, alpha-tocopherol, prednisolone, dexamethasone, prednisone, and hydrocortisone.

Paragraph 315. The pharmaceutical composition of any one of paragraphs 312-314, wherein the one or more PEGylated lipids are selected from the group consisting of PEG-c-DOMG, PEG-DMG, PEG-DLPE, PEG-DMPE, PEG-DPPC, and PEG-DSPE.

Paragraph 316. The pharmaceutical composition of any one of paragraphs 312-315, wherein the one or more phospholipids are selected from the group consisting of 1,2-distearoyl-sn-glycero-3-phosphocholine (DSPC), 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 1-palmitoyl-2-oleoyl-sn-glycero-3-phosphocho line (POPC), 1,2-di-O-octadecenyl-sn-glycero-3-phosphocholine (18:0 Diether PC), 1-oleoyl-2-cholesterylhemisuc cinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-diphytanoylsn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), and sphingomyelin.

Paragraph 317. The pharmaceutical composition of any one of paragraphs 312-316, wherein the lipid nanoparticle comprises about 48.5 mol % ionizable lipid, about 10 mol % phospholipid, about 40 mol % structural lipid, and about 1.5 mol % of PEG lipid.

Paragraph 318. The pharmaceutical composition of any one of paragraphs 312-317, wherein the lipid nanoparticle comprises about 48.5 mol % ionizable lipid, about 10 mol % phospholipid, about 39 mol % structural lipid, and about 2.5 mol % of PEG lipid.

Paragraph 319. The pharmaceutical composition of any one of paragraphs 312-318 wherein the LNP further comprises a targeting moiety operably connected to the LNP.

Paragraph 320. The pharmaceutical composition of any one of paragraphs 312-319, wherein the LNP further comprises one or more additional components selected from the group consisting of DDAB, EPC, 14PA, 18BMP, DODAP,

INCORPORATION BY REFERENCE

All publications, patents, and patent applications mentioned in this specification are herein incorporated by reference to the same extent as if each individual publication, patent, or patent application was specifically and individually indicated to be incorporated by reference. However, the citation of a reference herein should not be construed as an acknowledgement that such reference is prior art to the present disclosure. To the extent that any of the definitions or terms provided in the references incorporated by reference differ from the terms and discussion provided herein, the present terms and definitions control.

EXAMPLES

The following are examples of methods and compositions of the present disclosure. It is understood that various other embodiments may be practiced, given the general description provided herein.

Example 1: Production of Nanoparticle Compositions

A nanoparticle composition may be produced as described in US patent application US20170210697A1, which is incorporated herein by reference in its entirety.

In order to investigate safe and efficacious nanoparticle compositions for use in the delivery of various payloads, including but not limited to mRNA and siRNA therapeutics, a range of formulations are prepared and tested. Specifically, the particular elements and ratios thereof in the lipid component of nanoparticle compositions are optimized.

Nanoparticles can be made with mixing processes such as microfluidics and T-junction mixing of two fluid streams, one of which contains the genome editing system and the other has the lipid components.

Lipid compositions are prepared by combining an ionizable lipid, a phospholipid (such as DOPE or DSPC, obtainable from Avanti Polar Lipids, Alabaster, Ala.), a PEG lipid (such as PEG-DMG, obtainable from Avanti Polar Lipids, Alabaster, Ala.), and a structural lipid (such as cholesterol, obtainable from Sigma-Aldrich, Taufkirchen, Germany, or a cholesterol analog) in ethanol. Lipids are combined to yield desired molar ratios and diluted with water and ethanol.

Nanoparticle compositions may be prepared by combining a lipid solution with a solution including the genome editing system. The lipid solution is rapidly injected using, for example, a NanoAssemblr® microfluidic based system, into the genome editing system solution.

Solutions of the genome editing system in deionized water may be diluted in citrate buffer to form a stock solution.

Nanoparticle compositions can be processed by dialysis to remove ethanol and achieve buffer exchange. Formulations are dialyzed against a buffer such as phosphate buffered saline (PBS), Tris-HCl, or sodium citrate, using, for example, Slide-A-Lyzer cassettes (Thermo Fisher Scientific Inc., Rockford, Ill.). The resulting nanoparticle suspension is filtered through sterile filters (Sarstedt, Numbrecht, Germany) into glass vials and sealed with crimp closures. Alternatively, a Tangential Flow Filtration (TFF) system, such as a Spectrum KrosFlo system, may be used.

The method described above induces nano-precipitation and particle formation. Alternative processes including, but not limited to, T-junction and direct injection, may be used to achieve the same nano-precipitation.

Example 1a: Exemplary Nanoparticle Formulation Procedure

Ionizable lipids, phospholipids, structural lipids (eg. Cholesterol or other sterols), and PEG lipids are dissolved in ethanol. The ionizable lipids mol % can be from 30-70%, phospholipids mol % can be 5-20%, sterols mol % can be 20-60%, and PEG lipid mol % can be 0.1-10%. The lipid solution is mixed with an acidic buffer containing genome editing system on a mixing device, such as a NanoAssemblr® microfluidic systems, to form LNPs. To adjust LNP particle size, the volume ratio of lipid solution to genome editing system solution can be varied from 1:1 to 20:1, genome editing system concentration in aqueous buffer can be 0.01 mg/mL to 10 mg/mL, N/P ratio can be 1 to 50 and different identities of PEG lipids or other polymers can be used. After the LNP is formed from the mixing device, aqueous buffer is added to reduce the ethanol concentration. The volume of aqueous buffer can be 0.1 to 100 volume of LNP volume coming out of the mixing device. The LNPs are further dialyzed against aqueous and concentrated to a desired concentration. The particle size of LNPs is measured by dynamic light scattering (DLS), for example, by using a Zetasizer Ultra (Malvern Panalytical). Payload encapsulation efficiency is determined, for example, by Quant-it™ RiboGreen assay.

Example 2: Characterization of Nanoparticle Compositions

A nanoparticle composition may be characterized as described in US patent application US20170210697A1, which is incorporated herein by reference in its entirety.

Particle size, polydispersity index (PDI), and the zeta potential of a nanoparticle composition can be determined using, for example, a Zetasizer Nano ZS (Malvern Instruments Ltd, Malvern, Worcestershire, UK), or a Wyatt DynaPro plate reader.

Ultraviolet-visible spectroscopy can be used to determine the concentration of the genome editing system in the nanoparticle compositions. The formulation may be diluted in PBS then added to a mixture of methanol and chloroform. After mixing, the absorbance spectrum of the solution is recorded, for example, between 230 nm and 330 nm on a DU 800 spectrophotometer (Beckman Coulter, Beckman Coulter, Inc., Brea, Calif.). The concentration of the genome editing system in the nanoparticle composition can be calculated based on the extinction coefficient of the genome editing system used in the composition and on the difference between the absorbance at a wavelength of, for example, 260 nm and the baseline value at a wavelength of, for example, 330 nm.

For nanoparticle compositions including an RNA, a QUANT-IT™ RIBOGREEN® RNA assay (Invitrogen Corporation Carlsbad, Calif) can be used to evaluate the encapsulation of an RNA by the nanoparticle composition. The samples are diluted in a TE buffer solution. Portions of the diluted samples are transferred to a polystyrene 96 well plate and either TE buffer or a 2% Triton X-100 solution is added to the wells. The plate is incubated at, for example, a temperature of 37° C. for 15 minutes. The RIBOGREEN® reagent is diluted in TE buffer, and this solution is added to each well. The fluorescence intensity can be measured using a fluorescence plate reader (Wallac Victor 1420 Multilabel Counter; Perkin Elmer, Waltham, Mass.) at an excitation wavelength of, for example, about 480 nm and an emission wavelength of, for example, about 520 nm. The fluorescence values of the reagent blank are subtracted from that of each of the samples and the percentage of free RNA is determined by dividing the fluorescence intensity of the intact sample (without addition of Triton X-100) by the fluorescence value of the disrupted sample (caused by the addition of Triton X-100).

Example 3: In Vivo Studies Including Protein Expression by Organ

Delivery to a target organ may be assessed as described in US patent application US20170210697A1, which is incorporated herein by reference in its entirety.

In order to monitor how effectively various nanoparticle compositions deliver polynucleotides to targeted cells, different nanoparticle compositions including a particular polynucleotide are prepared and administered to rodent populations. Mice are intravenously, intramuscularly, intraarterially, or intratumorally administered a single dose of a nanoparticle composition. In some instances, mice may be made to inhale doses. Dose sizes may range from 0.001 mg/kg to 10 mg/kg, where 10 mg/kg describes a dose including 10 mg of polynucleotide in a nanoparticle composition for each 1 kg of body mass of the mouse. A control composition including PBS may also be employed.

Upon administration of nanoparticle compositions to mice, dose delivery profiles, dose responses, and toxicity of particular formulations and doses thereof can be measured by enzyme-linked immunosorbent assays (ELISA), bioluminescent imaging, or other methods. Time courses of protein expression can also be evaluated. Samples collected from the rodents for evaluation may include blood, sera, and tissue (for example, muscle tissue from the site of an intramuscular injection and internal tissue); sample collection may involve sacrifice of the animals.

For example, LNP formulations including RNA encoding a detectable protein such as luciferase may be administered intravenously to mice at a dosage of, for example, 0.5 mg/kg. A standard MC3 formulation and a PBS control may also be tested.

Bioluminescence in various organs, such as the liver, lung, spleen, and femur, may be measured after 6 hours.

Nanoparticle compositions including protein coding RNA are useful in the evaluation of the efficacy and usefulness of various formulations for the delivery of polynucleotides. Higher levels of protein expression induced by administration of a composition including protein coding RNA will be indicative of higher RNA translation and/or nanoparticle composition RNA delivery efficiencies. As the non-RNA components are not thought to affect translational machineries themselves, a higher level of protein expression is likely indicative of a higher efficiency of delivery of the RNA by a given nanoparticle composition relative to other nanoparticle compositions or the absence thereof.

Example 4: Toxicity, Cytokine Induction, and Complement Activation

Toxicity of the LNP compositions of the disclosure may be analyzed as described by international patent application WO2016118724 and/or US20170210697A1, which are incorporated herein by reference in its entirety.

Example 5: Optimization of Particle Sizes

The fenestration sizes for different bodily organs often vary; for example, the kidney is known to have a smaller fenestration size than the liver. Thus, targeting delivery of a genome editing system (e.g., specifically delivering) to a particular organ or group of organs may require the administration of nanoparticle compositions with different particle sizes. In order to investigate this effect, nanoparticle compositions are prepared with a variety of particle sizes using a Nanoassemblr® instrument. Nanoparticle compositions include an RNA encoding Luc. Each differently sized nanoparticle composition is subsequently administered to mice to evaluate the effect of particle size on delivery selectivity. Luc expression in two or more organs or groups of organs can be measured using bioluminescence to evaluate the relative expression in each organ.

A number of parameters can be adjusted in order to optimize the particle size of the nanoparticles. Exemplary parameters include, but are not limited to, the identity of the PEG lipid, mol % of the PEG lipid in the LNP formulation, the identity of the structural lipid, mol % of the structural lipid in the LNP formulation, the identity of the phospholipid, mol % of the phospholipid in the LNP formulation, the identity of the ionizable lipid, mol % of the ionizable lipid in the LNP formulation, identity of lipid components covalently bound to one or more targeting moieties, mol % of said targeting moiety bound lipids in the LNP formulation, flow rate of the Nanoassemblr® instrument in the preparation of the formulation, concentration of the mixing solutions used in the formulation, buffers used in the preparation of the formulation, and duration of formulation mixing.

Example 6: Construction and Testing an Cas12a Nuclease Genome Editor

To generate an Cas12a Nuclease Genome Editor, a human codon optimized Cas12a ORF is amplified from a vendor synthesized plasmid. In addition, the desired nuclear localization signal is encoded on the amplification primers. The amplified fragment containing the NLS and the human codon optimized Cas12a ORF are assembled using Gibson Assembly Master Mix (NEB), into the pCDNA3.1 vector (Thermo Scientific). The cognate crRNA for the indicated Cas12a ortholog is cloned under the control of the U6 promoter using Gibson Assembly Master Mix (NEB), into the pZ147-BvCas12b-sgRNA-scaffold vector (Addgene). The crRNA may be designed such that the guide sequence is replaced to match the desired target sequence with a cognate PAM for the indicated Cas12a ortholog, particularly the human genome in the case that the construct is to be used in a human genome editing experiment. In experiments where the Cas12a is mutated, the desired mutation is created by amplifying the entire plasmid in a single amplicon where the primer encodes the mutation and is cloned using the KLD enzyme mix (NEB). To evaluate the efficacy of the system, 100 ng of each of the Cas12a plasmid and the crRNA plasmid are transfected using Lipo 3000 (Thermo Scientific) into HEK293FT cells into a single well of a 96-well plate. The cells are left to incubate for 72 hours before they are harvested for sequencing. Quick Extract DNA solution is to extract gDNA from cells for subsequent NGS analysis of the targeted loci.

Example 7: Constructing and Testing an Cas12a-Deaminase Fusion

To generate an Cas12a-deaminase fusion construct, both a human codon optimized Cas12a ORF and a desired human codon optimized deaminase are amplified from plasmids with primer overhangs containing the desired linker sequence. In addition, the desired nuclear localization signal is encoded on the amplification primers. Two amplified fragments containing the Cas12a ORF and deaminase are stitched together using Gibson Assembly Master Mix (NEB), into the pCDNA3.1 vector (Thermo Scientific). The cognate crRNA for the indicated Cas12a ortholog is cloned under the control of the U6 promoter using Gibson Assembly Master Mix (NEB), into the pZ147-BvCas12b-sgRNA-scaffold vector (Addgene). The crRNA may be designed such that the guide sequence is replaced to match the desired target sequence with a cognate PAM for the indicated Cas12a ortholog, particularly the human genome in the case that the construct is to be used in a human genome editing experiment. In experiments where the Cas12a is mutated, the desired mutation is created by amplifying the entire plasmid in a single amplicon where the primer encodes the mutation and is cloned using the KLD enzyme mix (NEB). To evaluate the efficacy of the system, 100 ng of each of the Cas12a-deaminase plasmid and the crRNA plasmid are transfected using Lipo 3000 (Thermo Scientific) into HEK293FT cells into a single well of a 96-well plate. The cells are left to incubate for 72 hours before they are harvested for sequencing. Quick Extract DNA solution is used to extract gDNA from cells for subsequent NGS analysis of the targeted loci.

Example 8: Constructing and Testing an Cas12a-RT Fusion

To generate an Cas12a-RT fusion construct, both a human codon optimized Cas12a ORF and a desired human codon optimized RT are amplified from plasmids with primer overhangs containing the desired linker sequence. In addition, the desired nuclear localization signal is encoded on the amplification primers. Two amplified fragments containing the Cas12a ORF and RT are stitched together using Gibson Assembly Master Mix (NEB), into the pCDNA3.1 vector (Thermo Scientific). The cognate extended and engineered crRNA for the indicated Cas12a ortholog is cloned under the control of the U6 promoter using Gibson Assembly Master Mix (NEB), into the pZ147-BvCas12b-sgRNA-scaffold vector (Addgene). The extended crRNA is designed such that the guide sequence is replaced to match the desired target sequence with a cognate TAM for the indicated Cas12a ortholog, particularly the human genome in the case that the construct is to be used in a human genome editing experiment. In addition, a crRNA extension that contains a template for the desired edit, along with a homologous sequence designed to bind to the Cas12a non-target strand are included in the engineered crRNA. In experiments where the Cas12a is mutated, the desired mutation is created by amplifying the entire plasmid in a single amplicon where the primer encodes the mutation and is cloned using the KLD enzyme mix (NEB). In experiments where a second Cas12a ORF is included in the system, it may be expressed from a separate pCDNA3.1 vector. To evaluate the efficacy of the system, 100 ng of each of the Cas12a-RT plasmid and the crRNA plasmid are transfected using Lipo 3000 (Thermo Scientific) into HEK293FT cells into a single well of a 96-well plate. The cells are left to incubate for 72 hours before they are harvested for sequencing. Quick Extract DNA solution is used to extract gDNA from cells for subsequent NGS analysis of the targeted loci.

Example 9: In Vitro Activity Screening and PAM Determination

To detect dsDNA cleavage and characterize the protospacer adjacent motif (PAM) requirement Cas12a orthologs were initially expressed in Human embryonic kidney (HEK) cell line 293T (ATCC-CRL-3216). HEK293T cells were maintained in Dulbecco's modified Eagle's Medium (DMEM) with GlutaMAX (Thermo Fisher Scientific), supplemented with 10% fetal bovine serum (Thermo Fisher Scientific) and 10,000 units/mL penicillin, and 10,000 g/mL streptomycin (Thermo Fisher Scientific) at 37° C. with 5% $CO_2$ incubation.

HEK293T cells were seeded into 24-well plates (VWR) one day prior to transfection at a density of 100,000 cells per well. Cells were transfected using Lipofectamine 3000 (Invitrogen) following the manufacturer's recommended protocol. For each well of a 24-well plate 800 ng of plasmid DNA (pcDNA3.1-Cas12a-EGFP) encoding Cas12a was used. One well per plate was transfected using 800 ng of plasmid DNA (pD608-SpCas9-EGFP) encoding SpCas9 to use as a control.

Cells were incubated at 37° C. for 48 hours post transfection in 5% CO2 before lysis. The cells were washed twice with 900 µl 1×DPBS (Thermo Fisher Scientific) and resuspended in 100 µl 20 mM HEPES, 100 mM KCl, 5 mM $MgCl_2$, 5% glycerol, 0.1% Triton X-100, 1 mM DTT, 1× Halt Protease Inhibitor Cocktail (Thermo Scientific), pH 7.5 lysis buffer. Resuspended cells were incubated on ice for 20 minutes. Cell lysates were further used for activity determination in vitro as described below.

Ribonucleoprotein complexes were assembled using cell lysates and 100 nM or 1000 nM of appropriate crRNA; total reaction volume—10 µL. Reactions were incubated on ice for 15 minutes. 5 µL of RNP complex was used for 7N PAM library cleavage. 0.5 µg of the 7N PAM plasmid library was used, reaction buffer—NEBuffer 2.1 (New England Biolabs), total volume–50 µL. To achieve library cleavage reactions were incubated at 37° C. for 1 hour. Double-stranded break ends were blunted by adding 0.3 µL 10 mM dNTPs and 0.3 µL of T4 DNA polymerase and incubating at 12° C. for 15 minutes and 75° C. for 25 minutes. To add A-overhangs to blunt ends 0.3 µL 10 mM dNTPs and 0.3 µL of DreamTaq DNA polymerase (Thermo Scientific) were added to the reactions and incubated at 68° C. for 30 minutes. RNA removal was performed using 0.5 µL of RNase A (Thermo Scientific), samples incubated at 37° C. for 15 minutes. Cleaved DNA was purified using Monarch PCR & DNA Cleanup Kit (5 µg) (New England Biolabs). 100 ng of double stranded DNA linker was added to each reaction together with 2.5 µL ligation buffer (New England Biolabs) and 1 µL T4 DNA Ligase (New England Biolabs) (final reaction volume—25 µL). Reactions were incubated at 22° C. for 1 hour. 2 µL of each ligation mixture was used as a PCR template. PCR products were visualized by performing gel electrophoresis (1.5% agarose gel).

To determine PAM sequences, next generation sequencing was performed using Illumina MiSeq System. Using ligation mixtures as templates, PCR was performed to enrich for PAM-containing sequences (reaction volume—100 µL). Samples were then purified using Monarch PCR & DNA Cleanup Kit (5 µg) (New England Biolabs). Purified DNA was then used as a template for primary PCR. Primers that extend past the end of library fragments with 'tails' encoding Illumina sequences and sample-specific 6 nt barcodes (IDT, Metabion) were used. Phusion High-Fidelity DNA Polymerase (New England Biolabs) was used for both rounds of PCR and the reactions were set up according to the manufacturer's instructions in a final volume of 50 µl and allowed to proceed for 10 cycles. In the case of primary PCR 20 ng of the purified product from the previous step was used as template and for the secondary PCR 2 µL of the primary PCR reaction was used as template. The primary PCR forward primer contained a sample-specific barcode sequence in addition to the necessary Illumina sequences. The rest of the primers were universal and contained Illumina sequences only (Table Ex.9.1). The following conditions were used for the primary two-step PCR: 95° C. for 30 s, 10 cycles of 95° C. for 10 s and 72° C. for 5 s, and final extension at 72° C. for 5 min. The secondary PCR was performed as follows: 95° C. for 30 s, 10 cycles of 95° C. for 10 s, 58° C. for 15 s and 72° C. for 5 s, and final extension at 72° C. for 5 min. The secondary PCR products were purified using Monarch PCR & DNA Cleanup Kit (New England Biolabs), their concentration and quality assessed using NanoPhotometer® NP80 (IMPLEN) spectrophotometer and Qubit 4 (Thermo Fisher Scientific) fluorometer with the Qubit 1× dsDNA HS Assay kit (Thermo Fisher Scientific). Samples from uncleaved PAM libraries were used as negative control and libraries cleaved with LbaCas12a and SpyCas9 were used as positive control.

TABLE Ex.9.1

Primers used in PAM sample preparation for Illumina sequencing

| Primer NO: | SEQ ID NO: | Primer sequence (5'-3'), molecular barcode sequences underlined | Description |
|---|---|---|---|
| 1 | SEQ ID NO: 608 | CGGCATTCCTGCTGAACCGCTCTTCCGA TCT | Enrichment PCR forward primer |
| 3 | SEQ ID NO: 609 | GCCAGGGTTTTCCCAGTCACGA | Enrichment PCR reverse primer |
| 4 | SEQ ID NO: 610 | GAAATTCTAAACGCTAAAGAGGAAGAG G | Negative control sample enrichment PCR forward primer |
| 5 | SEQ ID NO: 611 | CTACACTCTTTCCCTACACGACGCTCTT CCGATCT<u>AGTCAATA</u>AACGCTAAAGAG GAAGAGG | Negative control primary PCR barcoding primer |

TABLE Ex.9.1-continued

Primers used in PAM sample preparation for Illumina sequencing

| Primer NO: | SEQ ID NO: | Primer sequence (5'-3'), molecular barcode sequences underlined | Description |
|---|---|---|---|
| 6 | SEQ ID NO: 612 | CTACACTCTTTCCCTACACGACGCTCTT CCGATCTATTCCTCGGCATTCCTGCTGA AC | Primary PCR barcoding primer |
| 7 | SEQ ID NO: 613 | CTACACTCTTTCCCTACACGACGCTCTT CCGATCTGCCAATCGGCATTCCTGCTGA AC | Primary PCR barcoding primer |
| 8 | SEQ ID NO: 614 | CTACACTCTTTCCCTACACGACGCTCTT CCGATCTCTTGTACGGCATTCCTGCTGA AC | Primary PCR barcoding primer |
| 9 | SEQ ID NO: 615 | CTACACTCTTTCCCTACACGACGCTCTT CCGATCTTTAGGCCGGCATTCCTGCTGA AC | Primary PCR barcoding primer |
| 10 | SEQ ID NO: 616 | CTACACTCTTTCCCTACACGACGCTCTT CCGATCTTAGCTTCGGCATTCCTGCTGA AC | Primary PCR barcoding primer |
| 11 | SEQ ID NO: 617 | CTACACTCTTTCCCTACACGACGCTCTT CCGATCTAGTTCCCGGCATTCCTGCTGA AC | Primary PCR barcoding primer |
| 12 | SEQ ID NO: 618 | CTACACTCTTTCCCTACACGACGCTCTT CCGATCTATCACGCGGCATTCCTGCTGA AC | Primary PCR barcoding primer |
| 13 | SEQ ID NO: 619 | CTACACTCTTTCCCTACACGACGCTCTT CCGATCTGAGTGGCGGCATTCCTGCTGA AC | Primary PCR barcoding primer |
| 14 | SEQ ID NO: 620 | CTACACTCTTTCCCTACACGACGCTCTT CCGATCTGGCTACCGGCATTCCTGCTGA AC | Primary PCR barcoding primer |
| 15 | SEQ ID NO: 621 | CTACACTCTTTCCCTACACGACGCTCTT CCGATCTACAGTGCGGCATTCCTGCTGA AC | Primary PCR barcoding primer |
| 16 | SEQ ID NO: 622 | CTACACTCTTTCCCTACACGACGCTCTT CCGATCTTGACCACGGCATTCCTGCTGA AC | Primary PCR barcoding primer |
| 17 | SEQ ID NO: 623 | CTACACTCTTTCCCTACACGACGCTCTT CCGATCTCAGATCCGGCATTCCTGCTGA AC | Primary PCR barcoding primer |
| 18 | SEQ ID NO: 624 | CTACACTCTTTCCCTACACGACGCTCTT CCGATCTGATCAGCGGCATTCCTGCTGA AC | Primary PCR barcoding primer |
| 19 | SEQ ID NO: 625 | CTACACTCTTTCCCTACACGACGCTCTT CCGATCTCGATGTCGGCATTCCTGCTGA AC | Primary PCR barcoding primer |
| 20 | SEQ ID NO: 626 | CTACACTCTTTCCCTACACGACGCTCTT CCGATCTCCGTCCCGGCATTCCTGCTGA AC | Primary PCR barcoding primer |
| 21 | SEQ ID NO: 627 | CTACACTCTTTCCCTACACGACGCTCTT CCGATCTGTCCGCCGGCATTCCTGCTGA AC | Primary PCR barcoding primer |
| 22 | SEQ ID NO: 628 | CTACACTCTTTCCCTACACGACGCTCTT CCGATCTACTTGACGGCATTCCTGCTGA AC | Primary PCR barcoding primer |
| 23 | SEQ ID NO: 629 | CTACACTCTTTCCCTACACGACGCTCTT CCGATCTCGTACGCGGCATTCCTGCTGA AC | Primary PCR barcoding primer |

TABLE Ex.9.1-continued

Primers used in PAM sample preparation for Illumina sequencing

| Primer NO: | SEQ ID NO: | Primer sequence (5'-3'), molecular barcode sequences underlined | Description |
|---|---|---|---|
| 24 | SEQ ID NO: 630 | CTACACTCTTTCCCTACACGACGCTCTT CCGATCTATGTCACGGCATTCCTGCTGA AC | Primary PCR barcoding primer |
| 25 | SEQ ID NO: 631 | CTACACTCTTTCCCTACACGACGCTCTT CCGATCTGTGAAACGGCATTCCTGCTGA AC | Primary PCR barcoding primer |
| 26 | SEQ ID NO: 632 | CTACACTCTTTCCCTACACGACGCTCTT CCGATCTGTGGCCCGGCATTCCTGCTGA AC | Primary PCR barcoding primer |
| 27 | SEQ ID NO: 633 | CTACACTCTTTCCCTACACGACGCTCTT CCGATCTGTTTCGCGGCATTCCTGCTGA AC | Primary PCR barcoding primer |
| 28 | SEQ ID NO: 634 | CTACACTCTTTCCCTACACGACGCTCTT CCGATCTACTGATCGGCATTCCTGCTGA AC | Primary PCR barcoding primer |
| 29 | SEQ ID NO: 635 | CTACACTCTTTCCCTACACGACGCTCTT CCGATCTGTAGAGCGGCATTCCTGCTGA AC | Primary PCR barcoding primer |
| 30 | SEQ ID NO: 636 | CAAGCAGAAGACGGCATACGAGCTCTT CCGATCTCGGCGACGTTGGGTC | Primary PCR universal reverse primer |
| 31 | SEQ ID NO: 637 | AATGATACGGCGACCACCGAGATCTAC ACTCTTTCCCTACACG | Secondary PCR universal forward primer |
| 32 | SEQ ID NO: 638 | CAAGCAGAAGACGGCATA | Secondary PCR universal reverse primer |

Sample libraries were normalized and pooled in equimolar ratio for sequencing. The resulting pool was purified and size selection performed using Ampure XP magnetic beads (Beckman Coulter Inc), then quantified via qPCR using NEBNext Library Quant Kit for Illumina (New England Biolabs). Final library pool was diluted and denatured for sequencing on Illumina MiSeq System (Illumina) with a 25% (v/v) spike of PhiX control v3 (Illumina). Single read deep sequencing was performed and the resulting sequences were post-processed and deconvoluted per the manufacturer's instruction.

Figure 15:
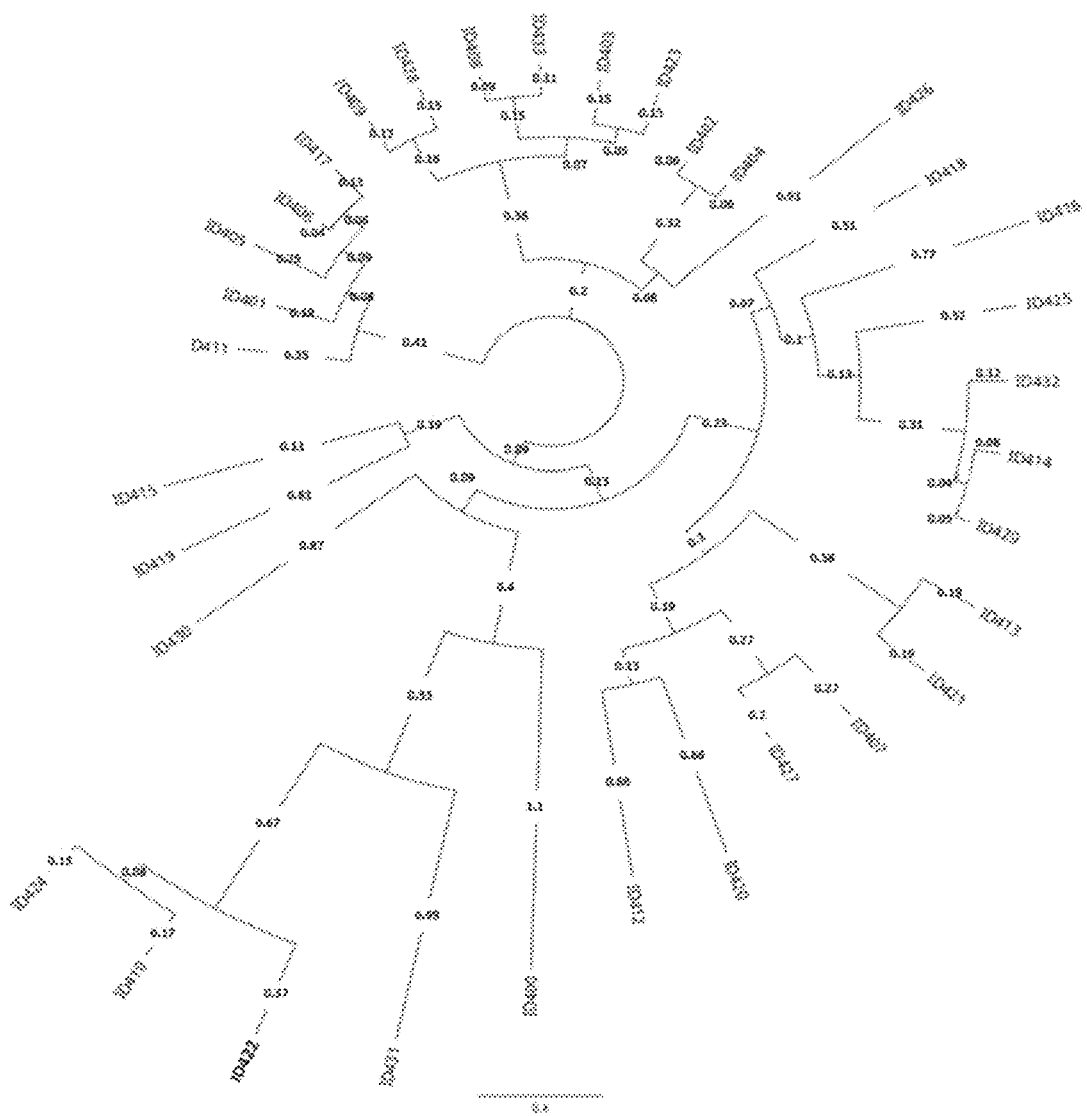
FIG. 15: as described in Example 9, the figure illustrates that determined PAM sequences added at each protein in the phylogenetic tree. Phylogenetic tree generated using Geneious Prime 2022.1.1 implementation of FastTree on Muscle multiple sequence alignment of selected protein sequences. PAM sequence weblogos generated using WebLogo 3 web application from PFMs.
Figure 16:
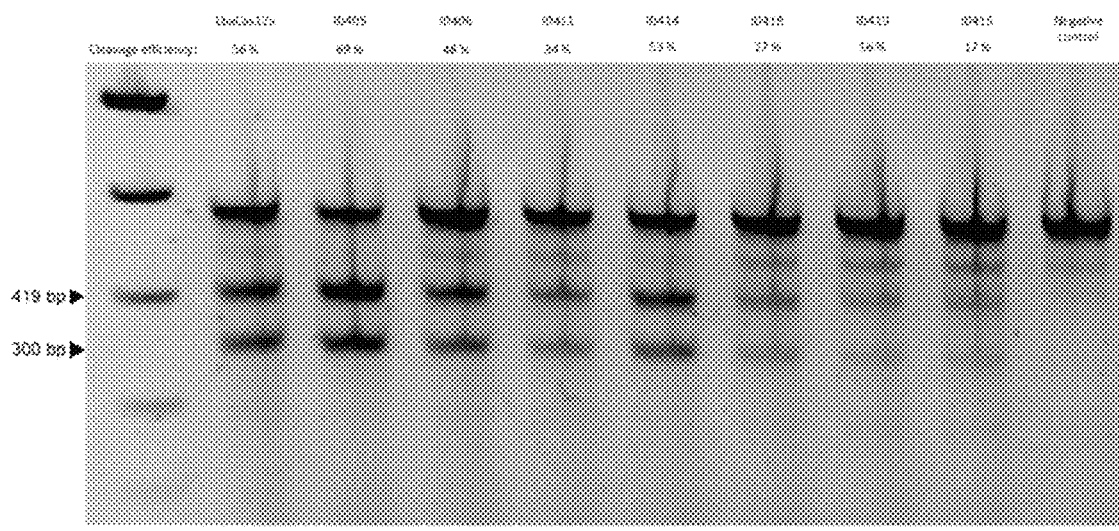
FIG. 16 Cleavage products of genomic target DNMT1 visualized on 2% agarose gel. Editing efficiency values for LbaCas12a and each ortholog were calculated using ImageJ software, in accordance with Example 10.
Figure 17:
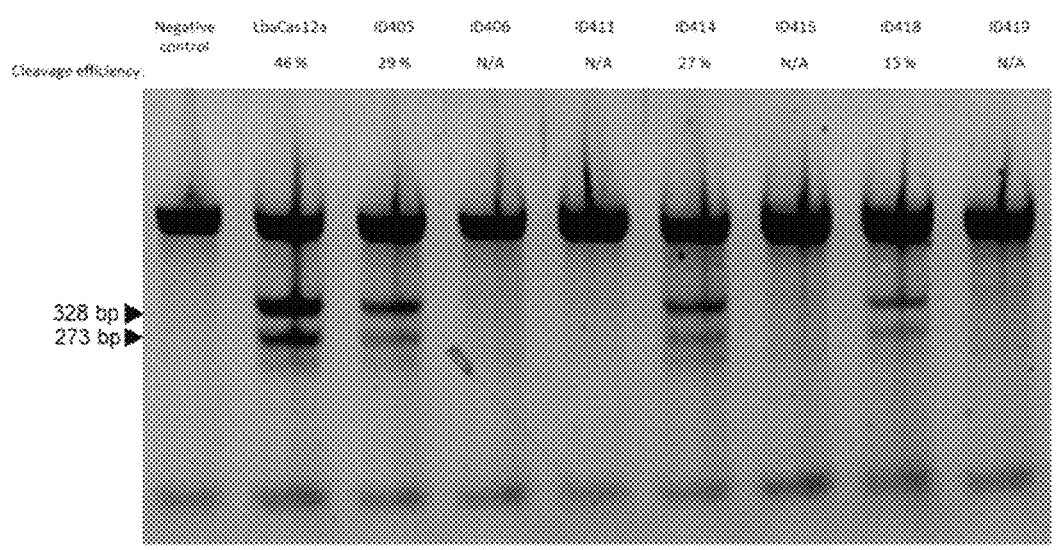
FIG. 17 Cleavage products of genomic target RUNX1 visualized on 2% agarose gel. Editing efficiency values for LbaCas12a and each ortholog were calculated using ImageJ software, in accordance with Example 10.
Figure 18:
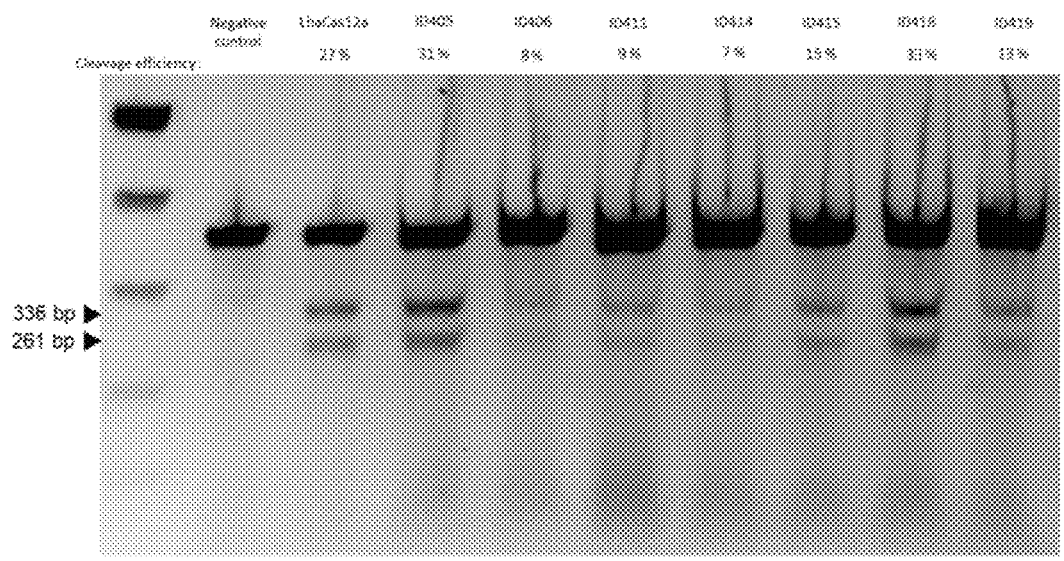
FIG. 18 Cleavage products of genomic target SCNJA visualized on 2% agarose gel. Editing efficiency values for LbaCas12a and each ortholog were calculated using ImageJ software, in accordance with Example 10.
Figure 19:
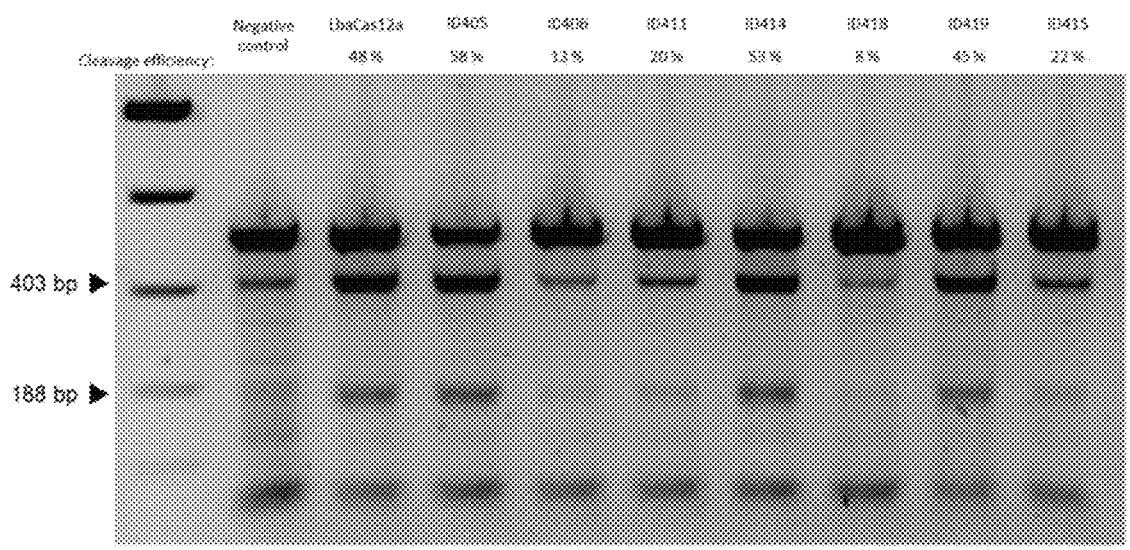
FIG. 19 Cleavage products of genomic target FANCF site 2 visualized on 2% agarose gel. Editing efficiency values for LbaCas12a and each ortholog were calculated using ImageJ software, in accordance with Example 10.
Figure 20:
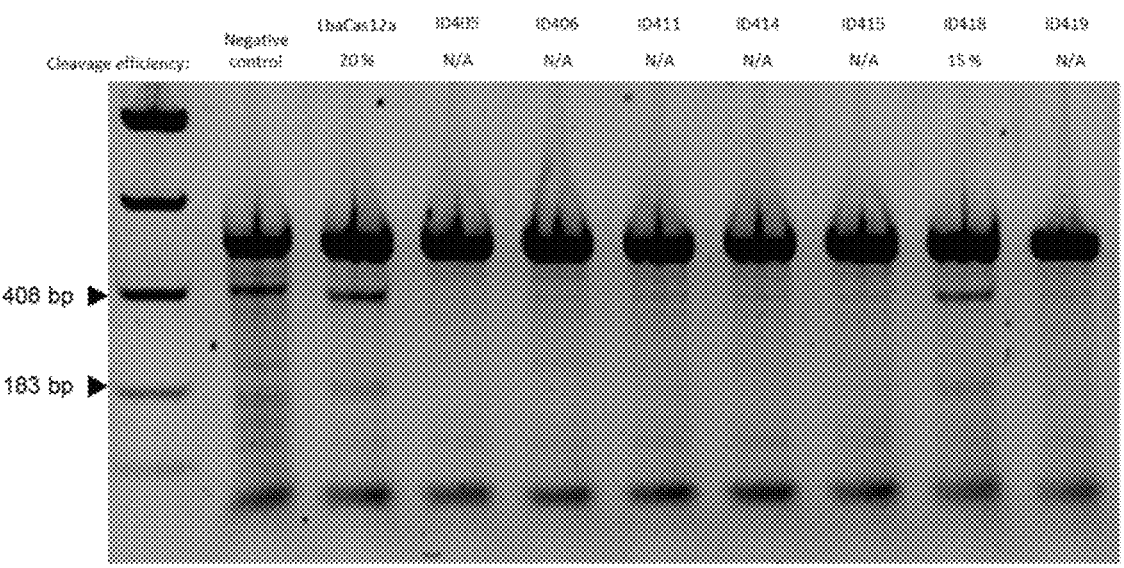
FIG. 20 Cleavage products of genomic target FANCF site 1 visualized on 2% agarose gel. Editing efficiency values for LbaCas12a and each ortholog were calculated using ImageJ software, in accordance with Example 10.

PAM sequence recognition was identified for each protein by first generating a collection of sequences that represent all possible outcomes of double stranded DNA cleavage and adapter ligation within the target region. For all the reads that matched these sequences which correspond to cleavage events the adjacent 7nt PAM sequences which promote the double stranded nuclease activity were extracted. The position-specific nucleotide preference was examined by first counting the identical PAM sequences, calculating their frequency within total reads and then normalizing the frequencies to the original uncleaved PAM library to account for under- or over-represented PAM sequences. Top 10% of the most enriched PAM sequences were used for further analysis. After normalization, a position frequency matrix (PFM) was calculated. This was done by weighting each nucleotide at each position based on the frequency (normalized) associated with each PAM. For example, if a PAM of 5'-CGGTAGC-3'; had a normalized frequency of 0.1500, then the C at first position would be given a frequency of 0.15% when determining the nucleotide frequency for the first PAM position. Next, the overall contribution of each nucleotide at each position in the dataset was summed and organized into a table with the most abundant nucleotides indicating Cas12a PAM preferences (Table Ex.9.2), herein: A=Adenine, C=Cytosine, G=Guanine, T=Thymine, R=A or G, Y=C or T, S=G or C, W=A or T, D=A or G or T, H=A or C or T, K=G or T, M=A or C, N=any base, B=C or G or T, V=A or C or G) and displayed as a WebLogos organized in the protein phylogenetic tree (FIG. 15).

TABLE EX. 9.2

Position frequency matrix for Cas12a protein PAMs

| | | | PAM Position | | | | | | |
|---|---|---|---|---|---|---|---|---|---|
| | | | 1 | 2 | 3 | 4 | 5 | 6 | 7 |
| ID401 | % Nucleotide | A | 0.30 | 0.30 | 0.30 | 0.06 | 0.00 | 0.00 | 0.52 |
| | | T | 0.31 | 0.24 | 0.37 | 0.56 | 0.93 | 0.99 | 0.02 |
| | | C | 0.20 | 0.23 | 0.19 | 0.32 | 0.07 | 0.01 | 0.27 |
| | | G | 0.19 | 0.24 | 0.14 | 0.06 | 0.00 | 0.00 | 0.18 |
| | Consensus | | N | N | N | Y(T > C) | T | T | V(A > B) | YTTV |

TABLE EX. 9.2-continued

Position frequency matrix for Cas12a protein PAMs

| | | | PAM Position | | | | | | | |
|---|---|---|---|---|---|---|---|---|---|---|
| | | | 1 | 2 | 3 | 4 | 5 | 6 | 7 | |
| ID402 | % | A | 0.31 | 0.28 | 0.37 | 0.03 | 0.19 | 0.00 | 0.17 | |
| | Nucleotide | T | 0.28 | 0.28 | 0.25 | 0.76 | 0.80 | 0.99 | 0.10 | |
| | | C | 0.20 | 0.25 | 0.10 | 0.15 | 0.00 | 0.01 | 0.58 | |
| | | G | 0.21 | 0.20 | 0.27 | 0.06 | 0.00 | 0.00 | 0.15 | |
| | Consensus | | N | N | N(A > K > C) | T | T | T | C | TTTC |
| ID403 | % | A | 0.29 | 0.20 | 0.36 | 0.10 | 0.00 | 0.00 | 0.25 | |
| | Nucleotide | T | 0.29 | 0.29 | 0.27 | 0.30 | 1.00 | 0.98 | 0.01 | |
| | | C | 0.22 | 0.26 | 0.21 | 0.36 | 0.00 | 0.02 | 0.54 | |
| | | G | 0.20 | 0.25 | 0.16 | 0.24 | 0.00 | 0.00 | 0.19 | |
| | Consensus | | N | N | N(A > Y > G) | N(Y > G > A) | T | T | V(C > R) | TTV |
| ID404 | % | A | 0.26 | 0.20 | 0.35 | 0.02 | 0.00 | 0.00 | 0.47 | |
| | Nucleotide | T | 0.34 | 0.35 | 0.25 | 0.75 | 0.99 | 1.00 | 0.02 | |
| | | C | 0.20 | 0.25 | 0.20 | 0.18 | 0.01 | 0.00 | 0.28 | |
| | | G | 0.20 | 0.19 | 0.20 | 0.05 | 0.00 | 0.00 | 0.23 | |
| | Consensus | | N | N | N | T | T | T | V(A > S) | TTTV |
| ID405 | % | A | 0.32 | 0.30 | 0.41 | 0.07 | 0.02 | 0.00 | 0.35 | |
| | Nucleotide | T | 0.27 | 0.27 | 0.28 | 0.58 | 0.90 | 0.95 | 0.09 | |
| | | C | 0.19 | 0.20 | 0.16 | 0.31 | 0.05 | 0.05 | 0.41 | |
| | | G | 0.22 | 0.23 | 0.15 | 0.04 | 0.03 | 0.00 | 0.15 | |
| | Consensus | | N | N | N(A > T > S) | Y(T > C) | T | T | V(C > A > G) | YTTV |
| ID406 | % | A | 0.31 | 0.28 | 0.36 | 0.06 | 0.00 | 0.00 | 0.51 | |
| | Nucleotide | T | 0.30 | 0.30 | 0.31 | 0.64 | 0.90 | 0.98 | 0.04 | |
| | | C | 0.20 | 0.23 | 0.14 | 0.25 | 0.10 | 0.02 | 0.26 | |
| | | G | 0.19 | 0.19 | 0.19 | 0.05 | 0.00 | 0.00 | 0.19 | |
| | Consensus | | N | N | N | Y(T > C) | T | T | V(A > C > G) | YTTV |
| ID407 | % | A | 0.35 | 0.34 | 0.40 | 0.07 | 0.03 | 0.00 | 0.37 | |
| | Nucleotide | T | 0.27 | 0.29 | 0.29 | 0.75 | 0.79 | 0.97 | 0.01 | |
| | | C | 0.16 | 0.18 | 0.17 | 0.18 | 0.19 | 0.03 | 0.34 | |
| | | G | 0.21 | 0.19 | 0.14 | 0.00 | 0.00 | 0.00 | 0.28 | |
| | Consensus | | N | N | N(A > T > S) | T | T | T | V | TTTV |
| ID408 | % | A | 0.28 | 0.25 | 0.40 | 0.05 | 0.00 | 0.00 | 0.53 | |
| | Nucleotide | T | 0.31 | 0.30 | 0.34 | 0.48 | 1.00 | 1.00 | 0.01 | |
| | | C | 0.23 | 0.24 | 0.07 | 0.44 | 0.00 | 0.00 | 0.28 | |
| | | G | 0.19 | 0.22 | 0.20 | 0.02 | 0.00 | 0.00 | 0.18 | |
| | Consensus | | N | N | D(W > G) | Y | T | T | V(A > S) | YTTV |
| ID409 | % | A | 0.23 | 0.15 | 0.35 | 0.34 | 0.00 | 0.00 | 0.00 | |
| | Nucleotide | T | 0.35 | 0.30 | 0.29 | 0.30 | 0.15 | 0.79 | 0.00 | |
| | | C | 0.25 | 0.31 | 0.14 | 0.19 | 0.85 | 0.17 | 1.00 | |
| | | G | 0.17 | 0.25 | 0.21 | 0.18 | 0.00 | 0.03 | 0.00 | |
| | Consensus | | N | N | N | N(W > S) | C | T | C | CTC |
| ID410 | % | A | 0.34 | 0.34 | 0.42 | 0.43 | 0.03 | 0.03 | 0.27 | |
| | Nucleotide | T | 0.28 | 0.29 | 0.32 | 0.37 | 0.49 | 0.76 | 0.08 | |
| | | C | 0.20 | 0.18 | 0.11 | 0.13 | 0.48 | 0.18 | 0.57 | |
| | | G | 0.18 | 0.19 | 0.15 | 0.08 | 0.00 | 0.03 | 0.08 | |
| | Consensus | | N | N | N(W > S) | H(A > T > C) | Y | T | M(C > A) | HYTM |
| ID411 | % | A | 0.27 | 0.24 | 0.38 | 0.01 | 0.00 | 0.00 | 0.39 | |
| | Nucleotide | T | 0.31 | 0.28 | 0.25 | 0.81 | 1.00 | 0.99 | 0.01 | |
| | | C | 0.19 | 0.23 | 0.21 | 0.16 | 0.00 | 0.01 | 0.32 | |
| | | G | 0.22 | 0.25 | 0.16 | 0.02 | 0.00 | 0.00 | 0.28 | |
| | Consensus | | N | N | N | T | T | T | V | TTTV |
| ID412 | % | A | 0.43 | 0.38 | 0.31 | 0.01 | 0.01 | 0.01 | 0.49 | |
| | Nucleotide | T | 0.21 | 0.29 | 0.38 | 0.98 | 0.99 | 0.99 | 0.01 | |
| | | C | 0.16 | 0.16 | 0.15 | 0.01 | 0.00 | 0.00 | 0.19 | |
| | | G | 0.20 | 0.17 | 0.16 | 0.00 | 0.00 | 0.00 | 0.31 | |
| | Consensus | | N(A > B) | N | N(W > S) | T | T | T | V(A > G > C) | TTTV |
| ID413 | % | A | 0.36 | 0.29 | 0.37 | 0.00 | 0.00 | 0.00 | 0.29 | |
| | Nucleotide | T | 0.26 | 0.24 | 0.27 | 0.81 | 1.00 | 0.81 | 0.09 | |
| | | C | 0.20 | 0.25 | 0.22 | 0.19 | 0.00 | 0.19 | 0.44 | |
| | | G | 0.18 | 0.21 | 0.13 | 0.00 | 0.00 | 0.00 | 0.18 | |
| | Consensus | | N | N | N | T | T | T | V(C > A > G) | TTTV |
| ID414 | % | A | 0.31 | 0.27 | 0.35 | 0.01 | 0.00 | 0.00 | 0.46 | |
| | Nucleotide | T | 0.27 | 0.28 | 0.29 | 0.95 | 0.99 | 0.99 | 0.02 | |
| | | C | 0.23 | 0.27 | 0.19 | 0.04 | 0.01 | 0.01 | 0.35 | |
| | | G | 0.20 | 0.18 | 0.16 | 0.00 | 0.00 | 0.00 | 0.17 | |
| | Consensus | | N | N | N | T | T | T | V(A > C > G) | TTTV |
| ID415 | % | A | 0.27 | 0.26 | 0.37 | 0.07 | 0.00 | 0.00 | 0.32 | |
| | Nucleotide | T | 0.34 | 0.32 | 0.28 | 0.63 | 0.92 | 0.98 | 0.01 | |
| | | C | 0.20 | 0.22 | 0.18 | 0.18 | 0.07 | 0.02 | 0.45 | |
| | | G | 0.20 | 0.20 | 0.18 | 0.12 | 0.00 | 0.00 | 0.22 | |
| | Consensus | | N | N | N | T | T | T | V(C > A > G) | TTTV |

TABLE EX. 9.2-continued

Position frequency matrix for Cas12a protein PAMs

| | | | PAM Position | | | | | | | |
|---|---|---|---|---|---|---|---|---|---|---|
| | | | 1 | 2 | 3 | 4 | 5 | 6 | 7 | |
| ID416 | % | A | 0.35 | 0.37 | 0.35 | 0.04 | 0.02 | 0.02 | 0.21 | |
| | Nucleotide | T | 0.30 | 0.21 | 0.39 | 0.93 | 0.95 | 0.94 | 0.04 | |
| | | C | 0.19 | 0.24 | 0.06 | 0.01 | 0.01 | 0.03 | 0.29 | |
| | | G | 0.15 | 0.17 | 0.20 | 0.02 | 0.01 | 0.01 | 0.46 | |
| | Consensus | | N | N | D(W > G) | T | T | T | V(G > M) | DTTV |
| ID417 | % | A | 0.29 | 0.27 | 0.40 | 0.14 | 0.00 | 0.08 | 0.38 | |
| | Nucleotide | T | 0.32 | 0.29 | 0.27 | 0.70 | 1.00 | 0.86 | 0.01 | |
| | | C | 0.19 | 0.22 | 0.17 | 0.13 | 0.00 | 0.06 | 0.33 | |
| | | G | 0.19 | 0.22 | 0.16 | 0.03 | 0.00 | 0.00 | 0.28 | |
| | Consensus | | N | N | N(A > T > S) | T | T | T | V | TTTV |
| ID418 | % | A | 0.35 | 0.30 | 0.38 | 0.11 | 0.00 | 0.00 | 0.36 | |
| | Nucleotide | T | 0.27 | 0.31 | 0.30 | 0.65 | 0.93 | 0.90 | 0.06 | |
| | | C | 0.20 | 0.20 | 0.14 | 0.23 | 0.07 | 0.10 | 0.43 | |
| | | G | 0.18 | 0.18 | 0.19 | 0.02 | 0.00 | 0.00 | 0.15 | |
| | Consensus | | N | N | N(W > S) | H(T > C > A) | T | T | V(M > G) | HTTV |
| ID419 | % | A | 0.29 | 0.25 | 0.36 | 0.02 | 0.00 | 0.00 | 0.42 | |
| | Nucleotide | T | 0.31 | 0.31 | 0.27 | 0.79 | 1.00 | 1.00 | 0.00 | |
| | | C | 0.18 | 0.21 | 0.22 | 0.18 | 0.00 | 0.00 | 0.29 | |
| | | G | 0.22 | 0.23 | 0.15 | 0.01 | 0.00 | 0.00 | 0.29 | |
| | Consensus | | N | N | N | T | T | T | V(A > S) | TTTV |
| ID420 | % | A | 0.34 | 0.30 | 0.42 | 0.12 | 0.00 | 0.00 | 0.48 | |
| | Nucleotide | T | 0.28 | 0.29 | 0.33 | 0.78 | 0.97 | 0.90 | 0.04 | |
| | | C | 0.20 | 0.21 | 0.11 | 0.07 | 0.03 | 0.10 | 0.35 | |
| | | G | 0.18 | 0.21 | 0.14 | 0.03 | 0.00 | 0.00 | 0.13 | |
| | Consensus | | N | N | N(W > S) | T | T | T | V(A > C > G) | TTTV |
| ID421 | % | A | 0.36 | 0.28 | 0.39 | 0.00 | 0.01 | 0.00 | 0.33 | |
| | Nucleotide | T | 0.26 | 0.27 | 0.29 | 0.83 | 0.99 | 0.81 | 0.06 | |
| | | C | 0.20 | 0.26 | 0.19 | 0.17 | 0.00 | 0.19 | 0.46 | |
| | | G | 0.18 | 0.19 | 0.13 | 0.00 | 0.01 | 0.00 | 0.16 | |
| | Consensus | | N | N | N(W > S) | T | T | T | V(C > A > G) | TTTV |
| ID422 | % | A | 0.33 | 0.21 | 0.37 | 0.00 | 0.00 | 0.00 | 0.29 | |
| | Nucleotide | T | 0.26 | 0.29 | 0.30 | 1.00 | 1.00 | 0.91 | 0.00 | |
| | | C | 0.18 | 0.27 | 0.30 | 0.00 | 0.00 | 0.09 | 0.38 | |
| | | G | 0.23 | 0.23 | 0.03 | 0.00 | 0.00 | 0.00 | 0.33 | |
| | Consensus | | N | N | H | T | T | T | V | HTTTV |
| ID423 | % | A | 0.25 | 0.19 | 0.17 | 0.18 | 0.00 | 0.00 | 0.03 | |
| | Nucleotide | T | 0.38 | 0.30 | 0.12 | 0.23 | 1.00 | 0.99 | 0.00 | |
| | | C | 0.22 | 0.23 | 0.00 | 0.36 | 0.00 | 0.01 | 0.85 | |
| | | G | 0.15 | 0.28 | 0.72 | 0.23 | 0.00 | 0.00 | 0.12 | |
| | Consensus | | N | N | G | N | T | T | C | GNTTC |
| ID424 | % | A | 0.35 | 0.32 | 0.41 | 0.40 | 0.03 | 0.00 | 0.40 | |
| | Nucleotide | T | 0.28 | 0.29 | 0.32 | 0.48 | 0.78 | 0.95 | 0.06 | |
| | | C | 0.20 | 0.20 | 0.12 | 0.07 | 0.19 | 0.05 | 0.42 | |
| | | G | 0.17 | 0.19 | 0.15 | 0.04 | 0.00 | 0.00 | 0.12 | |
| | Consensus | | N | N | N(A > T > S) | W | T | T | V(M > G) | WTTV |
| ID425 | % | A | 0.35 | 0.35 | 0.38 | 0.17 | 0.01 | 0.04 | 0.48 | |
| | Nucleotide | T | 0.28 | 0.25 | 0.31 | 0.76 | 0.99 | 0.94 | 0.01 | |
| | | C | 0.20 | 0.20 | 0.13 | 0.07 | 0.01 | 0.01 | 0.31 | |
| | | G | 0.16 | 0.20 | 0.19 | 0.01 | 0.00 | 0.00 | 0.20 | |
| | Consensus | | N | N | N(W > S) | T | T | T | V(A > C > G) | TTTV |
| ID426 | % | A | 0.35 | 0.38 | 0.41 | 0.19 | 0.03 | 0.00 | 0.22 | |
| | Nucleotide | T | 0.29 | 0.28 | 0.28 | 0.60 | 0.97 | 1.00 | 0.11 | |
| | | C | 0.22 | 0.16 | 0.08 | 0.13 | 0.00 | 0.00 | 0.53 | |
| | | G | 0.15 | 0.19 | 0.23 | 0.08 | 0.00 | 0.00 | 0.14 | |
| | Consensus | | N | N | D(A > K) | T | T | T | N(C > D) | DTTN |
| ID427 | % | A | 0.35 | 0.33 | 0.35 | 0.05 | 0.00 | 0.00 | 0.40 | |
| | Nucleotide | T | 0.29 | 0.27 | 0.29 | 0.74 | 0.92 | 0.89 | 0.11 | |
| | | C | 0.20 | 0.21 | 0.20 | 0.20 | 0.08 | 0.11 | 0.33 | |
| | | G | 0.16 | 0.18 | 0.16 | 0.01 | 0.00 | 0.00 | 0.17 | |
| | Consensus | | N | N | N | T | T | T | N(M > K) | TTTM |
| ID428 | % | A | 0.24 | 0.19 | 0.38 | 0.30 | 0.00 | 0.01 | 0.00 | |
| | Nucleotide | T | 0.35 | 0.22 | 0.26 | 0.29 | 0.07 | 0.66 | 0.01 | |
| | | C | 0.23 | 0.27 | 0.03 | 0.22 | 0.93 | 0.24 | 0.99 | |
| | | G | 0.19 | 0.32 | 0.33 | 0.19 | 0.00 | 0.09 | 0.00 | |
| | Consensus | | N | N | D | N | C | Y(T > C) | C | DNCYC |
| ID429 | % | A | 0.32 | 0.30 | 0.42 | 0.09 | 0.00 | 0.00 | 0.46 | |
| | Nucleotide | T | 0.27 | 0.25 | 0.28 | 0.66 | 0.98 | 0.99 | 0.05 | |
| | | C | 0.22 | 0.23 | 0.16 | 0.22 | 0.02 | 0.01 | 0.33 | |
| | | G | 0.20 | 0.21 | 0.14 | 0.03 | 0.00 | 0.00 | 0.16 | |
| | Consensus | | N | N | N(A > C > S) | T | T | T | V(A > C > G) | TTTV |

TABLE EX. 9.2-continued

Position frequency matrix for Cas12a protein PAMs

| | | | PAM Position | | | | | | | |
|---|---|---|---|---|---|---|---|---|---|---|
| | | | 1 | 2 | 3 | 4 | 5 | 6 | 7 | |
| ID432 | % | A | 0.34 | 0.27 | 0.41 | 0.03 | 0.00 | 0.00 | 0.41 | |
| | Nucleotide | T | 0.25 | 0.29 | 0.32 | 0.82 | 0.95 | 0.91 | 0.00 | |
| | | C | 0.20 | 0.25 | 0.15 | 0.15 | 0.05 | 0.08 | 0.36 | |
| | | G | 0.21 | 0.20 | 0.13 | 0.00 | 0.00 | 0.00 | 0.23 | |
| | Consensus | | N | N | N(W > S) | T | T | T | V(A > C > G) | TTTV |
| ID433 | % | A | 0.36 | 0.32 | 0.35 | 0.33 | 0.00 | 0.00 | 0.08 | |
| | Nucleotide | T | 0.27 | 0.23 | 0.25 | 0.43 | 0.49 | 0.71 | 0.00 | |
| | | C | 0.22 | 0.15 | 0.01 | 0.19 | 0.51 | 0.29 | 0.87 | |
| | | G | 0.16 | 0.30 | 0.39 | 0.04 | 0.00 | 0.00 | 0.06 | |
| | Consensus | | N | N | D | H(T > A > G) | Y | T | C | DHYTC |

Example 10. Genome Editing Determination by T7 Endo Assay

To determine gene editing efficiencies the Human embryonic kidney (HEK) cell line 293T (ATCC-CRL-3216) were transfected with plasmid encoding Cas12a and PCR fragment encoding U6 promoter, crRNA and HDV ribozyme. The activity of each protein was tested using 2 different sites (RUNX1 and SCN1A). Sequences of the targets and crRNA encoding fragments are provided in the supplementary file.

For that HEK293T cells were maintained in Dulbecco's modified Eagle's Medium (DMEM) with GlutaMAX (Thermo Fisher Scientific), supplemented with 10% fetal bovine serum (Thermo Fisher Scientific) and 10,000 units/mL penicillin, and 10,000 g/mL streptomycin (Thermo Fisher Scientific) at 37° C. with 5% CO2 incubation.

HEK293T cells were seeded into 96-well plates (Thermo Fisher Scientific) one day prior to transfection at a density of 18,000 cells per well. Cells were transfected using FuGENE HD (Promega Corporation) following the manufacturer's recommended protocol. For each well of a 96-well plate a total amount of 350 ng DNA containing 50 fmol of plasmid encoding Cas12a and 50 fmol of PCR fragment with appropriate U6-crRNA-HDV template was used.

Cells were incubated at 37° C. for 96 hours post transfection in 5% CO2 before genomic DNA extraction. The cells were washed twice with 200 µl 1xDPBS (Thermo Fisher Scientific) and resuspended in 25 µl 50 mM Tris-HCl, 150 mM NaCl, 0.05% Tween 20, pH 7.6 (Sigma Aldrich) and 0.2 mg/ml Proteinase K (New England Biolabs) lysis buffer.

Resuspended cells were incubated at 55° C. for 60 minutes and 95° C. for 15 minutes. Genomic region surrounding each Cas12a target site was PCR amplified using primers defined in the Table Ex.10.1 PCR amplification was performed using Q5 Hot Start High-Fidelity 2X Master Mix (New England Biolabs) according to the manufacturer's instructions. The reaction was set up using 1 µl of the cell lysate and 0.5 µM of each primer in a final reaction volume of 25 ul.

TABLE Ex.10.1

Primer sequences used for target amplification in T7 Endonuclease I assay

| Target | Primer | Primer sequence 5'->3' |
|---|---|---|
| DNMT1 | DNMT1_dir | GCCAAAGCCCGAGAGAGTG (SEQ ID NO: 639) |
| DNMT1 | DNMT1_rev | CCTCACACAACAGCTTCATG (SEQ ID NO: 640) |
| RUNX1 | RUNX1_dir | CATCACCAACCCACAGCCAAGG (SEQ ID NO: 641) |
| RUNX1 | RUNX1_rev | CCAGCACAACTTACTCGCACTTGAC (SEQ ID NO: 642) |
| SCN1A | SCN1A_dir | AGTCCAAGGAATGCAGTAGG (SEQ ID NO: 643) |
| SCN1A | SCN1A_rev | GGCACAGTTCCTGTATCAGT (SEQ ID NO: 644) |
| FANCF (amplicon 1) | FANCF1_dir | GCCCTACATCTGCTCTCCCTCC (SEQ ID NO: 645) |
| FANCF (amplicon 1) | FANCF1_rev | GGGCCGGGAAAGAGTTGCTG (SEQ ID NO: 646) |
| FANCF (amplicon 2) | FANCF2_dir | GCGACATAGGACCTTCTCCTCCC (SEQ ID NO: 647) |
| FANCF (amplicon 2) | FANCF2_rev | GGAGGGAGAGCAGATGTAGGGC (SEQ ID NO: 648) |

Figure 21:
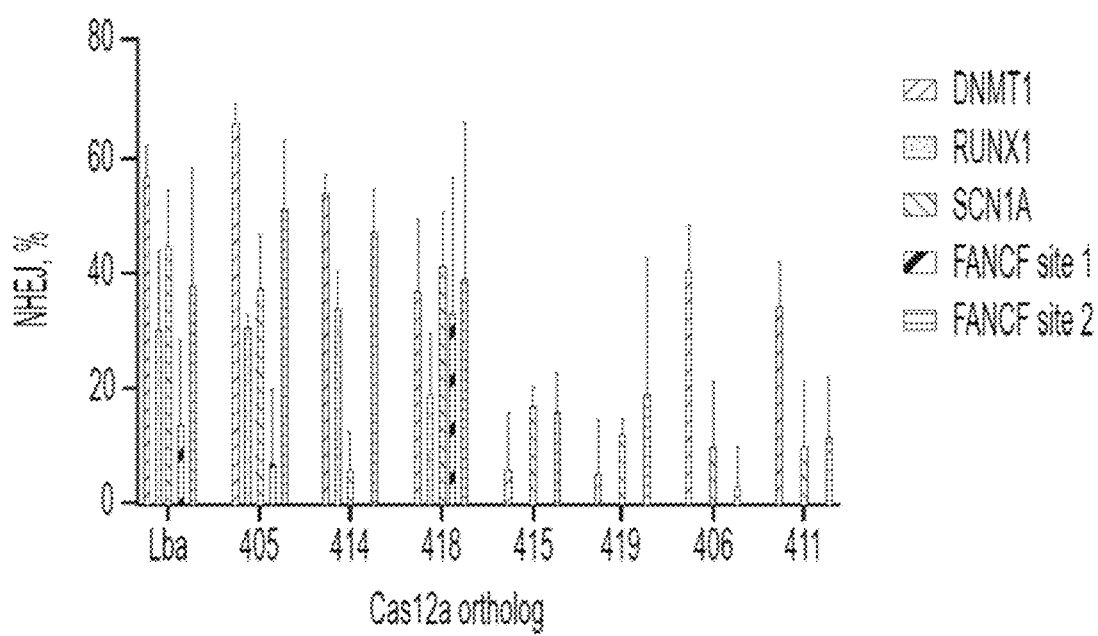
FIG. 21 Comparison of Cas12a orthologs activity on different targets (n≥3). Results are calculated from T7 endonuclease assay, in accordance with Example 11. Bars for each ortholog correspond to the key from top to bottom, i.e., DNMT1, RUNX1, SCN1A, FANCF site 1, FANCF site 2.

Example 11. Genome Editing Frequencies were Estimated Using T7 Endonuclease I Assays 25 µL of each PCR reaction was combined with 3 µL NEBluffer 2 (New England Biolabs) and 7 µL of water before denaturation at 95° C. for 5 minutes and re-annealing by temperature ramping from 95-85° C. at -2° C./s followed by ramping from 85-25° C. at -0.1° C./s. 1 µL of T7 Endonuclease I (New England Biolabs) was added to each re-annealed sample and cleavage reactions were incubated at 37° C. for 20 min. Fragments were analyzed by performing gel electrophoresis using E-Gel Precast Agarose Gel Electrophoresis system (Invitrogen). 2% gel with Ethidium bromide dye was used. 8 µL of each sample was mixed with 7 µL of E-Gel Sample Loading Buffer (Invitrogen) and the whole volume was loaded to the well. Genomic target cleavage percentage was calculated using ImageJ software. FIGS. 16, 17, 18, 19, and 20 demonstrates the editing efficiencies of LbaCas12a, ID405, ID406, ID411, ID414, ID415, ID418, and ID419 orthologs. FIG. 21 summarizes data from at least 3 repeats of such experiments.

Example 12. Gene Editing Efficiency Determination by Deep-Sequencing

Lysates of the transfected HEK293T cells were prepared for deep sequencing to determine the activity of Cas12a orthologs in eukaryotic cells by studying the rates of NHEJ outcomes in the genomic target sites of treated cells. Briefly, the genomic target regions were amplified and fragments extended with Illumina sequences including a unique index for each sample through two rounds of PCR. The triplicate samples from a single experiment were combined into a single tube and 4 µL of the mix was used as template in the primary PCR reaction. For the primary PCR custom primers were used that were complementary to the sequences surrounding the genomic targets and had non-complementary 'tails' with Illumina adapter sequences (Table Ex.12.1). Q5 HotStart 2× MasterMix (New England Biolabs) was used for the primary PCR and the reaction set up using 4 µL of cell lysate as template and 0.2 mM of each primer in a final volume of 25 µL. The cycling conditions used were: 98° C. for 2 min 30 s, 24 cycles of 98° C. for 30 s, 56.5° C. for 30 s, 72° C. for 25 s, and final extension at 72° C. for 2 min. The primary PCR product was purified using Monarch PCR & DNA Cleanup Kit (New England Biolabs) and used for the secondary PCR.

TABLE Ex.12.1

Custom primers used for primary PCR of genomic DNA deep sequencing sample preparation

| No. | Primer sequence 5'-3'. Underlined sequences complementary to genomic DNA | Description |
|---|---|---|
| 1 | ACACTCTTTCCCTACACGACGCTCTTCCGATCTAT TGAGTCCCCGCCTTCAG (SEQ ID NO: 649) | Indels Primary PCR RUNX1 forward primer |
| 2 | GTGACTGGAGTTCAGACGTGTGCTCTTCCGATCT ATGAAGCACTGTGGGTACGA (SEQ ID NO: 650) | Indels Primary PCR RUNX1 reverse primer |
| 3 | ACACTCTTTCCCTACACGACGCTCTTCCGATCTcag TTCTCTGGTGAAGAAGTTGAAGC (SEQ ID NO: 651) | Indels Primary PCR SCN1A forward primer |
| 4 | ACACTCTTTCCCTACACGACGCTCTTCCGATCTgT TCTCTGGTGAAGAAGTTGAAGC (SEQ ID NO: 652) | Indels Primary PCR SCN1A forward primer |
| 5 | GTGACTGGAGTTCAGACGTGTGCTCTTCCGATCT GGAATTTCATATGCAGAATAAATGG (SEQ ID NO: 653) | Indels Primary PCR SCN1A reverse primer |
| 6 | GTGACTGGAGTTCAGACGTGTGCTCTTCCGATCTc ctGGAATTTCATATGCAGAATAAATGG (SEQ ID NO: 654) | Indels Primary PCR SCN1A reverse primer |
| 7 | ACACTCTTTCCCTACACGACGCTCTTCCGATCTTT GGTCAGGTTGGCTGCTGG (SEQ ID NO: 655) | Indels Primary PCR DNMT1 forward primer |
| 8 | ACACTCTTTCCCTACACGACGCTCTTCCGATCTcg TTGGTCAGGTTGGCTGCTGG (SEQ ID NO: 656) | Indels Primary PCR DNMT1 forward primer |
| 9 | GTGACTGGAGTTCAGACGTGTGCTCTTCCGATCTc tAACACTCCTCAAACGGTCCC (SEQ ID NO: 657) | Indels Primary PCR DNMT1 reverse primer |
| 10 | GTGACTGGAGTTCAGACGTGTGCTCTTCCGATCT AACACTCCTCAAACGGTCCC (SEQ ID NO: 658) | Indels Primary PCR DNMT1 reverse primer |
| 11 | ACACTCTTTCCCTACACGACGCTCTTCCGATCTgcc gaTACCTGCGCCACATCCATCG (SEQ ID NO: 659) | Indels Primary PCR FANCF site 1 forward primer |
| 12 | ACACTCTTTCCCTACACGACGCTCTTCCGATCTac TACCTGCGCCACATCCATCG (SEQ ID NO: 660) | Indels Primary PCR FANCF site 1 forward primer |
| 13 | GTGACTGGAGTTCAGACGTGTGCTCTTCCGATCT AAAGCCGCCCTCTTGCCTCC (SEQ ID NO: 661) | Indels Primary PCR FANCF site 1 reverse primer |
| 14 | ACACTCTTTCCCTACACGACGCTCTTCCGATCTga ctTTCGACCAATAGCATTGCAGAG (SEQ ID NO: 662) | Indels Primary PCR FANCF site 2 forward primer |
| 15 | ACACTCTTTCCCTACACGACGCTCTTCCGATCTgac tTTCGACCAATAGCATTGCAGAG (SEQ ID NO: 663) | Indels Primary PCR FANCF site 2 forward primer |
| 16 | GTGACTGGAGTTCAGACGTGTGCTCTTCCGATCTc tcctAAGGCCCTACTTCCGCTTTC (SEQ ID NO: 664) | Indels Primary PCR FANCF site 2 reverse primer |
| 17 | GTGACTGGAGTTCAGACGTGTGCTCTTCCGATCTt gactAAGGCCCTACTTCCGCTTTC (SEQ ID NO: 665) | Indels Primary PCR FANCF site 2 reverse primer |

Secondary PCR was performed using PCR Add-on Kit for Illumina (Lexogen) with primers encoding Illumina sequences and a 6nt i7 index (Lexogen i7 6 nt Index Set (7001-7096)) according to the manufacturer's instructions. Cycling conditions for secondary PCR were as follows: 98° C. for 30 s, 8 cycles at 98° C. for 10 s, 65° C. for 20 s and 72° C. for 30 s, followed by final extension at 72° C. for 1 min. The secondary PCR products were purified using Monarch PCR & DNA Cleanup Kit (New England Biolabs), their quantity and quality checked using spectrophotometry (NanoPhotometer® NP80, IMPLEN) and fluorimetry (Qubit 1× dsDNA HS Assay and Qubit 4, Thermo Fisher Scientific). The purified samples were pooled in an equimolar ratio and size selection performed using Ampure XP (Beckman Coulter) magnetic beads. The resulting library was analyzed using Bioanalyzer (Agilent) and quantified using NEBNext Library Quant Kit for Illumina (New England Biolabs). Final library pool was prepared for deep sequencing according to Illumina's specifications. Paired end sequencing was performed using the MiSeq Reagent Kit v2 (300-cycles) (Illumina) on the MiSeq System (Illumina) with 7% PhiX v.3 (Illumina). All sequencing data analysis was done using Geneious Prime 2023.0.4. Reads were trimmed and filtered using BBDuk and mapped to the reference sequence with 25nt quantification window set on each side of the predicted cleavage site. Reads that differed from the reference sequence in this window were included in genome editing efficiency calculations.

Figure 22A:
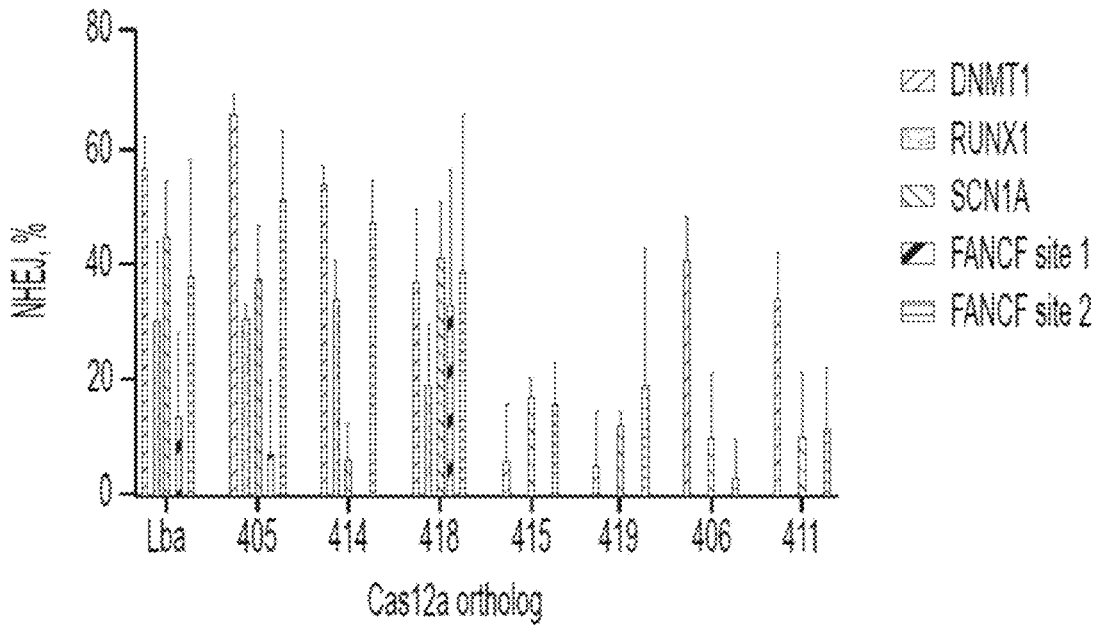
FIG. 22A Genome editing efficiency results for ID405, ID414, ID418, LbaCas12a depicted as indels frequency at RUNX1 and SCN1A target sites as determined by deep-sequencing in accordance with Example 12. Bars for each ortholog correspond to the key from top to bottom, i.e., RUNX1 site 1, SCN1A site 1.
Figure 22B:
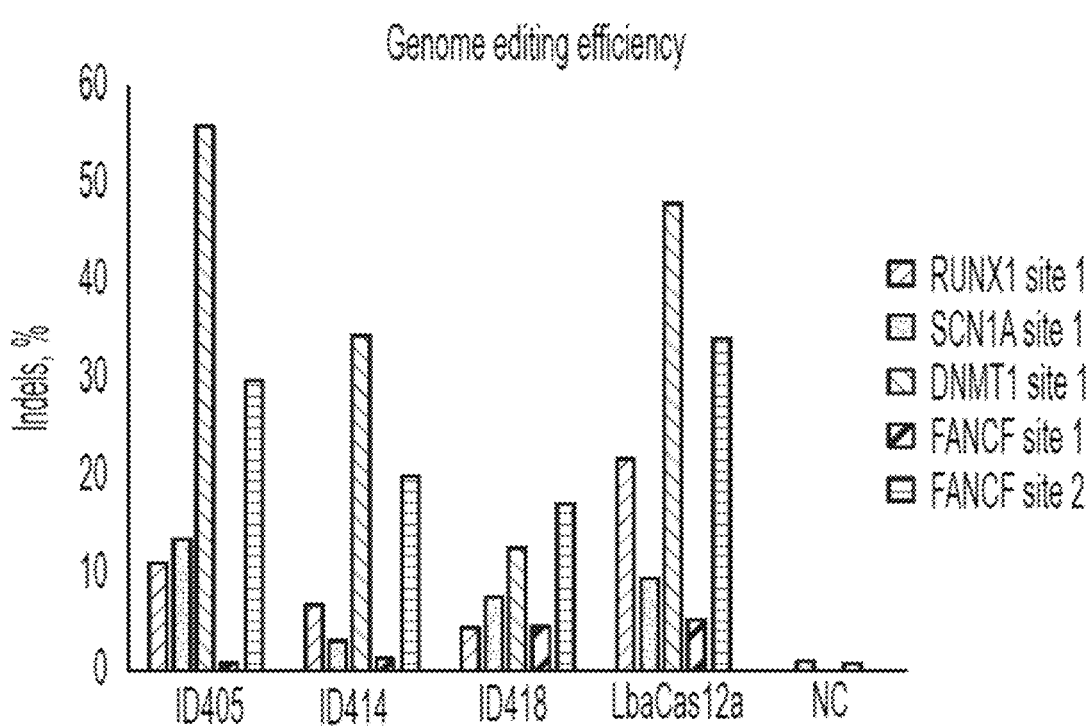
FIG. 22B Genome editing efficiency results for ID405, ID414, ID418, LbaCas12a depicted as indels frequency at RUNX1, SCN1A, DNMT1, FANCF site 1, and FANCF site 2 (left to right for each ortholog), as determined by deep-sequencing in accordance with Example 12.
Figure 23B:
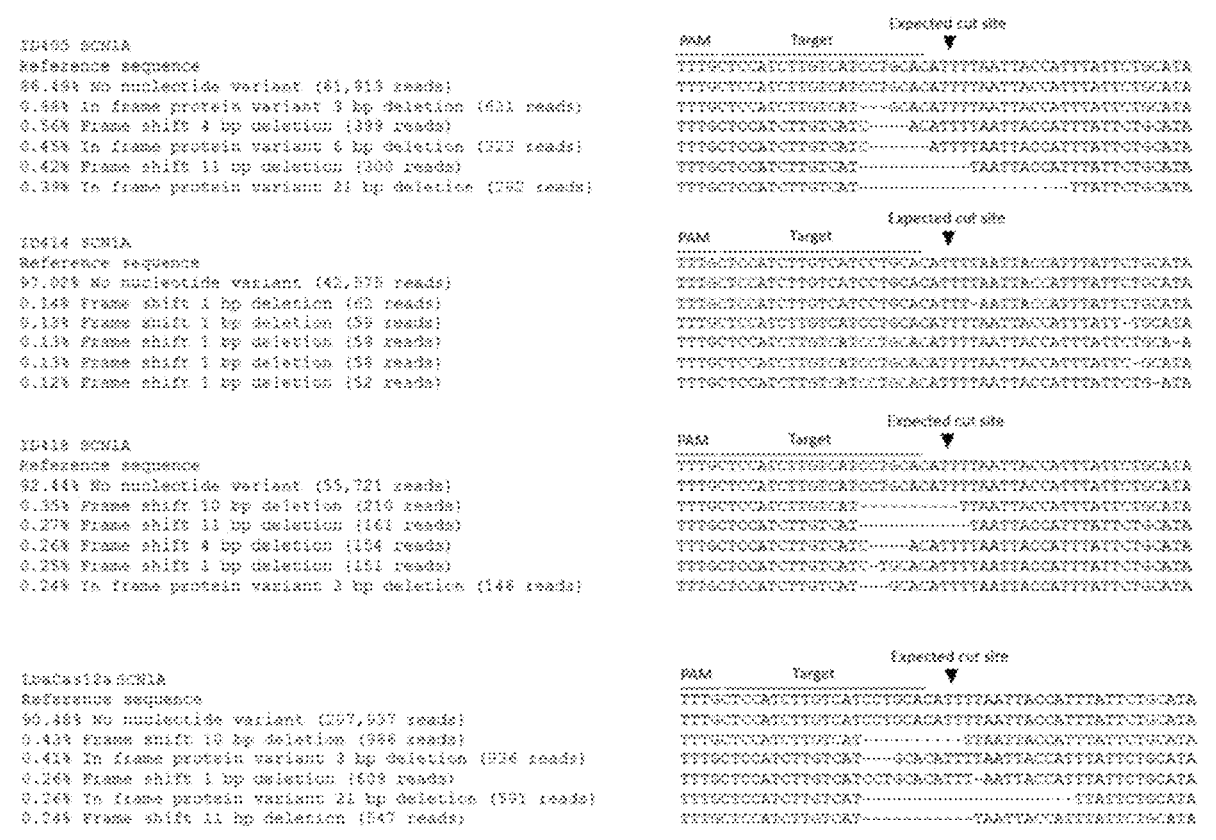
Figure 23C:
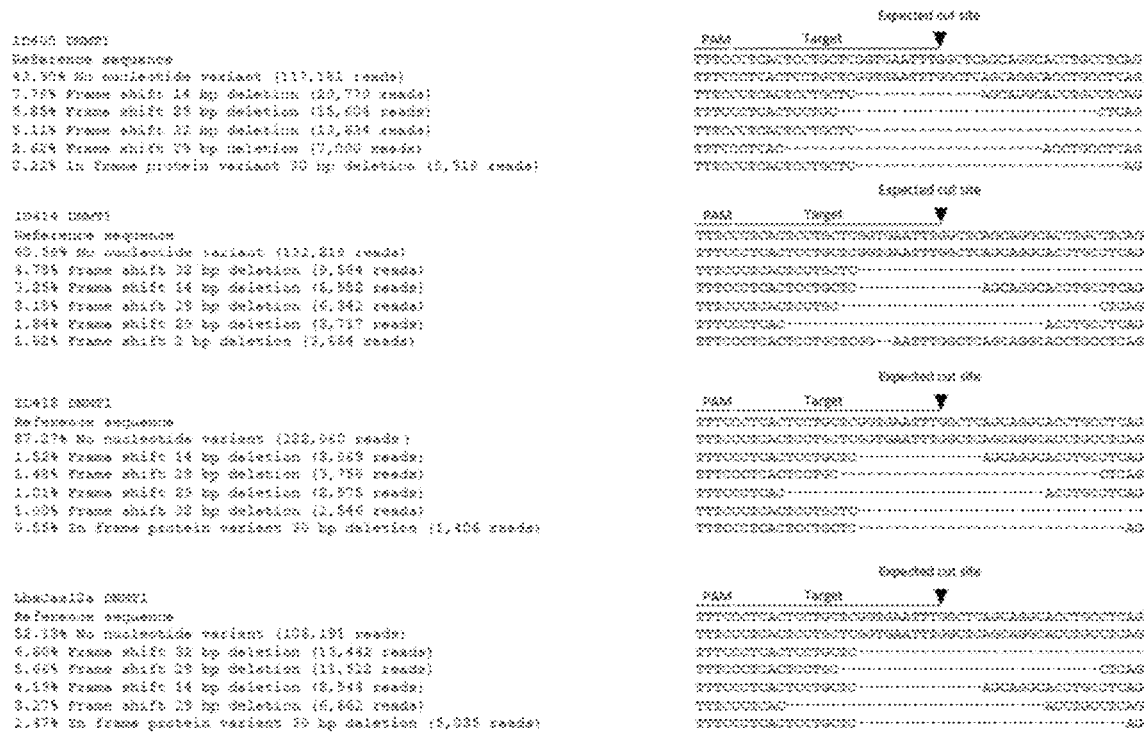
Figure 23D:
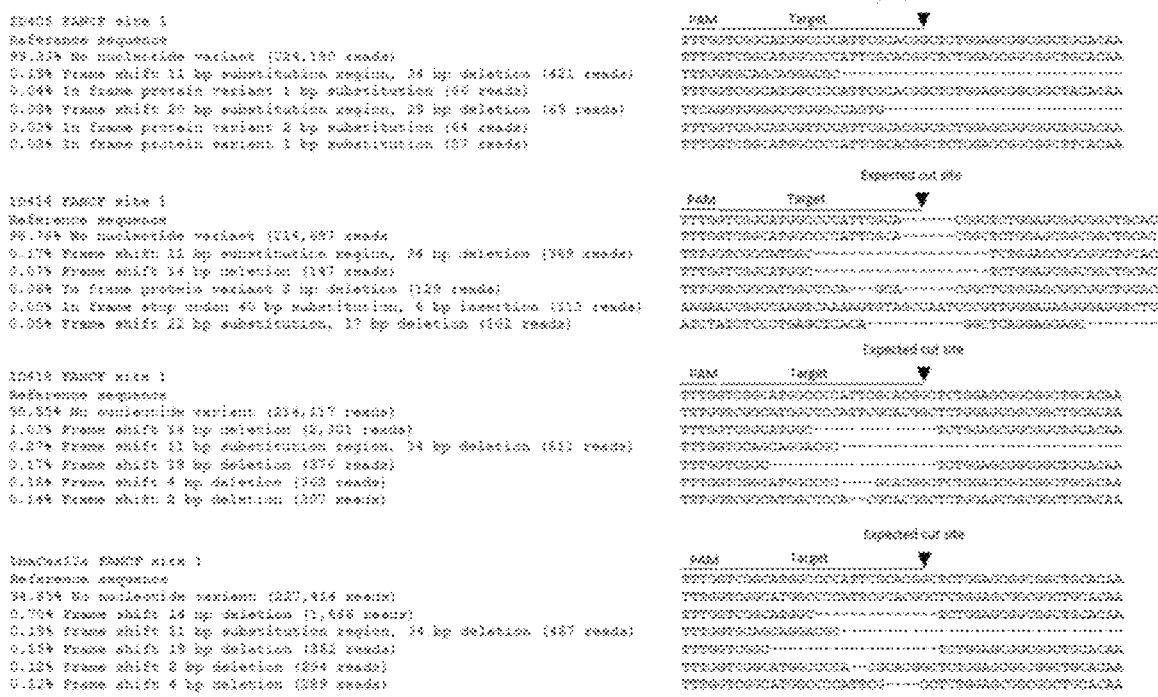
Figure 23E:
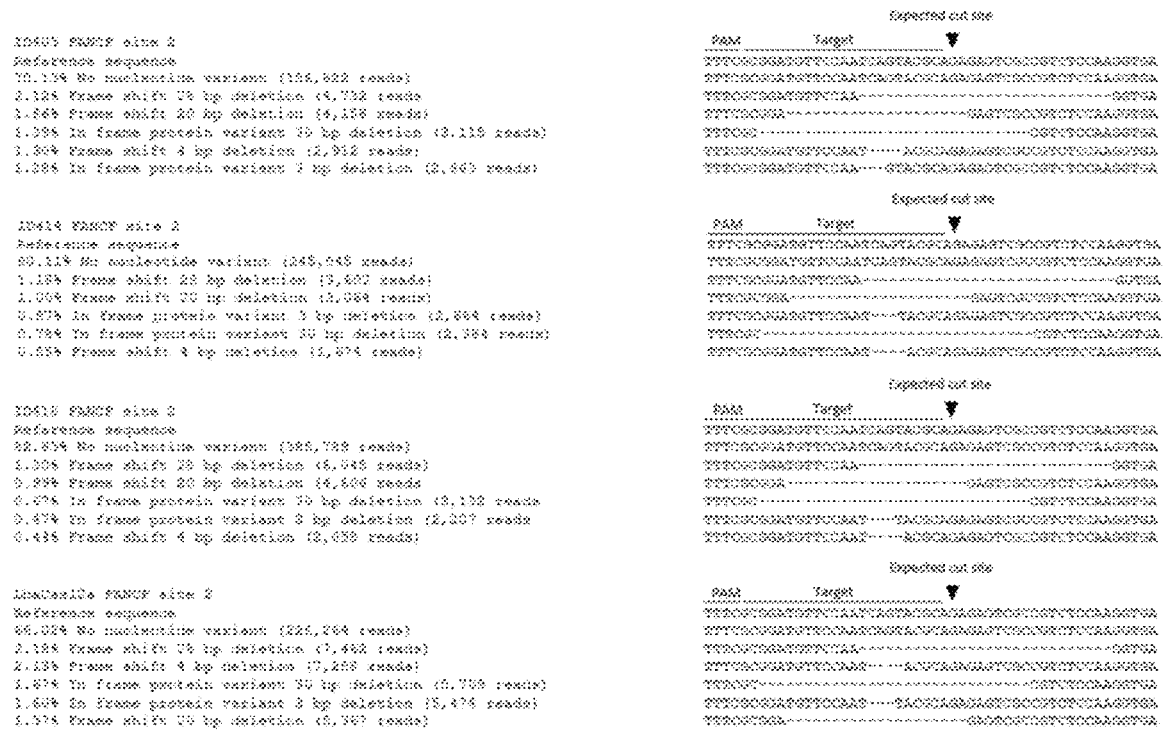

Efficiency results are presented in FIG. 22A and reads with the top 5 most common editing outcomes presented in FIG. 22B, with raw data presented in FIGS. 23A and 23B. Editing efficiency of ID405, ID414 and ID418 was comparable to that of LbaCas12a over five genomic targets in DNMT1, FANCF, RUNX1 and SCN1A genes. For DNMT1, SCN1A, RUNX1 and FANCF site 2 targets ID405 exhibited best genome editing efficiency up to 56% of edited reads, even exceeding LbaCas12a in the case of SCN1A and DNMT1 targets. ID414 and ID418 produced editing efficiencies up to 340 and 170 respectively. The majority of edited reads have small deletions in the editing window.

Figure 24:
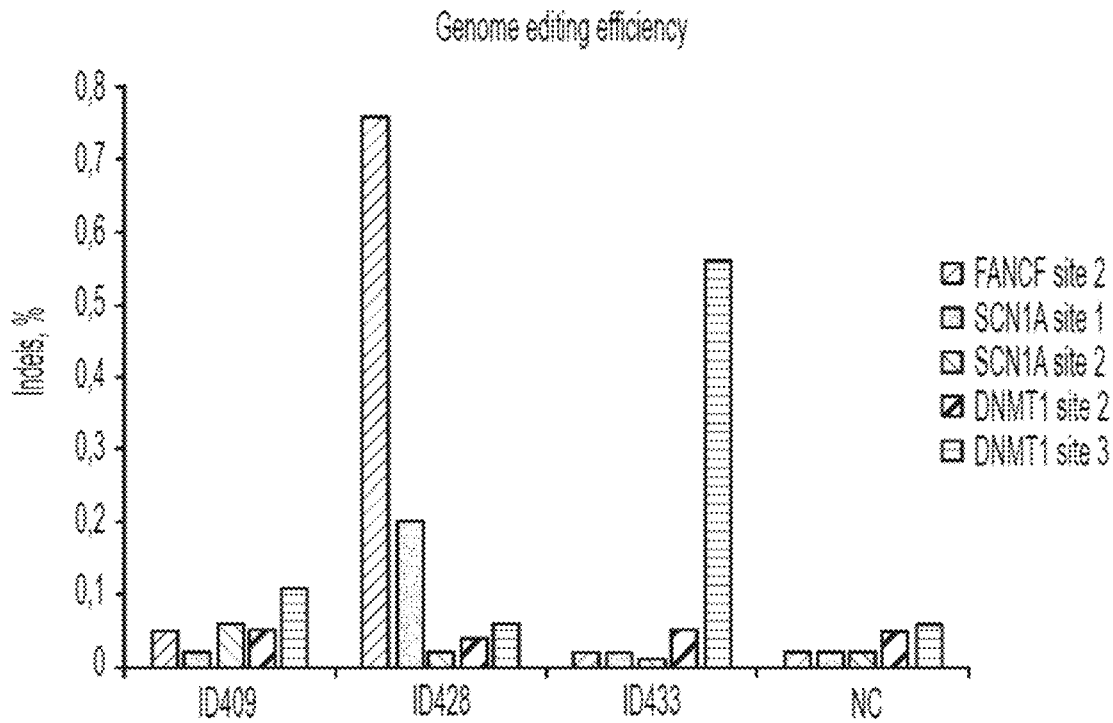
FIG. 24 Genome editing efficiency results depicted as indels frequency as determined by deep-sequencing as described in Example 12. Bars for each ortholog correspond to the key from top to bottom, i.e., FANCF site 2, SCN1A site 1, SCN1A site 2, DNMT1 site 2, DNMT1 site 3.
Figure 25:
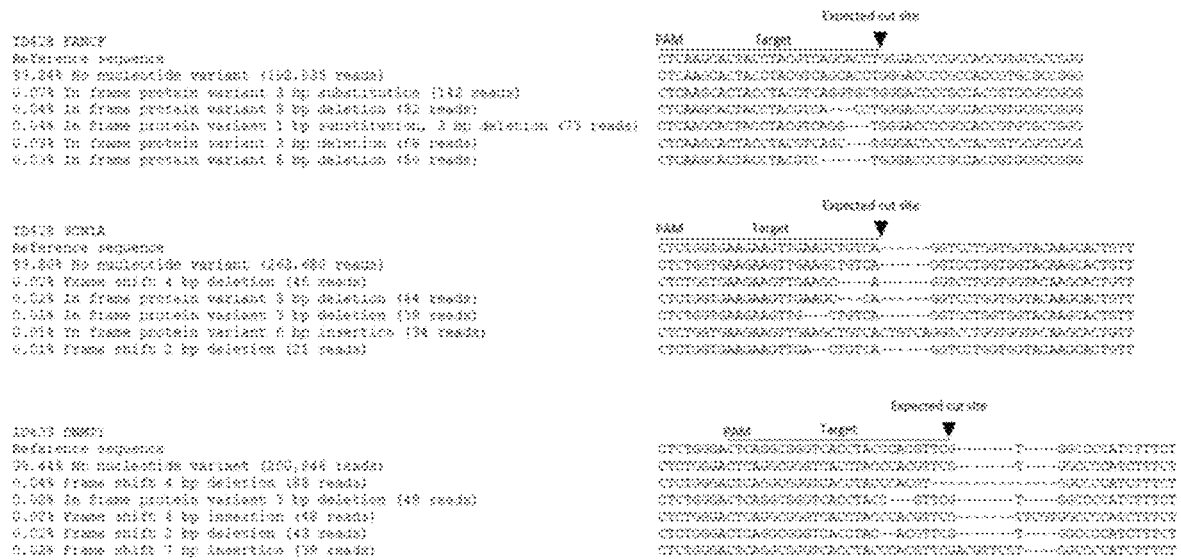
FIG. 25 Top 5 most common editing outcomes observed in deep sequencing data of ID428 and ID433 genomic targets exhibiting low but observable editing as compared to reference sequences as described in Example 12 ID428 at FANCF, top to bottom: SEQ ID NO:1528, SEQ ID NO:1528, SEQ ID NO:1529, SEQ ID NO:1530, SEQ ID NO:1531, SEQ ID NO:1532, SEQ ID NO:1533. ID428 at SCN1A, top to bottom: SEQ ID NO:1534, SEQ ID NO:1534, SEQ ID NO:1535, SEQ ID NO:1536, SEQ ID NO:1537, SEQ ID NO:1538, SEQ ID NO:1539. ID433 at DNMT1, top to bottom: SEQ ID NO:1540, SEQ ID NO:1540, SEQ ID NO:1541, SEQ ID NO:1542, SEQ ID NO:1543, SEQ ID NO:1544, SEQ ID NO:1545.

Efficiency results for proteins that recognize CTC PAMV are presented in FIG. 24 and reads with the top 5 most common editing outcomes of active proteins presented in FIG. 25. Editing efficiency of ID428 and TD433 is low (<10%) but elevated count of mutant reads can be detected with deep sequencing when compared to negative control, which suggests weak nuclease activity in eukaryotic cells. Sequences used in this example are provided in Tables Ex.12.2-Ex.12.5.

TABLE Ex.12.2

Custom primers used for primary PCR of genomic DNA deep sequencing sample preparation

| No. | Primer sequence 5'-3'. Underlined sequences complementary to genomic DNA | Description |
|---|---|---|
| 1 | ACACTCTTTCCCTACACGACGCTCTTCCGATCTCC TGGATCGCTTTTCCGAGCT (SEQ ID NO: 666) | Indels Primary PCR FANCF site 2 forward primer |
| 2 | GTGACTGGAGTTCAGACGTGTGCTCTTCCGATCT AGGTAGCGCGCCCACTGCAA (SEQ ID NO: 667) | Indels Primary PCR FANCF site 2 reverse primer |
| 3 | ACACTCTTTCCCTACACGACGCTCTTCCGATCTGC AATGCGTCTTTCAATAGCCGC (SEQ ID NO: 668) | Indels Primary SCNIA site 1 forward primer |
| 4 | GTGACTGGAGTTCAGACGTGTGCTCTTCCGATCTt AAAATGTGCAGGATGACAAGATG (SEQ ID NO: 669) | Indels Primary SCNIA site 1 reverse primer |
| 5 | ACACTCTTTCCCTACACGACGCTCTTCCGATCTAG GTCCTGGTGGTACAAGCACT (SEQ ID NO: 670) | Indels Primary SCNIA site 2 forward primer |
| 6 | GTGACTGGAGTTCAGACGTGTGCTCTTCCGATCT TCCACTCTTTAAAATATCTGTATTCC (SEQ ID NO: 671) | Indels Primary SCNIA site 2 reverse primer |
| 7 | ACACTCTTTCCCTACACGACGCTCTTCCGATCTGT TTCCCTCACTCCTGCTCG (SEQ ID NO: 672) | Indels Primary DNMTI site 2 forward primer |
| 8 | GTGACTGGAGTTCAGACGTGTGCTCTTCCGATCT CTCCTCAAACGGTCCCCAGA (SEQ ID NO: 673) | Indels Primary DNMTI site 2 reverse primer |
| 9 | ACACTCTTTCCCTACACGACGCTCTTCCGATCTG TACATGTGGGGGCAGTTGC (SEQ ID NO: 674) | Indels Primary DNMTI site 3 forward primer |
| 10 | GTGACTGGAGTTCAGACGTGTGCTCTTCCGATCT ACGTGCAACTCACTCAATCCT (SEQ ID NO: 675) | Indels Primary DNMTI site 3 reverse primer |
| 11 | ACACTCTTTCCCTACACGACGCTCTTCCGATCTGT ACATGTGGGGGCAGTTGC (SEQ ID NO: 676) | Indels Primary DNMTI site 3 forward primer |
| 12 | GTGACTGGAGTTCAGACGTGTGCTCTTCCGATCTc ACGTGCAACTCACTCAATCCT (SEQ ID NO: 677) | Indels Primary DNMTI site 3 reverse primer |

TABLE Ex 12.3

Target sequences in HEK293T cells in Example 12

| Cas12a nuclease | Target | Target sequence | PAM |
|---|---|---|---|
| ID409 | DNMT1 site 2 | AGCAGGCACCTGCCTCAGCTGCT (SEQ ID NO: 678) | CTC |
| ID409 | DNMT1 site 3 | AGGCGGGTCACCTACCCACGTTC (SEQ ID NO: 679) | CTC |
| ID428 | DNMT1 site 3 | AGGCGGGTCACCTACCCACGTTC (SEQ ID NO: 680) | CTC |
| ID428 | DNMT1 site 2 | AGCAGGCACCTGCCTCAGCTGCT (SEQ ID NO: 681) | CTC |
| ID433 | DNMT1 site 2 | AGCAGGCACCTGCCTCAGCTGCT (SEQ ID NO: 682) | CTC |
| ID433 | DNMT1 site 3 | AGGCGGGTCACCTACCCACGTTC (SEQ ID NO: 683) | CTC |
| ID409 | SCN1A_T1 | TGGTGAAGAAGTTGAAGCTGTCA (SEQ ID NO: 684) | CTC |
| ID409 | SCN1A_T2 | CATCTTGTCATCCTGCACATTTT (SEQ ID NO: 685) | CTC |
| ID428 | SCN1A_T1 | TGGTGAAGAAGTTGAAGCTGTCA (SEQ ID NO: 686) | CTC |
| ID428 | SCN1A_T2 | CATCTTGTCATCCTGCACATTTT (SEQ ID NO: 687) | CTC |
| ID433 | SCN1A_T1 | TGGTGAAGAAGTTGAAGCTGTCA (SEQ ID NO: 688) | CTC |
| ID433 | SCN1A_T2 | CATCTTGTCATCCTGCACATTTT (SEQ ID NO: 689) | CTC |
| ID409 | FANCF site 2 | AAGCACTACCTACGTCAGCACCT (SEQ ID NO: 690) | CTC |
| ID428 | FANCF site 2 | AAGCACTACCTACGTCAGCACCT (SEQ ID NO: 691) | CTC |
| ID433 | FANCF site 2 | AAGCACTACCTACGTCAGCACCT (SEQ ID NO: 692) | CTC |

TABLE Ex 12.4 crRNA sequences used in Example 12

| Cas12a nuclease | Target | crRNA sequence |
|---|---|---|
| ID409 | DNMT1 site 2 | UAAAUUUCUACUAUUGUAGAUAGCAGGCACCUGCCUCAGCUGCU (SEQ ID NO: 693) |
| ID409 | DNMT1 site 3 | UAAAUUUCUACUAUUGUAGAUAGGCGGGUCACCUACCCACGUUC (SEQ ID NO: 694) |
| ID428 | DNMT1 site 3 | UAAAUUUCUACUAUUGUAGAUAGGCGGGUCACCUACCCACGUUC (SEQ ID NO: 695) |
| ID428 | DNMT1 site 2 | UAAAUUUCUACUAUUGUAGAUAGCAGGCACCUGCCUCAGCUGCU (SEQ ID NO: 696) |
| ID433 | DNMT1 site 2 | AAAAUUUCUGCUAUUGCAGAUAGCAGGCACCUGCCUCAGCUGCU (SEQ ID NO: 697) |
| ID433 | DNMT1 site 3 | AAAAUUUCUGCUAUUGCAGAUAGGCGGGUCACCUACCCACGUUC (SEQ ID NO: 698) |
| ID409 | SCN1A site 1 | UAAAUUUCUACUAUUGUAGAUUGGUGAAGAAGUUGAAGCUGUCA (SEQ ID NO: 699) |
| ID409 | SCN1A site 2 | UAAAUUUCUACUAUUGUAGAUCAUCUUGUCAUCCUGCACAUUUU (SEQ ID NO: 700) |
| ID428 | SCN1A site 1 | UAAAUUUCUACUAUUGUAGAUUGGUGAAGAAGUUGAAGCUGUCA (SEQ ID NO: 701) |
| ID428 | SCN1A site 2 | UAAAUUUCUACUAUUGUAGAUCAUCUUGUCAUCCUGCACAUUUU (SEQ ID NO: 702) |
| ID433 | SCN1A site 1 | AAAAUUUCUGCUAUUGCAGAUUGGUGAAGAAGUUGAAGCUGUCA (SEQ ID NO: 703) |
| ID433 | SCN1A site 2 | AAAAUUUCUGCUAUUGCAGAUCAUCUUGUCAUCCUGCACAUUUU (SEQ ID NO: 704) |
| ID409 | FANCF site 2 | UAAAUUUCUACUAUUGUAGAUAAGCACUACCUACGUCAGCACCU (SEQ ID NO: 705) |
| ID428 | FANCF site 2 | UAAAUUUCUACUAUUGUAGAUAAGCACUACCUACGUCAGCACCU (SEQ ID NO: 706) |

TABLE Ex 12.4-continued crRNA sequences used in Example 12

| Cas12a nuclease | Target | crRNA sequence |
|---|---|---|
| ID433 | FANCF site 2 | AAAAUUUCUGCUAUUGCAGAUAAGCACUACCUACGUCAGCACCU (SEQ ID NO: 707) |

TABLE Ex 12.5

Full cassette sequences used in Example 12

| Cas12a nuclease | Target | Full cassette sequence |
|---|---|---|
| ID409 | DNMT1 site 2 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCTAAATTTCTACTATTGTAGATAGCAGGCACCTGCCTCAGCTGCTGGCCGGCATGGTCCCAGCCTCCTCGCTGGCGCCGGCTGGGCAACATGCTTCGGCATGGCGAATGGGAC (SEQ ID NO: 708) |
| ID409 | DNMT1 site 3 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCTAAATTTCTACTATTGTAGATAGGCGGGTCACCTACCCACGTTCGGCCGGCATGGTCCCAGCCTCCTCGCTGGCGCCGGCTGGGCAACATGCTTCGGCATGGCGAATGGGAC (SEQ ID NO: 709) |
| ID428 | DNMT1 site 3 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCTAAATTTCTACTATTGTAGATAGGCGGGTCACCTACCCACGTTCGGCCGGCATGGTCCCAGCCTCCTCGCTGGCGCCGGCTGGGCAACATGCTTCGGCATGGCGAATGGGAC (SEQ ID NO: 710) |
| ID428 | DNMT1 site 2 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCTAAATTTCTACTATTGTAGATAGCAGGCACCTGCCTCAGCTGCTGGCCGGCATGGTCCCAGCCTCCTCGCTGGCGCCGGCTGGGCAACATGCTTCGGCATGGCGAATGGGAC (SEQ ID NO: 711) |
| ID433 | DNMT1 site 2 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCAAAATTTCTGCTATTGCAGATAGCAGGCACCTGCCTCAGCTGCTGGCCGGCATGGTCCCAGCCTCCTCGCTGGCGCCGGCTGGGCAACATGCTTCGGCATGGCGAATGGGAC (SEQ ID NO: 712) |
| ID433 | DNMT1 site 3 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCAAAATTTCTGCTATTGCAGATAGGCGGGTCACCTACCCACGTTCGGCCGGCATGGTCCCAGCCTCCTCGCTGGCGCCGGCTGGGCAACATGCTTCGGCATGGCGAATGGGAC (SEQ ID NO: 713) |
| ID409 | SCN1A site 1 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCTAAATTTCTACTATTGTAGATTGGTGAAGAAGTTGAAGCTGTCAGGCCGGCATGGTCCCAGCCTCCTCGCTGGCGCCGGCTGGGCAACATGCTTCGGCATGGCGAATGGGAC (SEQ ID NO: 714) |
| ID409 | SCN1A site 2 | AAGGTCGGGCAGGAAGAGGGCCTATTTCCCATGATTCCTTCATATTTGCATATACGATACAAGGCTGTTAGAGAGATAATTAGAATTAATTTGACTGTAAACACAAAGATATTAGTACAAAATACGTGACGTAGAAAGTAATAATTTCTTGGGTAGTTTGCAGTTTTAAAATTATGTTTTAAAATGGACTATCATATGCTTACCGTAACTTGAAAGTATTTCGATTTCTTGGCTTTATATATCTTGTGGAAAGGACGAAACACCTAAATTTCTACTATTGTAGATC |

TABLE Ex 12.5-continued

Full cassette sequences used in Example 12

| Cas12a nuclease | Target | Full cassette sequence |
|---|---|---|
| | | ATCTTGTCATCCTGCACATTTTGGCCGGCATGGTCCCAGCCTCCTCGCTGGCGCCGG<br>CTGGGCAACATGCTTCGGCATGGCGAATGGGAC (SEQ ID NO: 715) |
| ID428 | SCN1A site 1 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCTAAATTTCTACTATTGTAGATT<br>GGTGAAGAAGTTGAAGCTGTCAGGCCGGCATGGTCCCAGCCTCCTCGCTGGCGCC<br>GGCTGGGCAACATGCTTCGGCATGGCGAATGGGAC (SEQ ID NO: 716) |
| ID428 | SCN1A site 2 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCTAAATTTCTACTATTGTAGATC<br>ATCTTGTCATCCTGCACATTTTGGCCGGCATGGTCCCAGCCTCCTCGCTGGCGCCGG<br>CTGGGCAACATGCTTCGGCATGGCGAATGGGAC (SEQ ID NO: 717) |
| ID433 | SCN1A site 1 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCAAAATTTCTGCTATTGCAGATT<br>GGTGAAGAAGTTGAAGCTGTCAGGCCGGCATGGTCCCAGCCTCCTCGCTGGCGCC<br>GGCTGGGCAACATGCTTCGGCATGGCGAATGGGAC (SEQ ID NO: 718) |
| ID433 | SCN1A site 2 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCAAAATTTCTGCTATTGCAGATC<br>ATCTTGTCATCCTGCACATTTTGGCCGGCATGGTCCCAGCCTCCTCGCTGGCGCCGG<br>CTGGGCAACATGCTTCGGCATGGCGAATGGGAC (SEQ ID NO: 719) |
| ID409 | FANCF site 2 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCTAAATTTCTACTATTGTAGATA<br>AGCACTACCTACGTCAGCACCTGGCCGGCATGGTCCCAGCCTCCTCGCTGGCGCCG<br>GCTGGGCAACATGCTTCGGCATGGCGAATGGGAC (SEQ ID NO: 720) |
| ID428 | FANCF site 2 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCTAAATTTCTACTATTGTAGATA<br>AGCACTACCTACGTCAGCACCTGGCCGGCATGGTCCCAGCCTCCTCGCTGGCGCCG<br>GCTGGGCAACATGCTTCGGCATGGCGAATGGGAC (SEQ ID NO: 721) |
| ID433 | FANCF site 2 | AAGGTCGGGCAGGAAGAGGGCCTATTTCCCATGATTCCTTCATATTTGCATATACGA<br>TACAAGGCTGTTAGAGAGATAATTAGAATTAATTTGACTGTAAACACAAAGATATTA<br>GTACAAAATACGTGACGTAGAAAGTAATAATTTCTTGGGTAGTTTGCAGTTTTAAAA<br>TTATGTTTTAAAATGGACTATCATATGCTTACCGTAACTTGAAAGTATTTCGATTTCT<br>TGGCTTTATATATCTTGTGGAAAGGACGAAACACCAAAATTTCTGCTATTGCAGATA<br>AGCACTACCTACGTCAGCACCTGGCCGGCATGGTCCCAGCCTCCTCGCTGGCGCCG<br>GCTGGGCAACATGCTTCGGCATGGCGAATGGGAC (SEQ ID NO: 722) |

Example 13. Cas12a Mutagenesis and Evaluation of Mutant Editing Performance

In this Example, three Cas12a nucleases (ID405 (SEQ TD NO: 334), ID414 (SEQ TD NO: 58), and ID418 (SEQ TD NO: 564)) were selected for mutagenesis and further testing to determine the effects of the mutations on the performance of the enzymes. It is contemplated that any of the mutations introduced herein could be introduced in other Cas12a orthologs disclosed herein at corresponding residue positions as determined by sequence and/or structural alignments.

Mutagenesis

Targeted mutagenesis was used to mutagenize ID405, ID414, and ID418 nucleases in order to improve their editing efficiency in eukaryotic cells.

In order to conduct the targeted mutagenesis approach, literature analysis was performed on the topic of Cas12a mutagenesis and amino acid mutations which resulted in increased genome editing activity in reported Cas12a family members. Protein structures were predicted using Alphafold2 and compared with experimentally determined Cas112a protein structures in complex with nucleic acids available in RCSB Protein Data Bank (PDB) database. The results of literature analysis and structural data analysis were used to generate a list of mutations to test in ID405, ID414 and ID418 orthologs (Table S513.1). Targeted mutagenesis was performed by inserting synthetic gene fragments (Twist Bioscience) containing the DNA sequence which codes for the mutated amino acid using NEBuilder® HiFi DNA Assembly kit (New England Biolabs) according to the manufacturer's instructions. The mutated DNA and protein sequences are available in supplementary file (see tab "Mutant gene and protein sequences").

TABLE S13.1

ID405, ID414 and ID418 amino acid targets for mutagenesis

| Protein ID | Mutated residue(s) | Nucleotide sequence | Amino acid sequence | Ref* |
|---|---|---|---|---|
| 405-1 | D169R | SEQ ID NO: 566 | SEQ ID NO: 585 | 1 |
| 405-2 | D169R/R950K/R954A | SEQ ID NO: 567 | SEQ ID NO: 586 | 2 |
| 405-3 | D169R/N559R/Q565R | SEQ ID NO: 568 | SEQ ID NO: 587 | 3 |
| 405-4 | C554R | SEQ ID NO: 569 | SEQ ID NO: 588 | 4 |
| 405-5 | C554N | SEQ ID NO: 570 | SEQ ID NO: 589 | 4 |
| 405-6 | L860Q | SEQ ID NO: 571 | SEQ ID NO: 590 | 4 |
| 414-1 | T154R | SEQ ID NO: 572 | SEQ ID NO: 591 | 1 |
| 414-2 | T154R/R887K/R891A | SEQ ID NO: 573 | SEQ ID NO: 592 | 2 |
| 414-3 | T154R/G536R/K542R | SEQ ID NO: 574 | SEQ ID NO: 593 | 3 |
| 141-4 | N531R/S802L | SEQ ID NO: 575 | SEQ ID NO: 594 | 4 |
| 414-5 | N531R | SEQ ID NO: 576 | SEQ ID NO: 595 | 4 |
| 414-6 | S802L | SEQ ID NO: 577 | SEQ ID NO: 596 | 4 |
| 418-1 | D161R | SEQ ID NO: 578 | SEQ ID NO: 597 | 1 |
| 418-2 | D161R/R888K/R892A | SEQ ID NO: 579 | SEQ ID NO: 598 | 2 |
| 418-3 | D161R/T532R/K538R | SEQ ID NO: 580 | SEQ ID NO: 599 | 3 |
| 418-4 | N527R/Q799L | SEQ ID NO: 581 | SEQ ID NO: 600 | 4 |
| 418-5 | N527R | SEQ ID NO: 582 | SEQ ID NO: 601 | 4 |
| 418-6 | Q799L | SEQ ID NO: 583 | SEQ ID NO: 602 | 4 |

*Reference list of publications used for selecting amino acids for targeted mutagenesis:

Schindele, P., & Puchta, H. (2020). Engineering CRISPR/LbCas12a for highly efficient, temperature-tolerant plant gene editing. *Plant biotechnology journal*, 18(5), 1118-1120.

Huang, H., Huang, G., Tan, Z., Hu, Y., Shan, L., Zhou, J., Zhang, X., Ma, S., Lv, W., Huang, T., Liu, Y., Wang, D., Zhao, X., Lin, Y., & Rong, Z. (2022). Engineered Cas12a-Plus nuclease enables gene editing with enhanced activity and specificity. *BMC biology*, 20(1), 91.

Kleinstiver, B. P., Sousa, A. A., Walton, R. T., Tak, Y. E., Hsu, J. Y., Clement, K., Welch, M. M., Horng, J. E., Malagon-Lopez, J., Scarfo, I., Maus, M. V., Pinello, L., Aryee, M. J., & Joung, J. K. (2019). Engineered CRISPR-Cas12a variants with increased activities and improved targeting ranges for gene, epigenetic and base editing. *Nature biotechnology*, 37(3), 276-282.

Zhang, L., Zuris, J. A., Viswanathan, R., Edelstein, J. N., Turk, R., Thommandru, B., Rube, H. T., Glenn, S. E., Collingwood, M. A., Bode, N. M., Beaudoin, S. F., Lele, S., Scott, S. N., Wasko, K. M., Sexton, S., Borges, C. M., Schubert, M. S., Kurgan, G. L., McNeill, M. S., Fernandez, C. A., Myer, V. E, Morgan, R. A, Behlke, M. A., Vakulskas, C. A. (2021). AsCas12a ultra nuclease facilitates the rapid generation of therapeutic cell medicines. *Nature communications*, 12(1), 3908.

Measuring Editing Efficiency of Mutant Cas12a Nucleases

To determine gene editing efficiencies of mutant Cas12a proteins of Table S13.1, the Human embryonic kidney (HEK) cell line 293T (ATCC-CRL-3216) was transfected with mRNA of each mutant Cas12a nuclease of Table S13.1 and a corresponding crRNA of one of five targets (BCL11a, HBG1, PCSK9, CISH, and TTR) as provided in Table S13.2. The mRNA transfection experiments, and activity determination were performed as described below.

TABLE S13.2 crRNA sequences for mutant Cas12a nucleases of Table S13.1

| Cas12a nuclease | Target | CRNA sequence |
|---|---|---|
| LbaCas12a | BCL11a | UAAUUUCUACUAAGUGUAGAUAAGCUAGUCUAGUGCAAGCUAAC (SEQ ID NO: 723) |
| ID405 | BCL11a | UGAAUUUCUACUGUUGUAGAUAAGCUAGUCUAGUGCAAGCUAAC (SEQ ID NO: 724) |
| ID414 | BCL11a | AUAAUUUCUACUGUUGUAGAUAAGCUAGUCUAGUGCAAGCUAAC (SEQ ID NO: 725) |
| ID418 | BCL11a | UAAAUUUCUACUAUUGUAGAUAAGCUAGUCUAGUGCAAGCUAAC (SEQ ID NO: 726) |
| LbaCas12a | CISH | UAAUUUCUACUAAGUGUAGAUACUGACAGCGUGAACAGGUAG (SEQ ID NO: 727) |
| ID405 | CISH | UGAAUUUCUACUGUUGUAGAUACUGACAGCGUGAACAGGUAG (SEQ ID NO: 728) |
| ID414 | CISH | AUAAUUUCUACUGUUGUAGAUACUGACAGCGUGAACAGGUAG (SEQ ID NO: 729) |
| ID418 | CISH | UAAAUUUCUACUAUUGUAGAUACUGACAGCGUGAACAGGUAG (SEQ ID NO: 730) |
| LbaCas12a | HBG1 | UAAUUUCUACUAAGUGUAGAUCCUUGUCAAGGCUAUUGGUCAAG (SEQ ID NO: 731) |

TABLE S13.2-continued crRNA sequences for mutant Cas12a nucleases of Table S13.1

| Cas12a nuclease | Target | CRNA sequence |
|---|---|---|
| ID405 | HBG1 | UGAAUUUCUACUGUUGUAGAUCCUUGUCAAGGCUAUUGGU CAAG (SEQ ID NO: 732) |
| ID414 | HBG1 | AUAAUUUCUACUGUUGUAGAUCCUUGUCAAGGCUAUUGGU CAAG (SEQ ID NO: 733) |
| ID418 | HBG1 | UAAAUUUCUACUAUUGUAGAUCCUUGUCAAGGCUAUUGGU CAAG (SEQ ID NO: 734) |
| LbaCas12a | PCSK9 | UAAUUUCUACUAAGUGUAGAUGCAGAGAAGUGGAUCAGUC UCUG (SEQ ID NO: 735) |
| ID405 | PCSK9 | UGAAUUUCUACUGUUGUAGAUGCAGAGAAGUGGAUCAGUC UCUG (SEQ ID NO: 736) |
| ID414 | PCSK9 | AUAAUUUCUACUGUUGUAGAUGCAGAGAAGUGGAUCAGUC UCUG (SEQ ID NO: 737) |
| ID418 | PCSK9 | UAAAUUUCUACUAUUGUAGAUGCAGAGAAGUGGAUCAGUC UCUG (SEQ ID NO: 738) |
| LbaCas12a | TTR | UAAUUUCUACUAAGUGUAGAUACCAUCAGAGGACACUUGG AUUC (SEQ ID NO: 739) |
| ID405 | TTR | UGAAUUUCUACUGUUGUAGAUACCAUCAGAGGACACUUGG AUUC (SEQ ID NO: 740) |
| ID414 | TTR | AUAAUUUCUACUGUUGUAGAUACCAUCAGAGGACACUUGG AUUC (SEQ ID NO: 741) |
| ID418 | TTR | UAAAUUUCUACUAUUGUAGAUACCAUCAGAGGACACUUGG AUUC (SEQ ID NO: 742) |

Cas12a mRNA Synthesis for Transfection Experiments

2 µg of each plasmid was linearized using suitable restriction endonuclease that does not have a recognition site inside the target gene and generates either a blunt end or a 5' protruding end. Digestion products were then purified using Monarch PCR & DNA Cleanup Kit (New England Biolabs), concentrations measured using spectrophotometry (NanoPhotometer® NP80, IMPLEN). Approximately 1 µg of each purified linearized plasmid was then used as a template for in vitro transcription reaction performed using HiScribe® T7 mRNA Kit with CleanCap® Reagent AG (New England Biolabs). In vitro transcription reaction was run for 2 hours at 37° C. After this step, IVT reaction product was purified using the RNeasy Micro Kit (Qiagen). Part of the purified samples were set aside to assess their quality. The whole volume of the eluate from the purification step was then used in poly(A) tail addition reaction which was performed using E. coli Poly(A) Polymerase (New England Biolabs). After poly(A) tailing, reaction products were purified using the RNeasy Micro Kit (Qiagen), sample concentrations were measured using spectrophotometry (NanoPhotometer® NP80, IMPLEN) and fluorimetry (Qubit RNA Broad Range Assay Kit and Qubit 4, Thermo Fisher Scientific). mRNA integrity was assessed by performing gel electrophoresis using E-Gel Electrophoresis System (Invitrogen). Synthesized mRNA was aliquoted and kept at −80° C. until use.

mRNA Transfection Experiments

To determine whether Cas12a orthologs can be delivered into HEK293T cells as mRNA, five targets in clinically important genes were selected. Synthetic crRNAs against each gene were designed and obtained (Table S13.2).

As controls, S. pyogenes Cas9 (SpyCas9) and Cas9 target genes (BCL11a, CISH, HBG1, PCSK9, and TTR), along with synthetic sgRNA (Syntego) (Table S13.3) were used to measure editing efficiency. Commercially available SpCas9 mRNA (TriLink) and in vitro transcribed SpCas9 mRNA were used as positive controls. In the case of Cas12a orthologs, in vitro transcribed mRNA was used for all experiments. mRNA sequences are provided in Section K, subsection P.3.

TABLE S13.3

Sequences of synthetic Cas9 sgRNAs used for RNA transfections as a part of SpyCas9 controls.

| Target gene | Cas9 sgRNA sequences for SpyCas9 controls |
|---|---|
| BCL11a | AAAGGCUGCUGAUGACACCUGUUUUAGAGCUAGAAAUAGCAAGUUA AAAUAAGGCUAGUCCGUUAUCAACUUGAAAAAGUGGCACCGAGUCG GUGCUUU (SEQ ID NO: 743) |

TABLE S13.3-continued

Sequences of synthetic Cas9 sgRNAs used for RNA transfections as a part of SpyCas9 controls.

| Target gene | Cas9 sgRNA sequences for SpyCas9 controls |
|---|---|
| CISH | CTAACAGTTGCTTTTATCACGUUUUAGAGCUAGAAAUAGCAAGUUAA AAUAAGGCUAGUCCGUUAUCAACUUGAAAAAGUGGCACCGAGUCGG UGCUUU (SEQ ID NO: 744) |
| HBG1 | CTTGTCAAGGCTATTGGTCAGUUUUAGAGCUAGAAAUAGCAAGUUAA AAUAAGGCUAGUCCGUUAUCAACUUGAAAAAGUGGCACCGAGUCGG UGCUUU (SEQ ID NO: 745) |
| PCSK9 | CAGGATCGGGGCTGTCGCTTGUUUUAGAGCUAGAAAUAGCAAGUUAA AAUAAGGCUAGUCCGUUAUCAACUUGAAAAAGUGGCACCGAGUCGG UGCUUU (SEQ ID NO: 746) |
| TTR | GGCCTCATTGATGACATCTTGUUUUAGAGCUAGAAAUAGCAAGUUAA AAUAAGGCUAGUCCGUUAUCAACUUGAAAAAGUGGCACCGAGUCGG UGCUUU (SEQ ID NO: 747) |

The transfections were conducted as follows. HEK293T cells were maintained in Dulbecco's modified Eagle's Medium (DMEM) with GlutaMAX (Thermo Fisher Scientific), supplemented with 10% fetal bovine serum (Thermo Fisher Scientific) and 10,000 units/mL penicillin, and 10,000 g/mL streptomycin (Thermo Fisher Scientific) at 37° C. with 5% CO2 incubation. HEK293T cells were seeded into 96-well plates (Thermo Fisher Scientific) one day prior to transfection at a density of 18,000 cells per well. Cells were transfected using Lipofectamine MessengerMAX Transfection Reagent (Invitrogen) following the manufacturer's recommended protocol. For each well of a 96-well plate a total amount of 100 ng RNA was used. This total amount consists of mRNA and crRNA in a ratio of 1:5. Cells were incubated at 37° C. for 72 hours post transfection in 5% CO2 before genomic DNA extraction. The cells were washed twice with 200 µl 1×DPBS (Thermo Fisher Scientific) and resuspended in 25 µl 50 mM Tris-HCl, 150 mM NaCl, 0.05% Tween 20, pH 7.6 (Sigma Aldrich) and 0.2 mg/ml Proteinase K (New England Biolabs) lysis buffer. Resuspended cells were incubated at 55° C. for 60 minutes and 95° C. for 15 minutes. The genomic region surrounding each Cas12a target site was PCR amplified using primers defined in Table S13.4. PCR amplification was performed using Q5 Hot Start High-Fidelity 2× Master Mix (New England Biolabs) according to the manufacturer's instructions. The reaction was set up using 1 µl of the cell lysate and 0.5 µM of each primer in a final reaction volume of 25 ul.

TABLE S13.4

Primer sequences used for target amplification in T7 Endonuclease I assay.

| Target | Primer | Primer sequence 5'→3' |
|---|---|---|
| BCL11a | BCL11a_dir | AGGAAGGCAGCTAGACAGGA (SEQ ID NO: 748) |
| BCL11a | BCL11a_rev | GGACAGCCCGACAGATGAAA (SEQ ID NO: 749) |
| CISH | CISH_dir | GAGAGGCACAGCCCTCTCTA (SEQ ID NO: 750) |
| CISH | CISH_rev | CAGTGGCAGGCAGTCCACGT (SEQ ID NO: 751) |
| HBG1 | HBG1_dir | CTCTATGATGGGAGAAGGAAACTAGCT (SEQ ID NO: 752) |
| HBG1 | HBG1_rev | GGACAGGTTGCCAAAGCTGTCAAAG (SEQ ID NO: 753) |
| PCSK9 | PCSK9_dir | GAAGGCATCTTGGAGGAGGG (SEQ ID NO: 754) |
| PCSK9 | PCSK9_rev | CCCTTTCAGAGCCCCATTCT (SEQ ID NO: 755) |
| TTR | TTR_dir | GGGATCAGTGTGTAATTCTTGTTTCG (SEQ ID NO: 756) |
| TTR | TTR_rev | GTGTTCTGTGACCCAAAAGGGTTGC (SEQ ID NO: 757) |

Genome Editing Frequency Estimates

Figure 26:
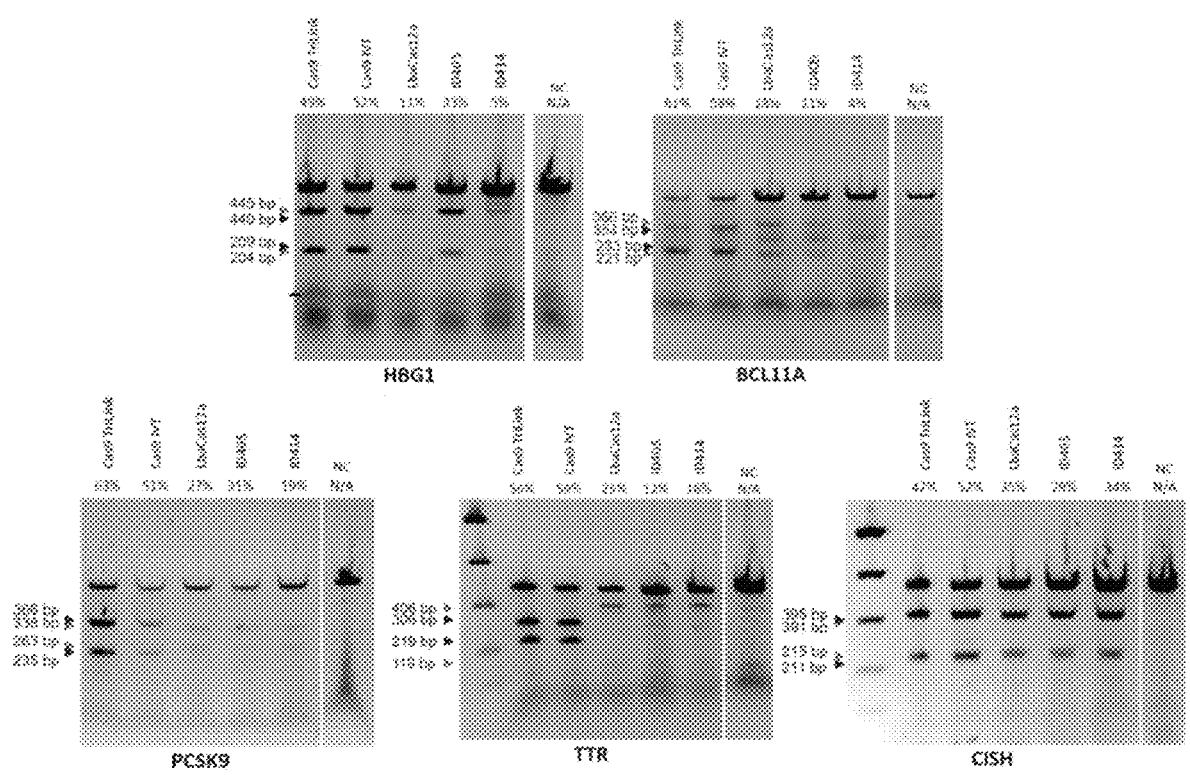
FIG. 26 Endonuclease activity comparison between SpyCas9, LbaCas12a, ID405, and ID414. Cas9 TriLink mRNA was synthesized by TriLink; Cas9 IVT, LbaCas12a, ID405, and ID414 mRNAs were synthesized in-house via in vitro transcription reaction. Blue arrows mark cleavage products of LbaCas12a, ID405, and ID414 nucleases; black arrows mark cleavage products of SpyCas9 nucleases. Percentages above each gel well show the editing number determined from the gel using ImageJ software. See Example 13 for further details.
Figure 27:
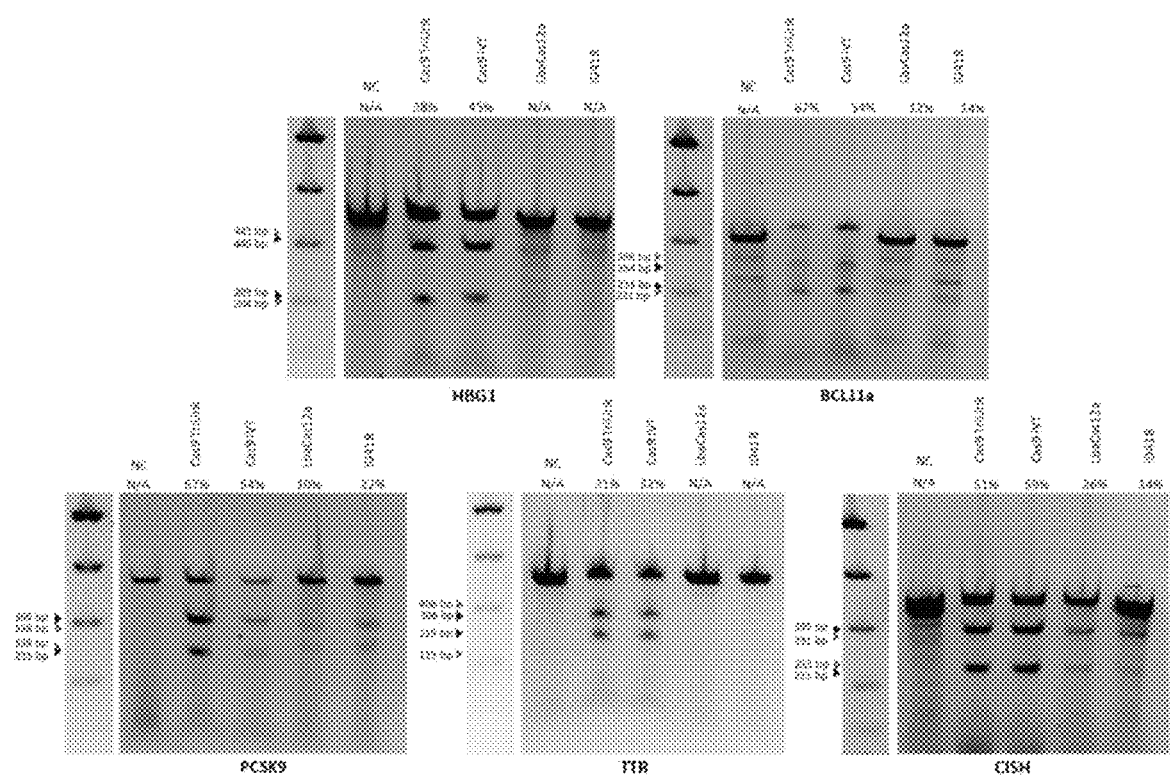
FIG. 27 Endonuclease activity comparison between SpyCas9, LbaCas12a, and ID418. Cas9 TriLink mRNA was synthesized by TriLink; Cas9 IVT, LbaCas12a, and ID418 mRNAs were synthesized in-house via in vitro transcription reaction. Blue arrows mark cleavage products of LbaCas12a and ID418 nucleases; black arrows mark cleavage products of SpyCas9 nucleases. Percentages above each gel well show the editing number determined from the gel using ImageJ software. See Example 13 for further details.

Genome editing frequencies were estimated using T7 Endonuclease I assays. 25 µL of each PCR reaction was combined with 3 µL NEBuffer 2 (New England Biolabs) and 7 µL of water before denaturation at 95° C. for 5 minutes and re-annealing by temperature ramping from 95-85° C. at −2° C./s followed by ramping from 85-25° C. at −0.1° C./s. 1 µL of T7 Endonuclease I (New England Biolabs) was added to each re-annealed sample and cleavage reactions were incubated at 37° C. for 20 min. Fragments were analyzed by performing gel electrophoresis using E-Gel Precast Agarose Gel Electrophoresis system (Invitrogen). 2% gel with Ethidium bromide dye was used. 8 µL of each sample was mixed with 7 µL of E-Gel Sample Loading Buffer (Invitrogen) and the whole volume was loaded to the well. Genomic target cleavage percentage was calculated using ImageJ software. FIG. 26 and FIG. 27 demonstrate the editing efficiencies of LbaCas12a, ID405, ID414, and ID 418 proteins as compared to SpCas9 mRNA transfection.

Editing Efficiency Results

FIG. 26 and FIG. 27 demonstrate the editing efficiencies of LbaCas12a, ID405, ID414 and ID 418 proteins as compared to SpCas9 mRNA transfection.

As shown in FIG. 26, endonuclease activity is compared among SpyCas9 (control), LbaCas12a (control), ID405, and ID414. Cas9 TriLink mRNA was synthesized by TriLink; Cas9 IVT, LbaCas12a, ID405, and ID414 mRNAs were synthesized in-house via in vitro transcription reaction. Arrows mark cleavage products of LbaCas12a, ID405, and ID414 nucleases; arrows mark cleavage products of Spy-Cas9 nucleases. Percentages above each gel well show the editing number determined from the gel using ImageJ software.

As shown in FIG. 27, endonuclease activity is compared among SpyCas9 (control), LbaCas12a (control), and ID418. Cas9 TriLink mRNA was synthesized by TriLink; Cas9 IVT, LbaCas12a, and ID418 mRNAs were synthesized in-house via in vitro transcription reaction. Arrows mark cleavage products of LbaCas12a and ID418 nucleases; arrows mark cleavage products of SpyCas9 nucleases. Percentages above each gel well show the editing number determined from the gel using ImageJ software.

Figure 28A:
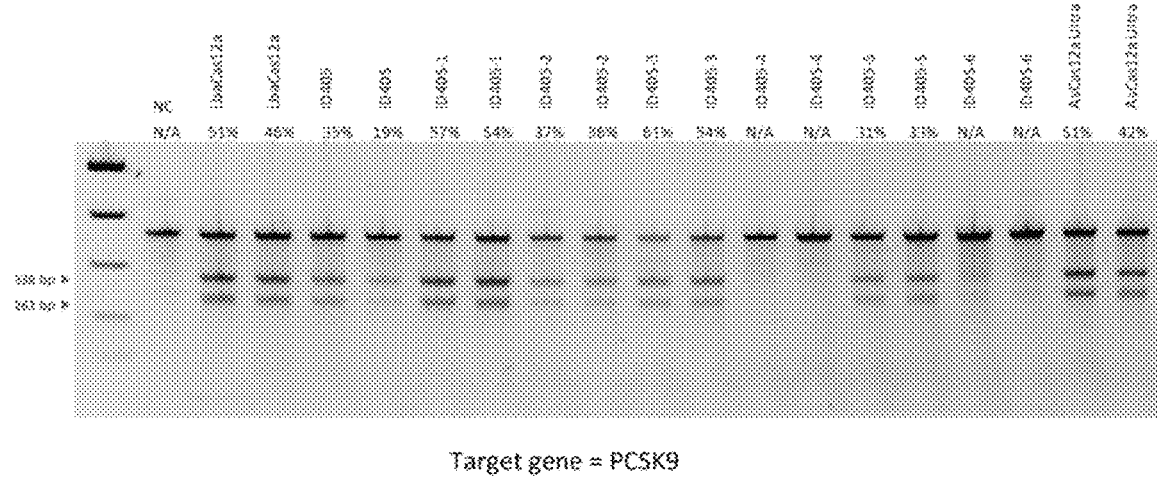
FIG. 28A Cleavage products of genomic target PCSK9 visualized on 2% agarose gel in the presence of various ID405 mutants. Editing efficiency values indicated above gel wells for LbaCas12a and each ID405 mutant were calculated using ImageJ software. See Example 13 for further details.
Figure 28B:
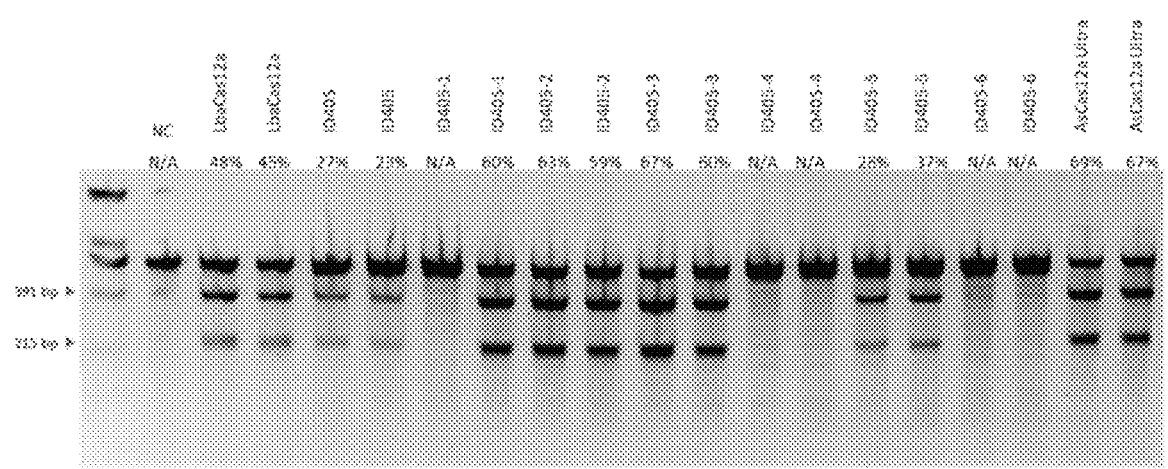
FIG. 28B Cleavage products of genomic target CISH visualized on 2% agarose gel in the presence of various ID405 mutants. Editing efficiency values indicated above gel wells for LbaCas12a and each ID405 mutant were calculated using ImageJ software. See Example 13 for further details.
Figure 28C:
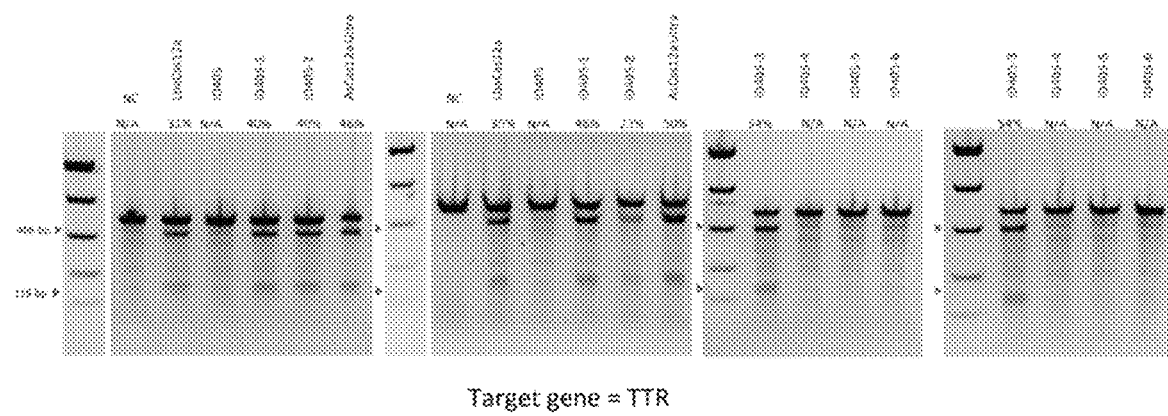
FIG. 28C Cleavage products of genomic target TTR visualized on 2% agarose gel in the presence of various ID405 mutants. Editing efficiency values indicated above gel wells for LbaCas12a and each ID405 mutant were calculated using ImageJ software. See Example 13 for further details.
Figure 28D:
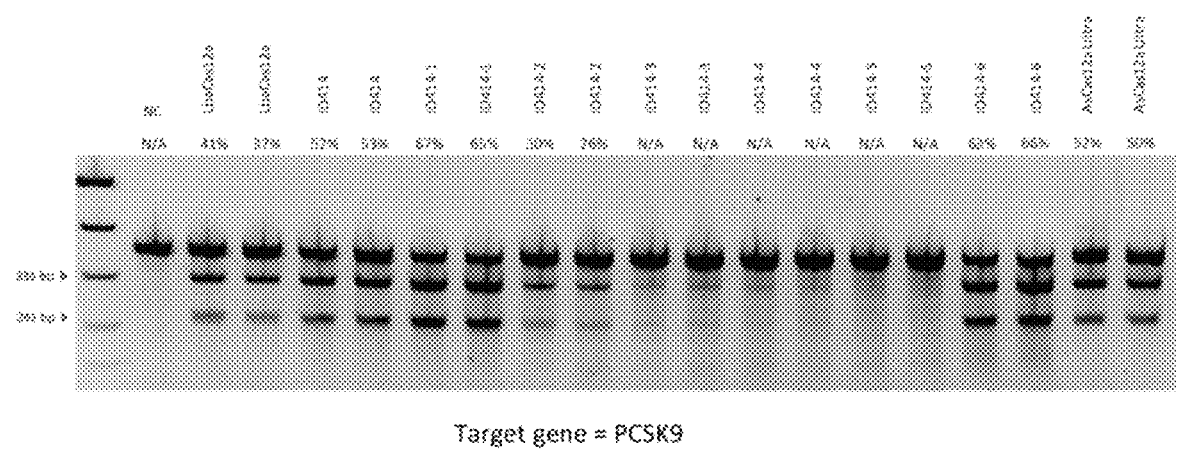
FIG. 28D Cleavage products of genomic target PCSK9 visualized on 2% agarose gel in the presence of various ID414 mutants. Editing efficiency values indicated above gel wells for LbaCas12a and each ID414 mutant were calculated using ImageJ software. See Example 13 for further details.
Figure 28E:
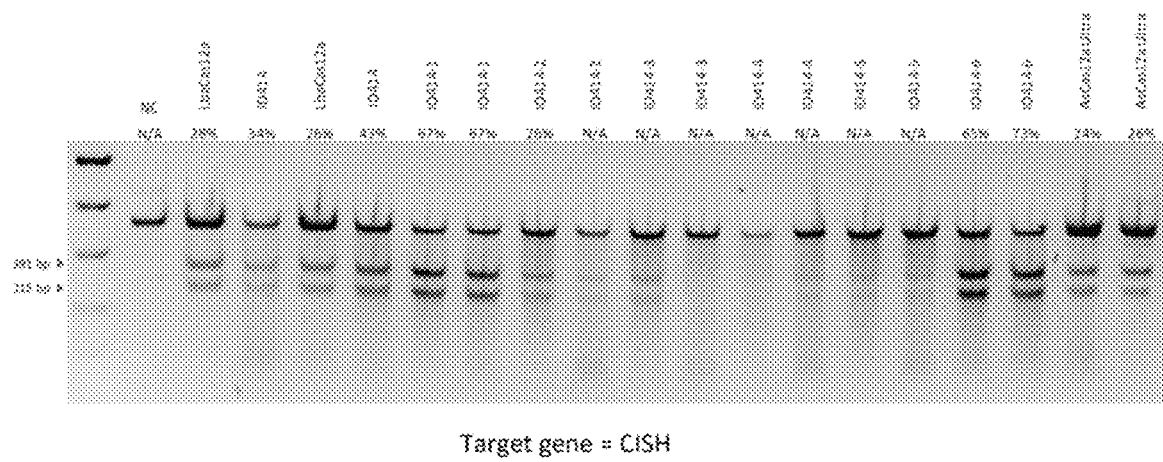
FIG. 28E Cleavage products of genomic target CISH visualized on 2% agarose gel in the presence of various ID414 mutants. Editing efficiency values indicated above gel wells for LbaCas12a and each ID414 mutant were calculated using ImageJ software. See Example 13 for further details.
Figure 28F:
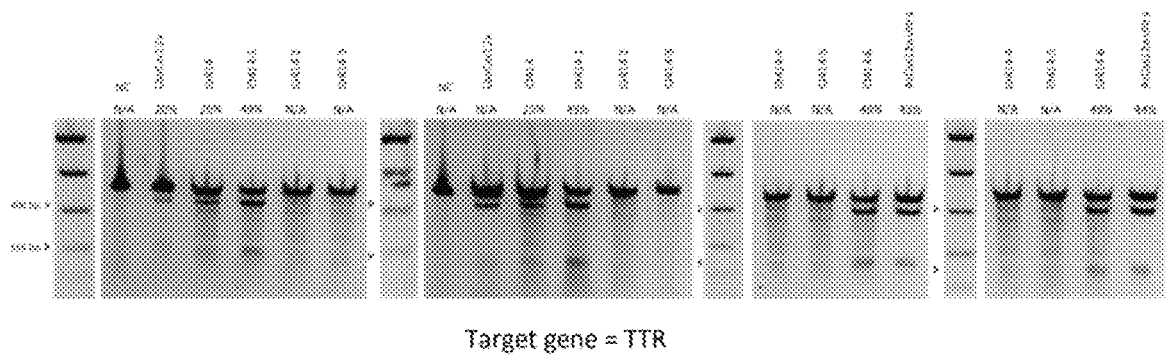
FIG. 28F Cleavage products of genomic target TTR visualized on 2% agarose gel in the presence of various ID414 mutants. Editing efficiency values indicated above gel wells for LbaCas12a and each ID414 mutant were calculated using ImageJ software. See Example 13 for further details.
Figure 28G:
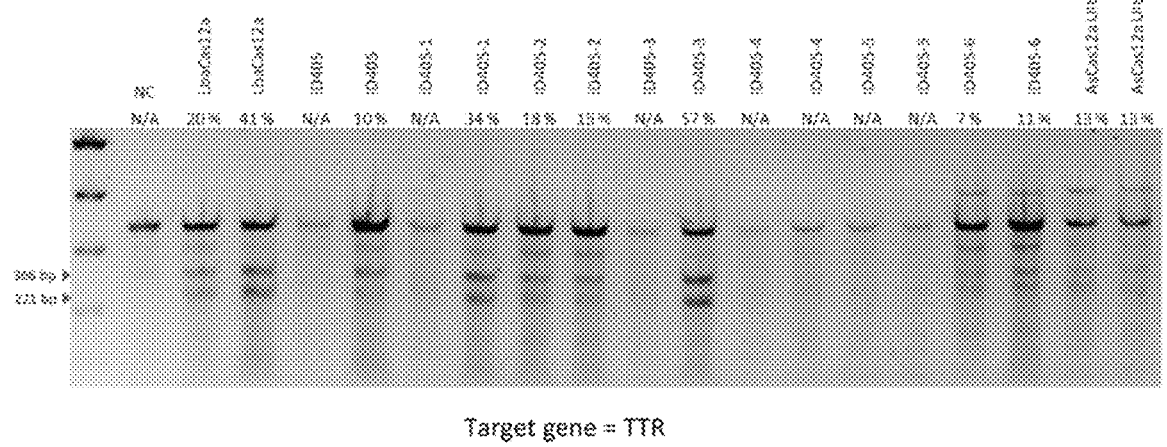
FIG. 28G Cleavage products of genomic target BCL11a visualized on 2% agarose gel in the presence of various ID405 mutants. Editing efficiency values for LbaCas12a and each ID405 mutant were calculated using ImageJ software.
Figure 28H:
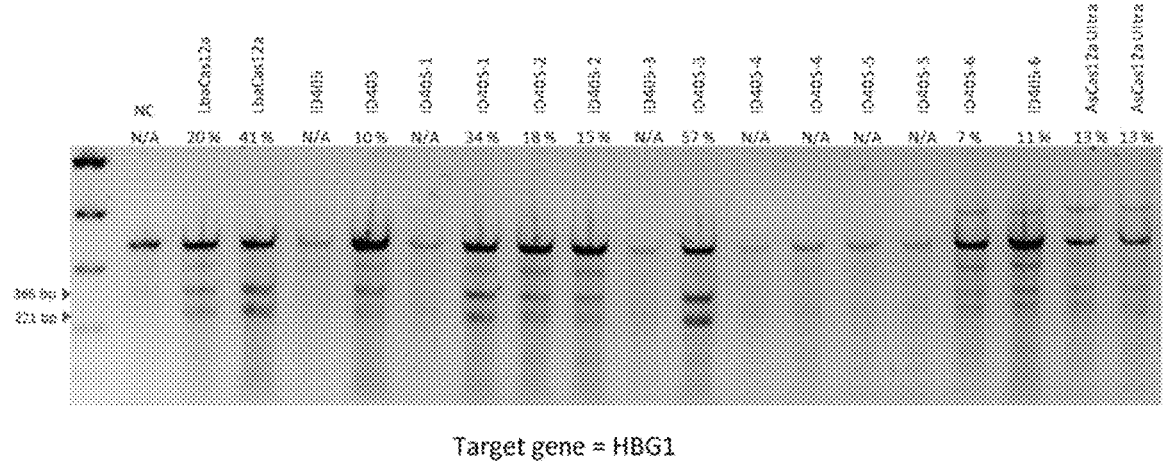
FIG. 28H Cleavage products of genomic target HBG1 visualized on 2% agarose gel in the presence of various ID405 mutants. Editing efficiency values for LbaCas12a and each ID405 mutant were calculated using ImageJ software.
Figure 28I:
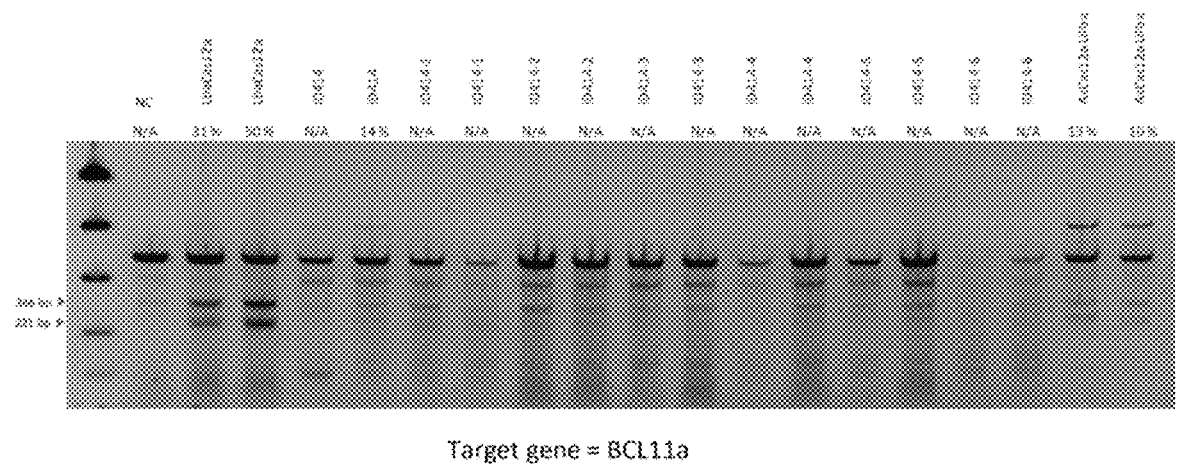
FIG. 28I Cleavage products of genomic target BCL11a visualized on 2% agarose gel in the presence of various ID414 mutants. Editing efficiency values for LbaCas12a and each ID414 mutant were calculated using ImageJ software.
Figure 28J:
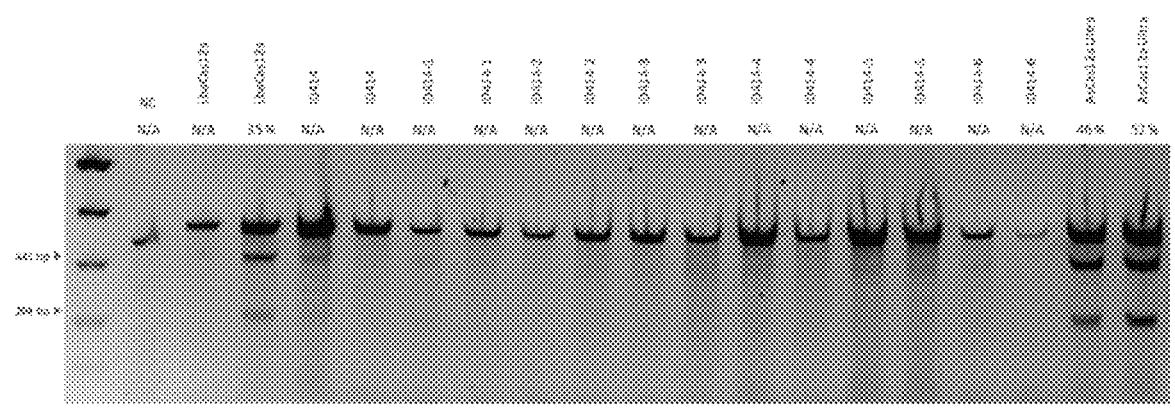
FIG. 28J Cleavage products of genomic target HBG1 visualized on 2% agarose gel in the presence of various ID414 mutants. Editing efficiency values for LbaCas12a and each ID414 mutant were calculated using ImageJ software.
Figure 28K:
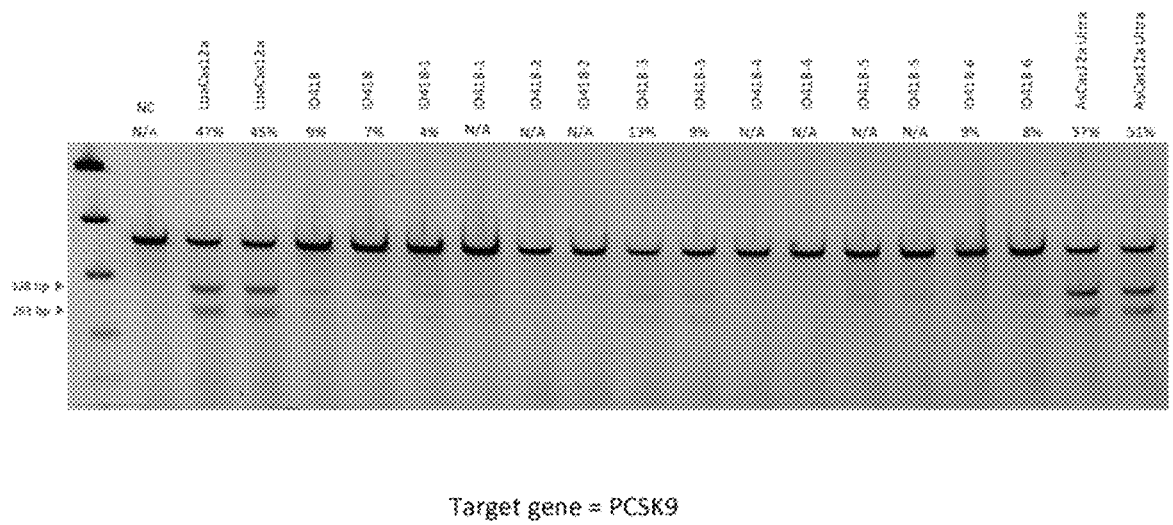
FIG. 28K Cleavage products of genomic target PCSK9 visualized on 2% agarose gel. Editing efficiency values for LbaCas12a and each ID418 mutant were calculated using ImageJ software.
Figure 28L:
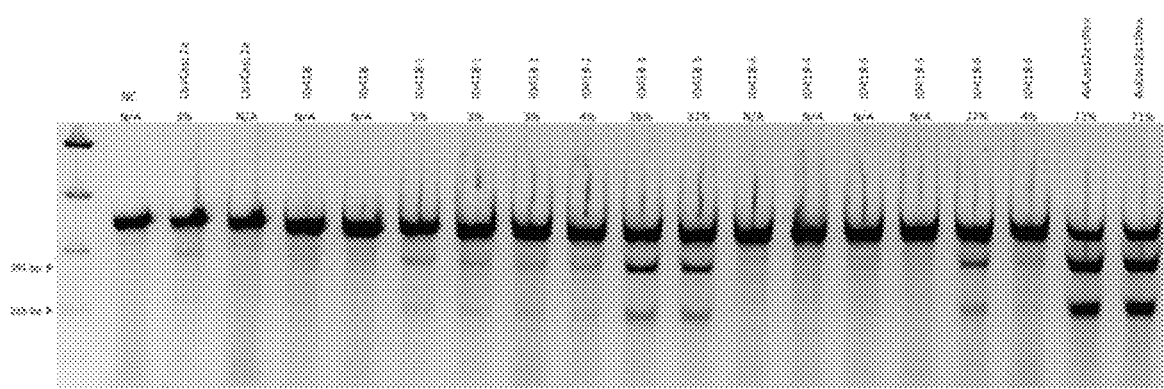
FIG. 28L Cleavage products of genomic target CISH visualized on 2% agarose gel in the presence of various ID418 mutants. Editing efficiency values for LbaCas12a and each ID418 mutant were calculated using ImageJ software.
Figure 28M:
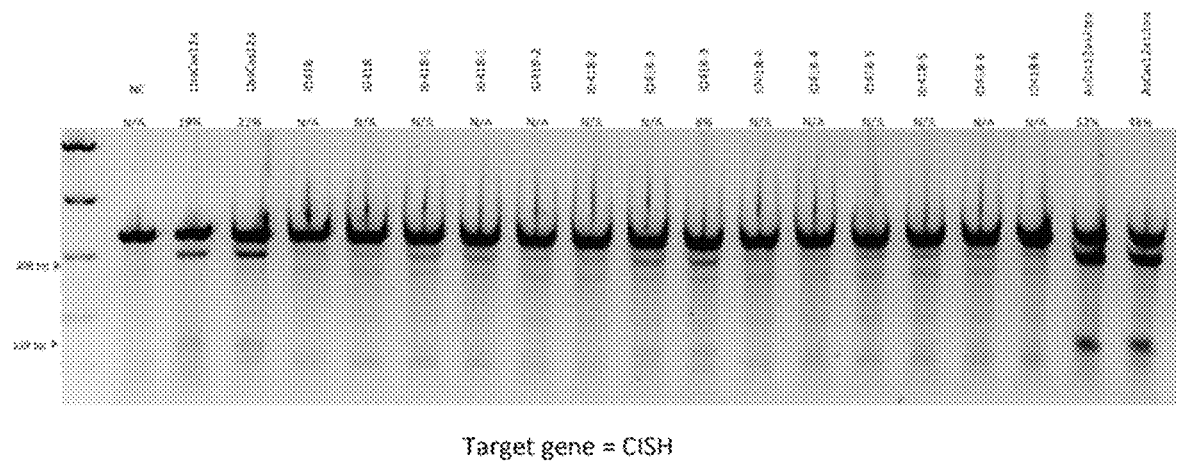
FIG. 28M Cleavage products of genomic target CISH visualized on 2% agarose gel in the presence of various ID418 mutants. Editing efficiency values for LbaCas12a and each ID418 mutant were calculated using ImageJ software.
Figure 28N:
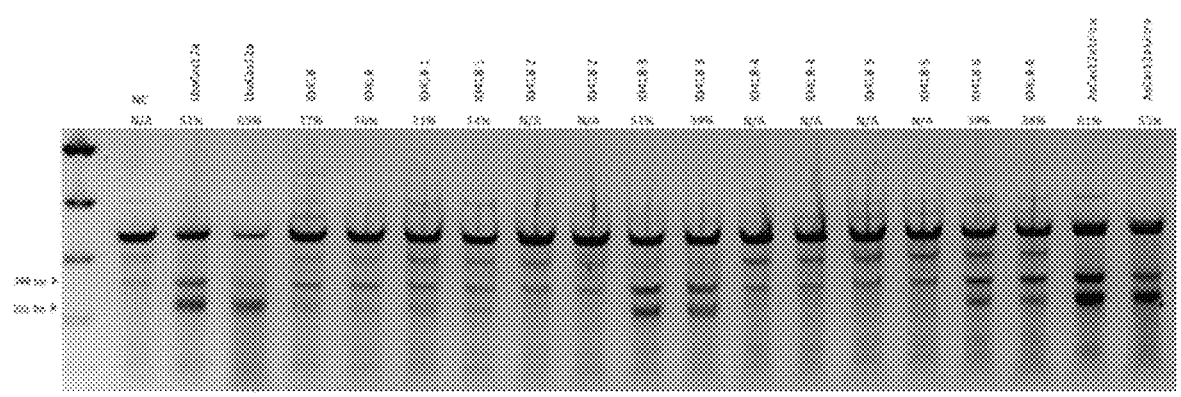
FIG. 28N Cleavage products of genomic target BCL11a visualized on 2% agarose gel in the presence of various ID418 mutants. Editing efficiency values for LbaCas12a and each ID418 mutant were calculated using ImageJ software.
Figure 28O:
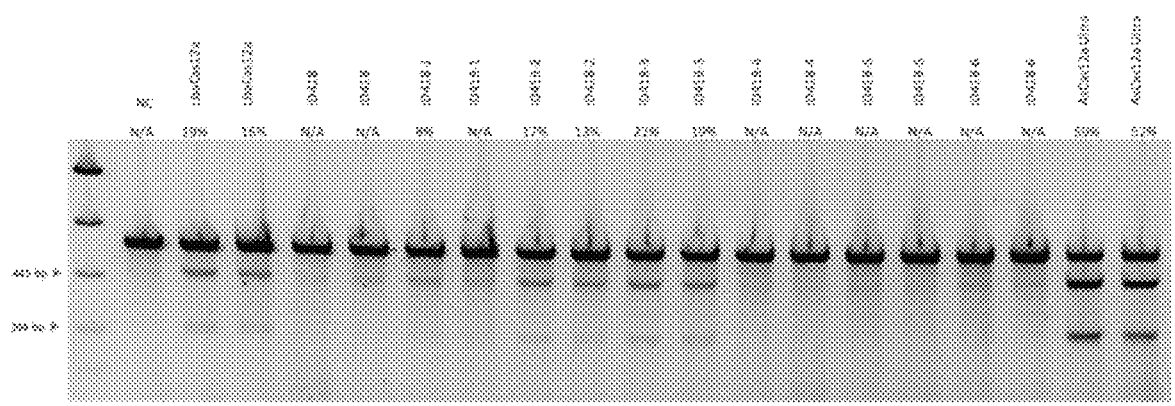
FIG. 28O Cleavage products of genomic target HBG1 visualized on 2% agarose gel in the presence of various ID418 mutants. Editing efficiency values for LbaCas12a and each ID418 mutant were calculated using ImageJ software.

FIGS. 28A-28O demonstrate the editing efficiencies of LbaCas12a, ID405, ID414, and ID418 mutant variants as compared to the editing efficiencies of WT Cas12a, LbaCas12a and AsCas12a Ultra nucleases.

FIG. 28A shows the cleavage products of genomic target PCSK9 visualized on 2% agarose gel in the presence of various ID405 mutants. Editing efficiency values indicated above gel wells for LbaCas12a and each ID405 mutant were calculated using ImageJ software.

FIG. 28B shows the cleavage products of genomic target CISH visualized on 2% agarose gel in the presence of various ID405 mutants. Editing efficiency values indicated above gel wells for LbaCas12a and each ID405 mutant were calculated using ImageJ software.

FIG. 28C shows the cleavage products of genomic target TTR visualized on 2% agarose gel in the presence of various ID405 mutants. Editing efficiency values indicated above gel wells for LbaCas12a and each ID405 mutant were calculated using ImageJ software.

FIG. 28D shows the cleavage products of genomic target PCSK9 visualized on 2% agarose gel in the presence of various ID414 mutants. Editing efficiency values indicated above gel wells for LbaCas12a and each ID414 mutant were calculated using ImageJ software.

FIG. 28E shows the cleavage products of genomic target CISH visualized on 2% agarose gel in the presence of various ID414 mutants. Editing efficiency values indicated above gel wells for LbaCas12a and each ID414 mutant were calculated using ImageJ software.

FIG. 28F shows the cleavage products of genomic target TTR visualized on 2% agarose gel in the presence of various ID414 mutants. Editing efficiency values indicated above gel wells for LbaCas12a and each ID414 mutant were calculated using ImageJ software.

FIG. 28G shows the cleavage products of genomic target BCL11a visualized on 2% agarose gel in the presence of various ID405 mutants. Editing efficiency values for LbaCas12a and each ID405 mutant were calculated using ImageJ software.

FIG. 28H shows the cleavage products of genomic target HBG1 visualized on 2% agarose gel in the presence of various ID405 mutants. Editing efficiency values for LbaCas12a and each ID405 mutant were calculated using ImageJ software.

FIG. 28I shows the cleavage products of genomic target BCL11a visualized on 2% agarose gel in the presence of various ID414 mutants. Editing efficiency values for LbaCas12a and each ID414 mutant were calculated using ImageJ software.

FIG. 28J shows the cleavage products of genomic target HBG1 visualized on 2% agarose gel in the presence of various ID414 mutants. Editing efficiency values for LbaCas12a and each ID414 mutant were calculated using ImageJ software.

FIG. 28K shows the cleavage products of genomic target PCSK9 visualized on 2% agarose gel. Editing efficiency values for LbaCas12a and each ID418 mutant were calculated using ImageJ software.

FIG. 28L shows the cleavage products of genomic target CISH visualized on 2% agarose gel in the presence of various ID418 mutants. Editing efficiency values for LbaCas12a and each ID418 mutant were calculated using ImageJ software.

FIG. 28M shows the cleavage products of genomic target CISH visualized on 2% agarose gel in the presence of various ID418 mutants. Editing efficiency values for LbaCas12a and each ID418 mutant were calculated using ImageJ software.

FIG. 28N shows the cleavage products of genomic target BCL11a visualized on 2% agarose gel in the presence of various ID418 mutants. Editing efficiency values for LbaCas12a and each ID418 mutant were calculated using ImageJ software.

FIG. 28O shows the cleavage products of genomic target HBG1 visualized on 2% agarose gel in the presence of various ID418 mutants. Editing efficiency values for LbaCas12a and each ID418 mutant were calculated using ImageJ software.

Figure 29A:
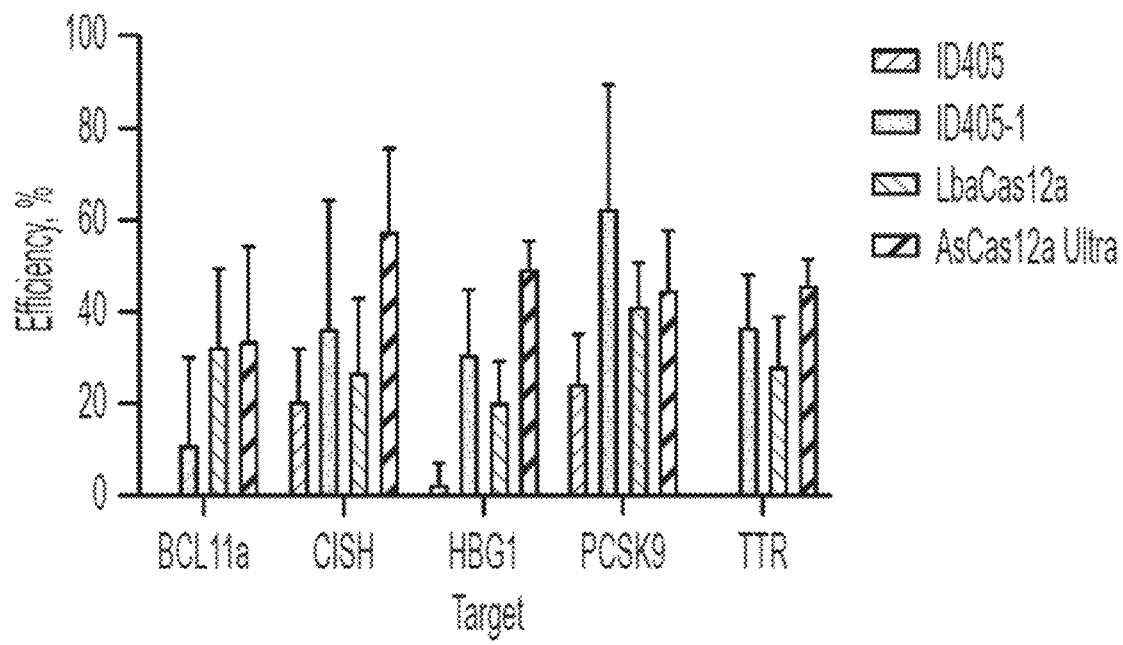
FIG. 29A Comparison of ID405 wild-type and ID405-1 mutant editing efficiency on different targets (n≥3). Targets are BCL11a, CISH, HBG1, PCSK9, and TTR. Results are calculated from T7 endonuclease assay data. For each gene target in the cluster of bar graphs, beginning on the left-most side of each clusture, the bars correspond to ID405, ID405-1, LbaCas12a, and AsCas12a Ultra. Note that no editing activity is observed fro the BCL11a and TTR targets (no left-most bar corresponding to ID405 activity). See Example 13 for further details.
Figure 29B:
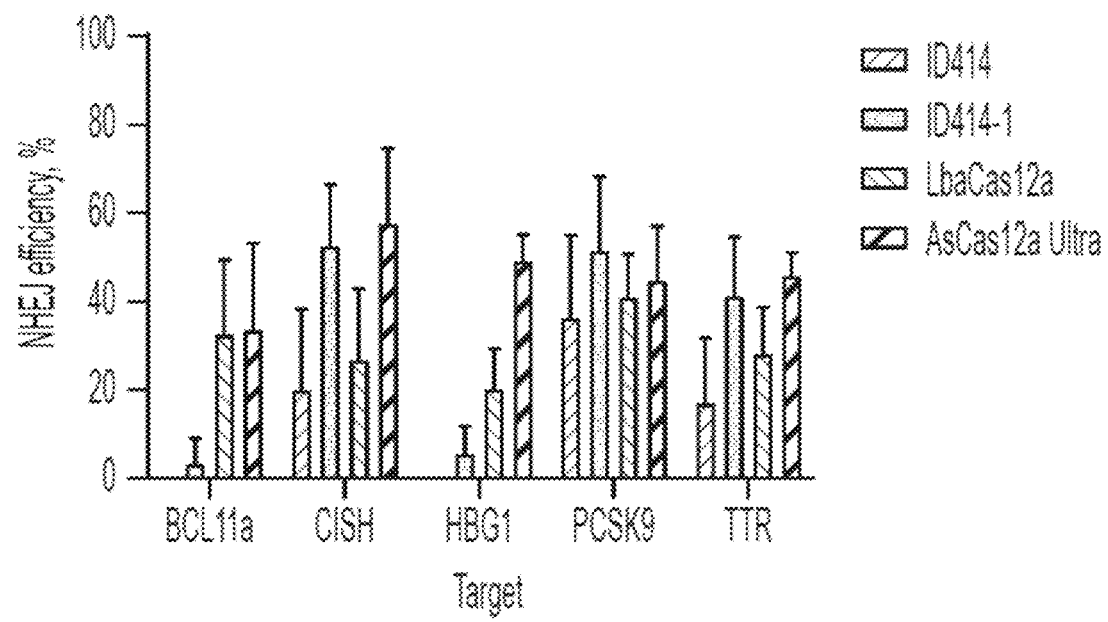
FIG. 29B Comparison of ID414 wild-type and ID414-1 mutant activity on different targets (n≥3). Targets are BCL11a, CISH, HBG1, PCSK9, and TTR. Results are calculated from T7 endonuclease assay data. For each gene target in the cluster of bar graphs, beginning on the left-most side of each clusture, the bars correspond to ID414, ID414-1, LbaCas12a, and AsCas12a Ultra. Note that no editing activity is observed fro the BCL11a and HBG1 targets (no left-most bar corresponding to ID414 activity). See Example 13 for further details.
Figure 30:
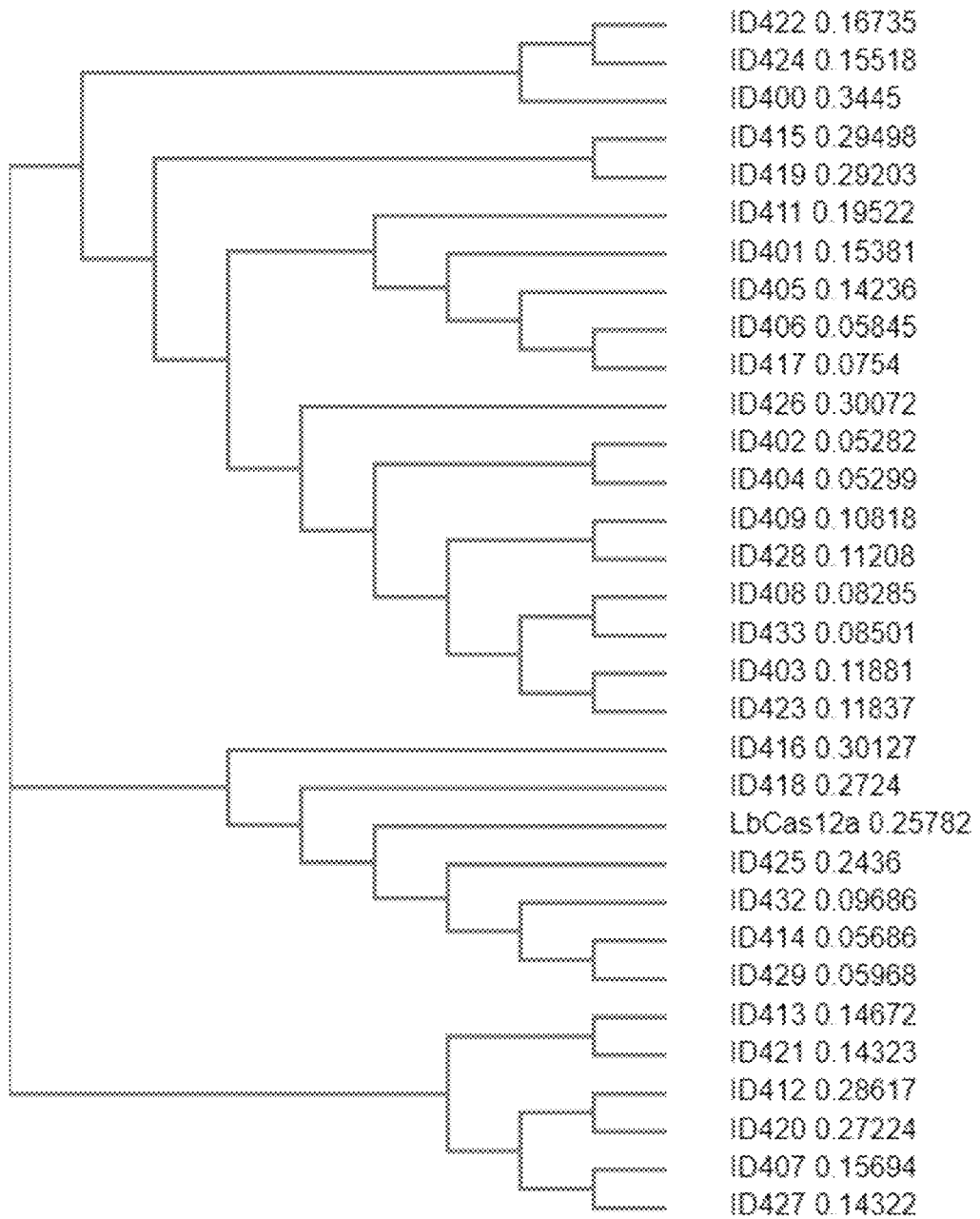
FIG. 30 depicts a phylogenetic tree of relationships among each of the Cas12a ortholog sequences presented in Table S15A versus the canonical LbCas12a sequence of SEQ ID NO: 1368 (provided in Section K subsection Q). The phylogenetic tree was calculated using the Clustal Omega multiple sequence alignment online tools available at EMBL (the European Molecular Biology Laboratory).

FIGS. 29A-29B summarize the results from multiple experiments with ID405-1 (SEQ ID NO: 585) and ID414-1 (SEQ ID NO: 591) mutants respectively, and demonstrates the increase of activity on each of the tested targets compared to WT proteins. As seen from the bar graph in FIG. 29A, ID405-1 mutant showed an increase in editing efficiency from less than 30% (the editing efficiency of the wildtype ID405 nuclease) to over 60% at the PCSK9 target. Similar, the ID405-1 mutant showed an increase in editing efficiency from below 20% (in the wildtype ID405 protein) to nearly 40% at the CISH target. These represent an over 2-fold (2X) increase in editing efficiency at both targets for the ID405-1 mutant as compared to the wildtype ID405 ortholog. In addition, at the TTR target, the ID405 wildtype protein showed no activity, whereas the mutant ID405-1 protein showed nearly 40% editing efficiency.

As seen from the bar graph in FIG. 29B, the editing efficiency of the ID414-1 mutants (relative to the wildtype ID414 nuclease) increase from less than 40% to over 50% at the PCSK9 target, from less than 20% to over 40% at the TTR target, and from about 20% to over 50% at the CISH target.

Example 14. Computational Methods to Predict Novel Single, Double, and Triple Mutations in Cas12a Orthologs Computations methods were used to predict novel single, double and triple mutations within three Cas12a orthologs. 3D structural models of each ortholog were obtained using AlphaFold v2.0 open source [1] and the models were subsequently relaxed with the RosettaSofwareSuite [2]. The putative PAM site for each ortholog was determined by superimposing the protein atoms of native Cas12a (5b43.pdb) onto each of the three 12a ortholog proteins, and the resulting nucleic acid 5b43 nucleic acid coordinates were used as a reference PAM model (pymol align, cycles=0). Individual sites within 6 Å of the putative PAM were selected for substitution for each ortholog and in-silico substitutions were made at each site to either arginine or alanine. Additional sites were selected for in silico modeling based on literature review.

The RosettaDesign or ddG mode was used to estimate the free energy changes upon amino acid substitutions upon each backbone [2]. Single amino acid substitutions with negative (eg. favorable) or neutral (eg. <2 Rosetta Energy Units, or REU) were selected for visual examination and further follow-up.

References in the Example are as follows:

[1] Jumper, J et al. Highly accurate protein structure prediction with AlphaFold.

[2] Maguire J B, Haddox H K, Strickland D, Halabiya S F, Coventry B, Griffin J R, Pulavarti S V S R K, Cummins M, Thieker D F, Klavins E, Szyperski T, DiMaio F, Baker D, and Kuhlman B. (2020). Perturbing the energy landscape for improved packing during computational protein design. Proteins 2021. doi: 10.1002/prot.26030.

Using the above computational approach, the following Cas12a mutant variants (based on Cas12a ID405 (SEQ ID NO: 334) as a reference Cas12a ortholog sequence) comprising novel single, double, and triple mutations were predicted.

| | |
|---|---|
| 405-2-1 | D169R + K127R |
| 405-2-2 | D169R + E128A |
| 405-2-3 | D169R + T162R |
| 405-2-4 | D169R + T165R |
| 405-2-5 | D169R + E772K |
| 405-2-6 | D169R + T162R + T165R |
| 405-2-7 | D169R + E128A + T165R |
| 405-2-8 | D169R + E128A + K127R |
| 405-2-9 | D169R + E128A + T165R + K127R |
| 405-2-10 | D169A + E128A + T162R + T165R |

Using the above computational approach, the following Cas12a mutant variants (based on Cas12a ID414 (SEQ ID NO: 58) as a reference Cas12a ortholog sequence) comprising novel single, double, and triple mutations were predicted.

| | |
|---|---|
| 414-2-1 | S802L + T154R |
| 414-2-2 | S802L + E120A |
| 414-2-3 | S802L + T147R |
| 414-2-4 | S802L + N150R |
| 414-2-5 | S802L + D539R |
| 414-2-6 | S802L + K590R |
| 414-2-7 | S802L + T154R + E120A |
| 414-2-8 | S802L + N150R + T147R + E120A |
| 414-2-9 | S802L + T154R + K590R |
| 414-2-10 | S802L + T154A + N150R + T147R + E120A |

Using the above computational approach, the following Cas12a mutant variants (based on Cas12a ID418 (SEQ ID NO: 564) as a reference Cas12a ortholog sequence) comprising novel single, double, and triple mutations were predicted.

| | |
|---|---|
| 418-2-1 | T532R/K538R + Q799L |
| 418-2-2 | D161R/T532R/K538R + Q799L |
| 418-2-3 | T532R/K538R + E126A |
| 418-2-4 | T532R/K538R + T154R |
| 418-2-5 | T532R/K538R + Q157R |
| 418-2-6 | T532R/K538R + E529A |
| 418-2-7 | T532R/K538R + T154R + Q157R |
| 418-2-8 | T532R/K538R + T154R + E126A |
| 418-2-9 | T532R/K538R + T154R + E529A |
| 418-2-10 | D161A/T532R/K538R +T154R + Q157R |

Supplementary Sequences for Examples

TABLE S1

| \multicolumn{2}{c}{crRNA for PAM determination:} | |
|---|---|
| Cas12a nuclease | crRNA sequence (mature repeat) - against T7 endo library for PAM determination |
| LbaCas12a | UAAUUUCUACUAAGUGUAGAUUGUCCUCUUCCUCUUUAGCG (SEQ ID NO: 758) |
| ID400 | GGAAUUUCUACUGUUGUAGAUUGUCCUCUUCCUCUUUAGCG (SEQ ID NO: 759) |
| ID401 | AGAAUUUCUACUGUUGUAGAUUGUCCUCUUCCUCUUUAGCG (SEQ ID NO: 760) |
| ID402 | AAAAUUUCUACUCUUGUAGAUUGUCCUCUUCCUCUUUAGCG (SEQ ID NO: 761) |
| ID403 | AAAAUUUCUACUAUUGUAGAUUGUCCUCUUCCUCUUUAGCG (SEQ ID NO: 762) |
| ID404 | AAAAUUUCUACUCUUGUAGAUUGUCCUCUUCCUCUUUAGCG (SEQ ID NO: 763) |
| ID405 | UGAAUUUCUACUGUUGUAGAUUGUCCUCUUCCUCUUUAGCG (SEQ ID NO: 764) |
| ID406 | UAAAUUUCUACUGUUGUAGAUUGUCCUCUUCCUCUUUAGCG (SEQ ID NO: 765) |
| ID407 | AAAAUUUCUACUAUUGUAGAUUGUCCUCUUCCUCUUUAGCG (SEQ ID NO: 766) |

TABLE S1-continued crRNA for PAM determination:

| Cas12a nuclease | crRNA sequence (mature repeat)- against T7 endo library for PAM determination |
|---|---|
| ID408 | AAAAUUUCUGCUAUUGCAGAUUGUCCUCUUCCUCUUUAGCG (SEQ ID NO: 767) |
| ID409 | UAAAUUUCUACUAUUGUAGAUUGUCCUCUUCCUCUUUAGCG (SEQ ID NO: 768) |
| ID410 | AUAAUUUCUACUAUCGUAGAUUGUCCUCUUCCUCUUUAGCG (SEQ ID NO: 769) |
| ID411 | UAAAUUUCUACUGUUGUAGAUUGUCCUCUUCCUCUUUAGCG (SEQ ID NO: 770) |
| ID412 | UUAAUUUCUACUAUUGUAGAUUGUCCUCUUCCUCUUUAGCG (SEQ ID NO: 771) |
| ID413 | AUAAUUUCUACUAUUGUAGAUUGUCCUCUUCCUCUUUAGCG (SEQ ID NO: 772) |
| ID414 | AUAAUUUCUACUGUUGUAGAUUGUCCUCUUCCUCUUUAGCG (SEQ ID NO: 773) |
| ID415 | UUAAUUUCUACUCUCGUAGAUUGUCCUCUUCCUCUUUAGCG (SEQ ID NO: 774) |
| ID416 | AUAAUUUCUACUAUCGUAGAUUGUCCUCUUCCUCUUUAGCG (SEQ ID NO: 775) |
| ID417 | UAAAUUUCUACUGUUGUAGAUUGUCCUCUUCCUCUUUAGCG (SEQ ID NO: 776) |
| ID418 | UAAAUUUCUACUAUUGUAGAUUGUCCUCUUCCUCUUUAGCG (SEQ ID NO: 777) |
| ID419 | AGAAUUUCUACUGUUGUAGAUUGUCCUCUUCCUCUUUAGCG (SEQ ID NO: 778) |
| ID420 | AUAAUUUCUACUAUUGUAGAUUGUCCUCUUCCUCUUUAGCG (SEQ ID NO: 779) |
| ID421 | AUAAUUUCUACUAUUGUAGAUUGUCCUCUUCCUCUUUAGCG (SEQ ID NO: 780) |
| ID422 | AAAAUUUCUACUAUUGUAGAUUGUCCUCUUCCUCUUUAGCG (SEQ ID NO: 781) |
| ID423 | GAAAUUUCUACUAUCGUAGAUUGUCCUCUUCCUCUUUAGCG (SEQ ID NO: 782) |
| ID424 | AUAAUUUCUACUAUUGUAGAUUGUCCUCUUCCUCUUUAGCG (SEQ ID NO: 783) |
| ID425 | UAAAUUUCUACUAUUGUAGAUUGUCCUCUUCCUCUUUAGCG (SEQ ID NO: 784) |
| ID426 | UCAAUUUCUACUGUUGUAGAUUGUCCUCUUCCUCUUUAGCG (SEQ ID NO: 785) |
| ID427 | AAAAUUUCUACUAUUGUAGAUUGUCCUCUUCCUCUUUAGCG (SEQ ID NO: 786) |
| ID428 | UAAAUUUCUACUAUUGUAGAUUGUCCUCUUCCUCUUUAGCG (SEQ ID NO: 787) |
| ID429 | AUAAUUUCUACUGUUGUAGAUUGUCCUCUUCCUCUUUAGCG (SEQ ID NO: 788) |
| ID430 | AGAAUUUCUACUUAUGUAGAUUGUCCUCUUCCUCUUUAGCG (SEQ ID NO: 789) |
| ID431 | UCAAUUUCUACUUUUGUAGAUUGUCCUCUUCCUCUUUAGCG (SEQ ID NO: 790) |
| ID432 | AUAAUUUCUACUGUUGUAGAUUGUCCUCUUCCUCUUUAGCG (SEQ ID NO: 791) |

TABLE S1-continued crRNA for PAM determination:

| Cas12a nuclease | crRNA sequence (mature repeat)-against T7 endo library for PAM determination |
|---|---|
| ID433 | AAAAUUUCUGCUAUUGCAGAUUGUCCUCUUCCUCUUUAGCG (SEQ ID NO: 792) |

TABLE S2

Target sequences HEK293T

| Cas12a nuclease | Target | Target sequence | PAM |
|---|---|---|---|
| LbaCas12a | DNMT1 | CCTCACTCCTGCTCGGTGAATTT (SEQ ID NO: 793) | TTTC |
| ID401 | DNMT1 | CCTCACTCCTGCTCGGTGAATTT (SEQ ID NO: 794) | TTTC |
| ID402 | DNMT1 | CCTCACTCCTGCTCGGTGAATTT (SEQ ID NO: 795) | TTTC |
| ID403 | DNMT1 | CCTCACTCCTGCTCGGTGAATTT (SEQ ID NO: 796) | TTTC |
| ID404 | DNMT1 | CCTCACTCCTGCTCGGTGAATTT (SEQ ID NO: 797) | TTTC |
| ID405 | DNMT1 | CCTCACTCCTGCTCGGTGAATTT (SEQ ID NO: 798) | TTTC |
| ID406 | DNMT1 | CCTCACTCCTGCTCGGTGAATTT (SEQ ID NO: 799) | TTTC |
| ID407 | DNMT1 | CCTCACTCCTGCTCGGTGAATTT (SEQ ID NO: 800) | TTTC |
| ID408 | DNMT1 | CCTCACTCCTGCTCGGTGAATTT (SEQ ID NO: 801) | TTTC |
| ID409 | DNMT1_T1 | TGGGACTCAGGCGGGTCACCTAC (SEQ ID NO: 802) | CTC |
| ID409 | DNMT1_T2 | AGCAGGCACCTGCCTCAGCTGCT (SEQ ID NO: 803) | CTC |
| ID409 | DNMT1_T3 | AGGCGGGTCACCTACCCACGTTC (SEQ ID NO: 804) | CTC |
| ID409 | DNMT1_T4 | ACTCCTGCTCGGTGAATTTGGCT (SEQ ID NO: 805) | CTC |
| ID410 | DNMT1 | CCTCACTCCTGCTCGGTGAATTT (SEQ ID NO: 806) | TTTC |
| ID411 | DNMT1 | CCTCACTCCTGCTCGGTGAATTT (SEQ ID NO: 807) | TTTC |
| ID412 | DNMT1 | CCTCACTCCTGCTCGGTGAATTT (SEQ ID NO: 808) | TTTC |
| ID413 | DNMT1 | CCTCACTCCTGCTCGGTGAATTT (SEQ ID NO: 809) | TTTC |
| ID414 | DNMT1 | CCTCACTCCTGCTCGGTGAATTT (SEQ ID NO: 810) | TTTC |
| ID415 | DNMT1 | CCTCACTCCTGCTCGGTGAATTT (SEQ ID NO: 811) | TTTC |
| ID416 | DNMT1_T1 | GGCTCTGGGACTCAGGCGGGTCA (SEQ ID NO: 812) | TTTTG |

TABLE S2-continued

Target sequences HEK293T

| Cas12a nuclease | Target | Target sequence | PAM |
|---|---|---|---|
| ID416 | DNMT1_T2 | GCTCAGCAGGCACCTGCCTCAGC (SEQ ID NO: 813) | ATTTG |
| ID417 | DNMT1 | CCTCACTCCTGCTCGGTGAATTT (SEQ ID NO: 814) | TTTC |
| ID418 | DNMT1 | CCTCACTCCTGCTCGGTGAATTT (SEQ ID NO: 815) | TTTC |
| ID419 | DNMT1 | CCTCACTCCTGCTCGGTGAATTT (SEQ ID NO: 816) | TTTC |
| ID420 | DNMT1 | CCTCACTCCTGCTCGGTGAATTT (SEQ ID NO: 817) | TTTC |
| ID421 | DNMT1 | CCTCACTCCTGCTCGGTGAATTT (SEQ ID NO: 818) | TTTC |
| ID422 | DNMT1 | CCTCACTCCTGCTCGGTGAATTT (SEQ ID NO: 819) | TTTC |
| ID423 | DNMT1_T1 | CCTCACTCCTGCTCGGTGAATTT (SEQ ID NO: 820) | GTTTC |
| ID423 | DNMT1_T2 | CTGATGGTCCATGTCTGTTACTC (SEQ ID NO: 821) | GTTTC |
| ID424 | DNMT1 | ACCGAGCAGGAGTGAGGGAAACG (SEQ ID NO: 822) | ATTC |
| ID425 | DNMT1 | CCTCACTCCTGCTCGGTGAATTT (SEQ ID NO: 823) | TTTC |
| ID426 | DNMT1 | CCTCACTCCTGCTCGGTGAATTT (SEQ ID NO: 824) | TTTC |
| ID427 | DNMT1 | CCTCACTCCTGCTCGGTGAATTT (SEQ ID NO: 825) | TTTC |
| ID428 | DNMT1_T1 | TGGGACTCAGGCGGGTCACCTAC (SEQ ID NO: 826) | CTC |
| ID428 | DNMT1_T2 | AGGCGGGTCACCTACCCACGTTC (SEQ ID NO: 827) | CTC |
| ID428 | DNMT1_T3 | AGCAGGCACCTGCCTCAGCTGCT (SEQ ID NO: 828) | CTC |
| ID428 | DNMT1_T4 | ACTCCTGCTCGGTGAATTTGGCT (SEQ ID NO: 829) | CTO |
| ID429 | DNMT1 | CCTCACTCCTGCTCGGTGAATTT (SEQ ID NO: 830) | TTTC |
| ID432 | DNMT1 | CCTCACTCCTGCTCGGTGAATTT (SEQ ID NO: 831) | TTTC |
| ID433 | DNMT1_T1 | ACTCCTGCTCGGTGAATTTGGCT (SEQ ID NO: 832) | CTC |
| ID433 | DNMT1_T2 | AGCAGGCACCTGCCTCAGCTGCT (SEQ ID NO: 833) | CTC |
| ID433 | DNMT1_T3 | AGGCGGGTCACCTACCCACGTTC (SEQ ID NO: 834) | CTC |
| LbaCas12a | RUNX1 | CAGGAGGAAGCGATGGCTTCAG (SEQ ID NO: 835) | TTTT |
| ID401 | RUNX1 | CAGGAGGAAGCGATGGCTTCAG (SEQ ID NO: 836) | TTTT |
| ID402 | RUNX1 | CAGGAGGAAGCGATGGCTTCAG (SEQ ID NO: 837) | TTTT |

TABLE S2-continued

Target sequences HEK293T

| Cas12a nuclease | Target | Target sequence | PAM |
|---|---|---|---|
| ID403 | RUNX1 | CAGGAGGAAGCGATGGCTTCAG (SEQ ID NO: 838) | TTTT |
| ID404 | RUNX1 | CAGGAGGAAGCGATGGCTTCAG (SEQ ID NO: 839) | TTTT |
| ID405 | RUNX1 | CAGGAGGAAGCGATGGCTTCAG (SEQ ID NO: 840) | TTTT |
| ID406 | RUNX1 | CAGGAGGAAGCGATGGCTTCAG (SEQ ID NO: 841) | TTTT |
| ID407 | RUNX1 | CAGGAGGAAGCGATGGCTTCAG (SEQ ID NO: 842) | TTTT |
| ID408 | RUNX1 | CAGGAGGAAGCGATGGCTTCAG (SEQ ID NO: 843) | TTTT |
| ID409 | RUNX1_T1 | AGCTTTGCCTGTAATGAAATGGC (SEQ ID NO: 844) | CTC |
| ID409 | RUNX1_T2 | GGTGCAGAGATGCCTCGGTGCCT (SEQ ID NO: 845) | CTC |
| ID410 | RUNX1 | CAGGAGGAAGCGATGGCTTCAG (SEQ ID NO: 846) | TTTT |
| ID411 | RUNX1 | CAGGAGGAAGCGATGGCTTCAG (SEQ ID NO: 847) | TTTT |
| ID412 | RUNX1 | CAGGAGGAAGCGATGGCTTCAG (SEQ ID NO: 848) | TTTT |
| ID413 | RUNX1 | CAGGAGGAAGCGATGGCTTCAG (SEQ ID NO: 849) | TTTT |
| ID414 | RUNX1 | CAGGAGGAAGCGATGGCTTCAG (SEQ ID NO: 850) | TTTT |
| ID415 | RUNX1 | CAGGAGGAAGCGATGGCTTCAG (SEQ ID NO: 851) | TTTT |
| ID416 | RUNX1_T1 | TTTTTACAAAGGTGCATTTTTTA (SEQ ID NO: 852) | ATTTG |
| ID416 | RUNX1_T2 | CTCAGCTTTGCCTGTAATGAAAT (SEQ ID NO: 853) | TTTTG |
| ID417 | RUNX1 | CAGGAGGAAGCGATGGCTTCAG (SEQ ID NO: 854) | TTTT |
| ID418 | RUNX1 | CAGGAGGAAGCGATGGCTTCAG (SEQ ID NO: 855) | TTTT |
| ID419 | RUNX1 | CAGGAGGAAGCGATGGCTTCAG (SEQ ID NO: 856) | TTTT |
| ID420 | RUNX1 | CAGGAGGAAGCGATGGCTTCAG (SEQ ID NO: 857) | TTTT |
| ID421 | RUNX1 | CAGGAGGAAGCGATGGCTTCAG (SEQ ID NO: 858) | TTTT |
| ID422 | RUNX1 | CAGGAGGAAGCGATGGCTTCAG (SEQ ID NO: 859) | TTTT |
| ID423 | RUNX1_T1 | AGACAGCATATTTGAGTCATTTC (SEQ ID NO: 860) | GCTTC |
| ID423 | RUNX1_T2 | ACCTCGGTGCAGAGATGCCTCGG (SEQ ID NO: 1547) | GTTTC |
| ID424 | RUNX1 | CTTACTAATCAGATGGAAGCTCT (SEQ ID NO: 861) | ATTA |

TABLE S2-continued

Target sequences HEK293T

| Cas12a nuclease | Target | Target sequence | PAM |
|---|---|---|---|
| ID425 | RUNX1 | CAGGAGGAAGCGATGGCTTCAG (SEQ ID NO: 862) | TTTT |
| ID426 | RUNX1 | CAGGAGGAAGCGATGGCTTCAG (SEQ ID NO: 863) | TTTT |
| ID427 | RUNX1 | CAGGAGGAAGCGATGGCTTCAG (SEQ ID NO: 864) | TTTT |
| ID428 | RUNX1 | CAGGAGGAAGCGATGGCTTCAG (SEQ ID NO: 865) | TTTT |
| ID429 | RUNX1 | CAGGAGGAAGCGATGGCTTCAG (SEQ ID NO: 866) | TTTT |
| ID432 | RUNX1 | CAGGAGGAAGCGATGGCTTCAG (SEQ ID NO: 867) | TTTT |
| ID433 | RUNX1_T1 | AGCTTTGCCTGTAATGAAATGGC (SEQ ID NO: 868) | CTC |
| ID433 | RUNX1_T2 | GGTGCAGAGATGCCTCGGTGCCT (SEQ ID NO: 869) | CTC |
| LbaCas12a | SCN1A | CTCCATCTTGTCATCCTGCA (SEQ ID NO: 870) | TTTG |
| ID401 | SCN1A | CTCCATCTTGTCATCCTGCA (SEQ ID NO: 871) | TTTG |
| ID402 | SCN1A | CTCCATCTTGTCATCCTGCA (SEQ ID NO: 872) | TTTG |
| ID403 | SCN1A | CTCCATCTTGTCATCCTGCA (SEQ ID NO: 873) | TTTG |
| ID404 | SCN1A | CTCCATCTTGTCATCCTGCA (SEQ ID NO: 874) | TTTG |
| ID405 | SCN1A | CTCCATCTTGTCATCCTGCA (SEQ ID NO: 875) | TTTG |
| ID406 | SCN1A | CTCCATCTTGTCATCCTGCA (SEQ ID NO: 876) | TTTG |
| ID407 | SCN1A | CTCCATCTTGTCATCCTGCA (SEQ ID NO: 877) | TTTG |
| ID408 | SCN1A | CTCCATCTTGTCATCCTGCA (SEQ ID NO: 878) | TITG |
| ID409 | SCN1A_T1 | TGGTGAAGAAGTTGAAGCTGTCA (SEQ ID NO: 879) | CTC |
| ID409 | SCN1A_T2 | CATCTTGTCATCCTGCACATTTT (SEQ ID NO: 880) | CTC |
| ID410 | SCN1A | CTCCATCTTGTCATCCTGCA (SEQ ID NO: 881) | TTTG |
| ID411 | SCN1A | CTCCATCTTGTCATCCTGCA (SEQ ID NO: 882) | TTTG |
| ID412 | SCN1A | CTCCATCTTGTCATCCTGCA (SEQ ID NO: 883) | TITG |
| ID413 | SCN1A | CTCCATCTTGTCATCCTGCA (SEQ ID NO: 884) | TTTG |
| ID414 | SCN1A | CTCCATCTTGTCATCCTGCA (SEQ ID NO: 885) | TTTG |
| ID415 | SCN1A | CTCCATCTTGTCATCCTGCA (SEQ ID NO: 886) | TTTG |

TABLE S2-continued

Target sequences HEK293T

| Cas12a nuclease | Target | Target sequence | PAM |
|---|---|---|---|
| ID416 | SCN1A | CTCCATCTTGTCATCCTGCA (SEQ ID NO: 887) | GTTTG |
| ID417 | SCN1A | CTCCATCTTGTCATCCTGCA (SEQ ID NO: 888) | TTTG |
| ID418 | SCN1A | CTCCATCTTGTCATCCTGCA (SEQ ID NO: 889) | TTTG |
| ID419 | SCN1A | CTCCATCTTGTCATCCTGCA (SEQ ID NO: 890) | TTTG |
| ID420 | SCN1A | CTCCATCTTGTCATCCTGCA (SEQ ID NO: 891) | TTTG |
| ID421 | SCN1A | CTCCATCTTGTCATCCTGCA (SEQ ID NO: 892) | TTTG |
| ID422 | SCN1A | CTCCATCTTGTCATCCTGCA (SEQ ID NO: 893) | TTTG |
| ID423 | SCN1A_T1 | TTTGCCTTTTCTTCTGCAATGCG (SEQ ID NO: 894) | GATTC |
| ID423 | SCN1A_T2 | TCTGGTGAAGAAGTTGAAGCTGT (SEQ ID NO: 895) | GATTC |
| ID424 | SCN1A | CTCCATCTTGTCATCCTGCA (SEQ ID NO: 896) | TTTG |
| ID425 | SCN1A | CTCCATCTTGTCATCCTGCA (SEQ ID NO: 897) | TTTG |
| ID426 | SCN1A | CTCCATCTTGTCATCCTGCA (SEQ ID NO: 898) | TTTG |
| ID427 | SCN1A | CTCCATCTTGTCATCCTGCA (SEQ ID NO: 899) | TTTG |
| ID428 | SCN1A | CTCCATCTTGTCATCCTGCA (SEQ ID NO: 900) | TTTG |
| ID429 | SCN1A | CTCCATCTTGTCATCCTGCA (SEQ ID NO: 901) | TTTG |
| ID432 | SCN1A | CTCCATCTTGTCATCCTGCA (SEQ ID NO: 902) | TTTG |
| ID433 | SCN1A_T1 | TGGTGAAGAAGTTGAAGCTGTCA (SEQ ID NO: 903) | CTC |
| ID433 | SCN1A_T2 | CATCTTGTCATCCTGCACATTTT (SEQ ID NO: 904) | CTC |
| LbaCas12a | FANCF site 1 | GTCGGCATGGCCCCATTCGCACG (SEQ ID NO: 905) | TTTG |
| ID401 | FANCF site 1 | GTCGGCATGGCCCCATTCGCACG (SEQ ID NO: 906) | TTTG |
| ID402 | FANCF site 1 | GTCGGCATGGCCCCATTCGCACG (SEQ ID NO: 907) | TTTG |
| ID403 | FANCF site 1 | GTCGGCATGGCCCCATTCGCACG (SEQ ID NO: 908) | TTTG |
| ID404 | FANCF site 1 | GTCGGCATGGCCCCATTCGCACG (SEQ ID NO: 909) | TTTG |
| ID405 | FANCF site 1 | GTCGGCATGGCCCCATTCGCACG (SEQ ID NO: 910) | TTTG |
| ID406 | FANCF site 1 | GTCGGCATGGCCCCATTCGCACG (SEQ ID NO: 911) | TTTG |

TABLE S2-continued

Target sequences HEK293T

| Cas12a nuclease | Target | Target sequence | PAM |
|---|---|---|---|
| ID407 | FANCF site 1 | GTCGGCATGGCCCCATTCGCACG (SEQ ID NO: 912) | TTTG |
| ID408 | FANCF site 1 | GTCGGCATGGCCCCATTCGCACG (SEQ ID NO: 913) | TTTG |
| ID409 | FANCF site 1 | ATGGAATCCCTTCTGCAGCACCT (SEQ ID NO: 914) | CTC |
| ID410 | FANCF site 1 | GTCGGCATGGCCCCATTCGCACG (SEQ ID NO: 915) | TTTG |
| ID411 | FANCF site 1 | GTCGGCATGGCCCCATTCGCACG (SEQ ID NO: 916) | TTTG |
| ID412 | FANCF site 1 | GTCGGCATGGCCCCATTCGCACG (SEQ ID NO: 917) | TTTG |
| ID413 | FANCF site 1 | GTCGGCATGGCCCCATTCGCACG (SEQ ID NO: 918) | TTTG |
| ID414 | FANCF site 1 | GTCGGCATGGCCCCATTCGCACG (SEQ ID NO: 919) | TTTG |
| ID415 | FANCF site 1 | GTCGGCATGGCCCCATTCGCACG (SEQ ID NO: 920) | TTTG |
| ID416 | FANCF site 1 | TCCTAAAAATTACGAAAACGAAA (SEQ ID NO: 921) | TTTTG |
| ID417 | FANCF site 1 | GTCGGCATGGCCCCATTCGCACG (SEQ ID NO: 922) | TTTG |
| ID418 | FANCF site 1 | GTCGGCATGGCCCCATTCGCACG (SEQ ID NO: 923) | TTTG |
| ID419 | FANCF site 1 | GTCGGCATGGCCCCATTCGCACG (SEQ ID NO: 924) | TTTG |
| ID420 | FANCF site 1 | GTCGGCATGGCCCCATTCGCACG (SEQ ID NO: 925) | TTTG |
| ID421 | FANCF site 1 | GTCGGCATGGCCCCATTCGCACG (SEQ ID NO: 926) | TTTG |
| ID422 | FANCF site 1 | GTCGGCATGGCCCCATTCGCACG (SEQ ID NO: 927) | TTTG |
| ID423 | FANCF site 1 | AAATAATCTGGGCTTCAGTTCTA (SEQ ID NO: 928) | GTTTC |
| ID424 | FANCF site 1 | GCGAACTTCCAGGCCCTCGGTCA (SEQ ID NO: 929) | ATTA |
| ID425 | FANCF site 1 | GTCGGCATGGCCCCATTCGCACG (SEQ ID NO: 930) | TTTG |
| ID426 | FANCF site 1 | GTCGGCATGGCCCCATTCGCACG (SEQ ID NO: 931) | TTTG |
| ID427 | FANCF site 1 | GTCGGCATGGCCCCATTCGCACG (SEQ ID NO: 932) | TTTG |
| ID428 | FANCF site 1 | TGGCGTTACTTAATTTTGAAAAA (SEQ ID NO: 933) | CTC |
| ID429 | FANCF site 1 | GTCGGCATGGCCCCATTCGCACG (SEQ ID NO: 934) | TTTG |
| ID432 | FANCF site 1 | GTCGGCATGGCCCCATTCGCACG (SEQ ID NO: 935) | TTTG |
| ID433 | FANCF site 1 | TGGCGTTACTTAATTTTGAAAAA (SEQ ID NO: 936) | CTC |

TABLE S2-continued

Target sequences HEK293T

| Cas12a nuclease | Target | Target sequence | PAM |
|---|---|---|---|
| LbaCas12a | FANCF site 2 | GCGGATGTTCCAATCAGTACGC (SEQ ID NO: 937) | TTTC |
| ID401 | FANCF site 2 | GCGGATGTTCCAATCAGTACGC (SEQ ID NO: 938) | TTTC |
| ID402 | FANCF site 2 | GCGGATGTTCCAATCAGTACGC (SEQ ID NO: 939) | TTTC |
| ID403 | FANCF site 2 | GCGGATGTTCCAATCAGTACGC (SEQ ID NO: 940) | TTTC |
| ID404 | FANCF site 2 | GCGGATGTTCCAATCAGTACGC (SEQ ID NO: 941) | TTTC |
| ID405 | FANCF site 2 | GCGGATGTTCCAATCAGTACGC (SEQ ID NO: 942) | TTTC |
| ID406 | FANCF site 2 | GCGGATGTTCCAATCAGTACGC (SEQ ID NO: 943) | TTTC |
| ID407 | FANCF site 2 | GCGGATGTTCCAATCAGTACGC (SEQ ID NO: 944) | TTTC |
| ID408 | FANCF site 2 | GCGGATGTTCCAATCAGTACGC (SEQ ID NO: 945) | TTTC |
| ID409 | FANCF site 2 | AAGCACTACCTACGTCAGCACCT (SEQ ID NO: 946) | CTC |
| ID410 | FANCF site 2 | GCGGATGTTCCAATCAGTACGC (SEQ ID NO: 947) | TTTC |
| ID411 | FANCF site 2 | GCGGATGTTCCAATCAGTACGC (SEQ ID NO: 948) | TTTC |
| ID412 | FANCF site 2 | GCGGATGTTCCAATCAGTACGC (SEQ ID NO: 949) | TTTC |
| ID413 | FANCF site 2 | GCGGATGTTCCAATCAGTACGC (SEQ ID NO: 950) | TTTC |
| ID414 | FANCF site 2 | GCGGATGTTCCAATCAGTACGC (SEQ ID NO: 951) | TTTC |
| ID415 | FANCF site 2 | GCGGATGTTCCAATCAGTACGC (SEQ ID NO: 952) | TTTC |
| ID416 | FANCF site 2 | AAAAACCTCAACACAGATTCTAG (SEQ ID NO: 953) | TTTTG |
| ID417 | FANCF site 2 | GCGGATGTTCCAATCAGTACGC (SEQ ID NO: 954) | TTTC |
| ID418 | FANCF site 2 | GCGGATGTTCCAATCAGTACGC (SEQ ID NO: 955) | TTTC |
| ID419 | FANCF site 2 | GCGGATGTTCCAATCAGTACGC (SEQ ID NO: 956) | TTTC |
| ID420 | FANCF site 2 | GCGGATGTTCCAATCAGTACGC (SEQ ID NO: 957) | TTTC |
| ID421 | FANCF site 2 | GCGGATGTTCCAATCAGTACGC (SEQ ID NO: 958) | TTTC |
| ID422 | FANCF site 2 | GCGGATGTTCCAATCAGTACGC (SEQ ID NO: 959) | TTTC |
| ID423 | FANCF site 2 | CTCACGTCACAGTATGTCTCTGG (SEQ ID NO: 960) | GTTTC |
| ID424 | FANCF site 2 | GCGGATGTTCCAATCAGTACGC (SEQ ID NO: 961) | TTTC |

TABLE S2-continued

Target sequences HEK293T

| Cas12a nuclease | Target | Target sequence | PAM |
|---|---|---|---|
| ID425 | FANCF site 2 | GCGGATGTTCCAATCAGTACGC (SEQ ID NO: 962) | TTTC |
| ID426 | FANCF site 2 | GCGGATGTTCCAATCAGTACGC (SEQ ID NO: 963) | TTTC |
| ID427 | FANCF site 2 | GCGGATGTTCCAATCAGTACGC (SEQ ID NO: 964) | TTTC |
| ID428 | FANCF site 2 | AAGCACTACCTACGTCAGCACCT (SEQ ID NO: 965) | CTC |
| ID429 | FANCF site 2 | GCGGATGTTCCAATCAGTACGC (SEQ ID NO: 966) | TTTC |
| ID432 | FANCF site 2 | GCGGATGTTCCAATCAGTACGC (SEQ ID NO: 967) | TTTC |
| ID433 | FANCF site 2 | AAGCACTACCTACGTCAGCACCT (SEQ ID NO: 968) | CTC |

TABLE S3 crRNA cassette sequences HEK293T

| Cas12a nuclease | Target | Full cassette sequence | SEQ ID NO: |
|---|---|---|---|
| LbaCas12a | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA ATTTCTACTAAGTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 969 |
| ID401 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAG AATTTCTACTGTTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 970 |
| ID402 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 971 |
| ID403 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 972 |
| ID404 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT | SEQ ID NO: 973 |

TABLE S3-continued crRNA cassette sequences HEK293T

| Cas12a nuclease | Target | Full cassette sequence | SEQ ID NO: |
|---|---|---|---|
| | | AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTCTTGTAGATCCTCACTCCTGCTCGGTGAATTTGGC<br>CGGCATGGTCCCAGCCTCCTCGCTGGCGCCGGCTGGGCAACAT<br>GCTTCGGCATGGCGAATGGGAC | |
| ID405 | DNMT1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTG<br>AATTTCTACTGTTGTAGATCCTCACTCCTGCTCGGTGAATTTGGC<br>CGGCATGGTCCCAGCCTCCTCGCTGGCGCCGGCTGGGCAACAT<br>GCTTCGGCATGGCGAATGGGAC | SEQ ID NO: 974 |
| ID406 | DNMT1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTGTTGTAGATCCTCACTCCTGCTCGGTGAATTTGGC<br>CGGCATGGTCCCAGCCTCCTCGCTGGCGCCGGCTGGGCAACAT<br>GCTTCGGCATGGCGAATGGGAC | SEQ ID NO: 975 |
| ID407 | DNMT1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATCCTCACTCCTGCTCGGTGAATTTGGC<br>CGGCATGGTCCCAGCCTCCTCGCTGGCGCCGGCTGGGCAACAT<br>GCTTCGGCATGGCGAATGGGAC | SEQ ID NO: 976 |
| ID408 | DNMT1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTGCTATTGCAGATCCTCACTCCTGCTCGGTGAATTTGGC<br>CGGCATGGTCCCAGCCTCCTCGCTGGCGCCGGCTGGGCAACAT<br>GCTTCGGCATGGCGAATGGGAC | SEQ ID NO: 977 |
| ID409 | DNMT1_<br>T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATTGGACTCAGGCGGGTCACCTACGG<br>CCGGCATGGTCCCAGCCTCCTCGCTGGCGCCGGCTGGGCAACAT<br>GCTTCGGCATGGCGAATGGGAC | SEQ ID NO: 978 |
| ID409 | DNMT1_<br>T2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATAGCAGGCACCTGCCTCAGCTGCTGG<br>CCGGCATGGTCCCAGCCTCCTCGCTGGCGCCGGCTGGGCAACAT<br>GCTTCGGCATGGCGAATGGGAC | SEQ ID NO: 979 |
| ID409 | DNMT1_<br>T3 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC | SEQ ID NO: 980 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCTA AATTTCTACTATTGTAGATAGGCGGGTCACCTACCCACGTTCGG CCGGCATGGTCCCAGCCTCCTCGCTGGCGCCGGCTGGGAACAT GCTTCGGCATGGCGAATGGGAC | |
| ID409 | DNMT1_T4 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATACTCCTGCTCGGTGAATTTGGCTGGC CGGCATGGTCCCAGCCTCCTCGCTGGCGCCGGCTGGGAACAT GCTTCGGCATGGCGAATGGGAC | SEQ ID NO: 981 |
| ID410 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATCCTCACTCCTGCTCGGTGAATTTGGC CGGCATGGTCCCAGCCTCCTCGCTGGCGCCGGCTGGGAACAT GCTTCGGCATGGCGAATGGGAC | SEQ ID NO: 982 |
| ID411 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCCTCACTCCTGCTCGGTGAATTTGGC CGGCATGGTCCCAGCCTCCTCGCTGGCGCCGGCTGGGAACAT GCTTCGGCATGGCGAATGGGAC | SEQ ID NO: 983 |
| ID412 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTATTGTAGATCCTCACTCCTGCTCGGTGAATTTGGCC GGCATGGTCCCAGCCTCCTCGCTGGCGCCGGCTGGGAACATG CTTCGGCATGGCGAATGGGAC | SEQ ID NO: 984 |
| ID413 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCCTCACTCCTGCTCGGTGAATTTGGC CGGCATGGTCCCAGCCTCCTCGCTGGCGCCGGCTGGGAACAT GCTTCGGCATGGCGAATGGGAC | SEQ ID NO: 985 |
| ID414 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATCCTCACTCCTGCTCGGTGAATTTGGC CGGCATGGTCCCAGCCTCCTCGCTGGCGCCGGCTGGGAACAT GCTTCGGCATGGCGAATGGGAC | SEQ ID NO: 986 |
| ID415 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTCTCGTAGATCCTCACTCCTGCTCGGTGAATTTGGCC GGCATGGTCCCAGCCTCCTCGCTGGCGCCGGCTGGGAACATG CTTCGGCATGGCGAATGGGAC | SEQ ID NO: 987 |

TABLE S3-continued crRNA cassette sequences HEK293T

| Cas12a nuclease | Target | Full cassette sequence | SEQ ID NO: |
|---|---|---|---|
| ID416 | DNMT1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATGGCTCTGGGACTCAGGCGGGTCAGG CCGGCATGGTCCCAGCCTCCTCGCTGGCGCCGGCTGGGCAACAT GCTTCGGCATGGCGAATGGGAC | SEQ ID NO: 988 |
| ID416 | DNMT1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATGCTCAGCAGGCACCTGCCTCAGCGG CCGGCATGGTCCCAGCCTCCTCGCTGGCGCCGGCTGGGCAACAT GCTTCGGCATGGCGAATGGGAC | SEQ ID NO: 989 |
| ID417 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 990 |
| ID418 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 991 |
| ID419 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAG AATTTCTACTGTTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 992 |
| ID420 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 993 |
| ID421 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 994 |
| ID422 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 995 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAA AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | |
| ID423 | DNMT1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCGA AATTTCTACTATCGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 996 |
| ID423 | DNMT1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCGA AATTTCTACTATCGTAGATCGATGGTCCATGTCTGTTACTCGGC CGGCATGGTCCCAGCCTCCTCGCTGGCGCCGGCTGGGCAACAT GCTTCGGCATGGCGAATGGGAC | SEQ ID NO: 997 |
| ID424 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 998 |
| ID425 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 999 |
| ID426 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTCA ATTTCTACTGTTGTAGATCCTCACTCCTGCTCGGTGAATTTGGCC GGCATGGTCCCAGCCTCCTCGCTGGCGCCGGCTGGGCAACATG CTTCGGCATGGCGAATGGGAC | SEQ ID NO: 1000 |
| ID427 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 1001 |
| ID428 | DNMT1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATTGGGACTCAGGCGGGTCACCTACGG CCGGCATGGTCCCAGCCTCCTCGCTGGCGCCGGCTGGGCAACAT GCTTCGGCATGGCGAATGGGAC | SEQ ID NO: 1002 |

TABLE S3-continued crRNA cassette sequences HEK293T

| Cas12a nuclease | Target | Full cassette sequence | SEQ ID NO: |
|---|---|---|---|
| ID428 | DNMT1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATAGGCGGGTCACCTACCCACGTTCGG CCGGCATGGTCCCAGCCTCCTCGCTGGCGCCGGCTGGGCAACAT GCTTCGGCATGGCGAATGGGAC | SEQ ID NO: 1003 |
| ID428 | DNMT1_T3 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATAGCAGGCACCTGCCTCAGCTGCTGG CCGGCATGGTCCCAGCCTCCTCGCTGGCGCCGGCTGGGCAACAT GCTTCGGCATGGCGAATGGGAC | SEQ ID NO: 1004 |
| ID428 | DNMT1_T4 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATACTCCTGCTCGGTGAATTTGGCTGGC CGGCATGGTCCCAGCCTCCTCGCTGGCGCCGGCTGGGCAACAT GCTTCGGCATGGCGAATGGGAC | SEQ ID NO: 1005 |
| ID429 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 1006 |
| ID432 | DNMT1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATCCTCACTCCTGCTCGGTGAATTTGGC CGGCATGGTCCCAGCCTCCTCGCTGGCGCCGGCTGGGCAACAT GCTTCGGCATGGCGAATGGGAC | SEQ ID NO: 1007 |
| ID433 | DNMT1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTGCTATTGCAGATACTCCTGCTCGGTGAATTTGGCTGGC CGGCATGGTCCCAGCCTCCTCGCTGGCGCCGGCTGGGCAACAT GCTTCGGCATGGCGAATGGGAC | SEQ ID NO: 1008 |
| ID433 | DNMT1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTGCTATTGCAGATAGCAGGCACCTGCCTCAGCTGCTGG CCGGCATGGTCCCAGCCTCCTCGCTGGCGCCGGCTGGGCAACAT GCTTCGGCATGGCGAATGGGAC | SEQ ID NO: 1009 |
| ID433 | DNMT1_T3 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1010 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAA AATTTCTGCTATTGCAGATAGGCGGGTCACCTACCCACGTTCGG CCGGCATGGTCCCAGCCTCCTCGCTGGCGCCGGCTGGGAACAT GCTTCGGCATGGCGAATGGGAC | |
| LbaCas12a | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA ATTTCTACTAAGTGTAGATCAGGAGGAAGCGATGGCTTCAGGG CCGGCATGGTCCCAGCCTCCTCGCTGGCGCCGGCTGGGAACAT GCTTCGGCATGGCGAATGGGAC | SEQ ID NO: 1011 |
| ID401 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAG AATTTCTACTGTTGTAGATCAGGAGGAAGCGATGGCTTCAGGGC CGGCATGGTCCCAGCCTCCTCGCTGGCGCCGGCTGGGAACAT GCTTCGGCATGGCGAATGGGAC | SEQ ID NO: 1012 |
| ID402 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATCAGGAGGAAGCGATGGCTTCAGGGC CGGCATGGTCCCAGCCTCCTCGCTGGCGCCGGCTGGGAACAT GCTTCGGCATGGCGAATGGGAC | SEQ ID NO: 1013 |
| ID403 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCAGGAGGAAGCGATGGCTTCAGGGC CGGCATGGTCCCAGCCTCCTCGCTGGCGCCGGCTGGGAACAT GCTTCGGCATGGCGAATGGGAC | SEQ ID NO: 1014 |
| ID404 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATCAGGAGGAAGCGATGGCTTCAGGGC CGGCATGGTCCCAGCCTCCTCGCTGGCGCCGGCTGGGAACAT GCTTCGGCATGGCGAATGGGAC | SEQ ID NO: 1015 |
| ID405 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTG AATTTCTACTGTTGTAGATCAGGAGGAAGCGATGGCTTCAGGGC CGGCATGGTCCCAGCCTCCTCGCTGGCGCCGGCTGGGAACAT GCTTCGGCATGGCGAATGGGAC | SEQ ID NO: 1016 |
| ID406 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCAGGAGGAAGCGATGGCTTCAGGGC CGGCATGGTCCCAGCCTCCTCGCTGGCGCCGGCTGGGAACAT GCTTCGGCATGGCGAATGGGAC | SEQ ID NO: 1017 |

TABLE S3-continued crRNA cassette sequences HEK293T

| Cas12a nuclease | Target | Full cassette sequence | SEQ ID NO: |
|---|---|---|---|
| ID407 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1018 |
| ID408 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTGCTATTGCAGATCAGGAGGAAGCGATGGCTTCAGGG CCGGCATGGTCCCAGCCTCCTCGCTGGCGCCGGCTGGGCAACAT GCTTCGGCATGGCGAATGGGAC | SEQ ID NO: 1019 |
| ID409 | RUNX1_ T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATAGCTTTGCCTGTAATGAAATGGCGGC CGGCATGGTCCCAGCCTCCTCGCTGGCGCCGGCTGGGCAACAT GCTTCGGCATGGCGAATGGGAC | SEQ ID NO: 1020 |
| ID409 | RUNX1_ T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATGGTGCAGAGATGCCTCGGTGCCTGG CCGGCATGGTCCCAGCCTCCTCGCTGGCGCCGGCTGGGCAACAT GCTTCGGCATGGCGAATGGGAC | SEQ ID NO: 1021 |
| ID410 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1022 |
| ID411 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1023 |
| ID412 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTATTGTAGATCAGGAGGAAGCGATGGCTTCAGGGCC GGCATGGTCCCAGCCTCCTCGCTGGCGCCGGCTGGGCAACATG CTTCGGCATGGCGAATGGGAC | SEQ ID NO: 1024 |
| ID413 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1025 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAT<br>AATTTCTACTATTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | |
| ID414 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTGTTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1026 |
| ID415 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTTA<br>ATTTCTACTCTCGTAGATCAGGAGGAAGCGATGGCTTCAGGGCC<br>GGCATGGTCCCAGCCTCCTCGCTGGCGCCGGCTGGGCAACATG<br>CTTCGGCATGGCGAATGGGAC | SEQ ID NO: 1027 |
| ID416 | RUNX1_<br>T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATCGTAGATTTTTTACAAAGGTGCATTTITTAGGC<br>CGGCATGGTCCCAGCCTCCTCGCTGGCGCCGGCTGGGCAACAT<br>GCTTCGGCATGGCGAATGGGAC | SEQ ID NO: 1028 |
| ID416 | RUNX1_<br>T2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATCGTAGATCTCAGCTTTGCCTGTAATGAAATGGC<br>CGGCATGGTCCCAGCCTCCTCGCTGGCGCCGGCTGGGCAACAT<br>GCTTCGGCATGGCGAATGGGAC | SEQ ID NO: 1029 |
| ID417 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTGTTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1030 |
| ID418 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1031 |
| ID419 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAG<br>AATTTCTACTGTTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1032 |

TABLE S3-continued crRNA cassette sequences HEK293T

| Cas12a nuclease | Target | Full cassette sequence | SEQ ID NO: |
|---|---|---|---|
| ID420 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1033 |
| ID421 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1034 |
| ID422 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1035 |
| ID423 | RUNX1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCGA AATTTCTACTATCGTAGATAGACAGCATATTTGAGTCATTTCGGC CGGCATGGTCCCAGCCTCCTCGCTGGCGCCGGCTGGGCAACAT GCTTCGGCATGGCGAATGGGAC | SEQ ID NO: 1036 |
| ID423 | RUNX1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCGA AATTTCTACTATCGTAGATACCTCGGTGCAGAGATGCCTCGGGG CCGGCATGGTCCCAGCCTCCTCGCTGGCGCCGGCTGGGCAACAT GCTTCGGCATGGCGAATGGGAC | SEQ ID NO: 1037 |
| ID424 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1038 |
| ID425 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATCAGGAGGAAGCGATGGCTTCAGGGC CGGCATGGTCCCAGCCTCCTCGCTGGCGCCGGCTGGGCAACAT GCTTCGGCATGGCGAATGGGAC | SEQ ID NO: 1039 |
| ID426 | RUNX1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1040 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCTCA<br>ATTTCTACTGTTGTAGATCAGGAGGAAGCGATGGCTTCAGGGCC<br>GGCATGGTCCCAGCCTCCTCGCTGGCGCCGGCTGGGCAACATG<br>CTTCGGCATGGCGAATGGGAC | |
| ID427 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1041 |
| ID428 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1042 |
| ID429 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTGTTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1043 |
| ID432 | RUNX1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTGTTGTAGATCAGGAGGAAGCGATGGCTTCAGGGC<br>CGGCATGGTCCCAGCCTCCTCGCTGGCGCCGGCTGGGCAACAT<br>GCTTCGGCATGGCGAATGGGAC | SEQ ID NO: 1044 |
| ID433 | RUNX1_<br>T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTGCTATTGCAGATAGCTTTGCCTGTAATGAAATGGCGG<br>CCGGCATGGTCCCAGCCTCCTCGCTGGCGCCGGCTGGGCAACAT<br>GCTTCGGCATGGCGAATGGGAC | SEQ ID NO: 1045 |
| ID433 | RUNX1_<br>T2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTGCTATTGCAGATGGTGCAGAGATGCCTCGGTGCCTGG<br>CCGGCATGGTCCCAGCCTCCTCGCTGGCGCCGGCTGGGCAACAT<br>GCTTCGGCATGGCGAATGGGAC | SEQ ID NO: 1046 |
| LbaCas12a | SCN1A | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>ATTTCTACTAAGTGTAGATCTCCATCTTGTCATCCTGCAGGCCGG<br>CATGGTCCCAGCCTCCTCGCTGGCGCCGGCTGGGCAACATGCTT<br>CGGCATGGCGAATGGGAC | SEQ ID NO: 1047 |

TABLE S3-continued crRNA cassette sequences HEK293T

| Cas12a nuclease | Target | Full cassette sequence | SEQ ID NO: |
|---|---|---|---|
| ID401 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAG AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1048 |
| ID402 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1049 |
| ID403 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1050 |
| ID404 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1051 |
| ID405 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTG AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1052 |
| ID406 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1053 |
| ID407 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1054 |
| ID408 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1055 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAA AATTTCTGCTATTGCAGATCTCCATCTTGTCATCCTGCAGGCCGG CATGGTCCCAGCCTCCTCGCTGGCGCCGGCTGGGCAACATGCTT CGGCATGGCGAATGGGAC | |
| ID409 | SCN1A_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATTGGTGAAGAAGTTGAAGCTGTCAGG CCGGCATGGTCCCAGCCTCCTCGCTGGCGCCGGCTGGGCAACAT GCTTCGGCATGGCGAATGGGAC | SEQ ID NO: 1056 |
| ID409 | SCN1A_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATCATCTTGTCATCCTGCACATTTTGGCC GGCATGGTCCCAGCCTCCTCGCTGGCGCCGGCTGGGCAACATG CTTCGGCATGGCGAATGGGAC | SEQ ID NO: 1057 |
| ID410 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1058 |
| ID411 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1059 |
| ID412 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTATTGTAGATCTCCATCTTGTCATCCTGCAGGCCGGC ATGGTCCCAGCCTCCTCGCTGGCGCCGGCTGGGCAACATGCTTC GGCATGGCGAATGGGAC | SEQ ID NO: 1060 |
| ID413 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1061 |
| ID414 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1062 |

TABLE S3-continued crRNA cassette sequences HEK293T

| Cas12a nuclease | Target | Full cassette sequence | SEQ ID NO: |
|---|---|---|---|
| ID415 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTCTCGTAGATCTCCATCTTGTCATCCTGCAGGCCGGC ATGGTCCCAGCCTCCTCGCTGGCGCCGGCTGGGCAACATGCTTC GGCATGGCGAATGGGAC | SEQ ID NO: 1063 |
| ID416 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1064 |
| ID417 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1065 |
| ID418 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1066 |
| ID419 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAG AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1067 |
| ID420 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1068 |
| ID421 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1069 |
| ID422 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1070 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAA<br>AATTTCTACTATTGTAGATCTCCATCTTGTCATCCTGCAGGCCGG<br>CATGGTCCCAGCCTCCTCGCTGGCGCCGGCTGGGCAACATGCTT<br>CGGCATGGCGAATGGGAC | |
| ID423 | SCN1A_<br>T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCGA<br>AATTTCTACTATCGTAGATTTTGCCTTTTCTTCTGCAATGCGGGC<br>CGGCATGGTCCCAGCCTCCTCGCTGGCGCCGGCTGGGCAACAT<br>GCTTCGGCATGGCGAATGGGAC | SEQ ID NO: 1071 |
| ID423 | SCN1A_<br>T2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCGA<br>AATTTCTACTATCGTAGATTCTGGTGAAGAAGTTGAAGCTGTGG<br>CCGGCATGGTCCCAGCCTCCTCGCTGGCGCCGGCTGGGCAACAT<br>GCTTCGGCATGGCGAATGGGAC | SEQ ID NO: 1072 |
| ID424 | SCN1A | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATCTCCATCTTGTCATCCTGCAGGCCGG<br>CATGGTCCCAGCCTCCTCGCTGGCGCCGGCTGGGCAACATGCTT<br>CGGCATGGCGAATGGGAC | SEQ ID NO: 1073 |
| ID425 | SCN1A | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATCTCCATCTTGTCATCCTGCAGGCCGG<br>CATGGTCCCAGCCTCCTCGCTGGCGCCGGCTGGGCAACATGCTT<br>CGGCATGGCGAATGGGAC | SEQ ID NO: 1074 |
| ID426 | SCN1A | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTCA<br>ATTTCTACTGTTGTAGATCTCCATCTTGTCATCCTGCAGGCCGGC<br>ATGGTCCCAGCCTCCTCGCTGGCGCCGGCTGGGCAACATGCTTC<br>GGCATGGCGAATGGGAC | SEQ ID NO: 1075 |
| ID427 | SCN1A | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATCTCCATCTTGTCATCCTGCAGGCCGG<br>CATGGTCCCAGCCTCCTCGCTGGCGCCGGCTGGGCAACATGCTT<br>CGGCATGGCGAATGGGAC | SEQ ID NO: 1076 |
| ID428 | SCN1A | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATCTCCATCTTGTCATCCTGCAGGCCGG<br>CATGGTCCCAGCCTCCTCGCTGGCGCCGGCTGGGCAACATGCTT<br>CGGCATGGCGAATGGGAC | SEQ ID NO: 1077 |

TABLE S3-continued crRNA cassette sequences HEK293T

| Cas12a nuclease | Target | Full cassette sequence | SEQ ID NO: |
|---|---|---|---|
| ID429 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1078 |
| ID432 | SCN1A | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATCTCCATCTTGTCATCCTGCAGGCCGG CATGGTCCCAGCCTCCTCGCTGGCGCCGGCTGGGCAACATGCTT CGGCATGGCGAATGGGAC | SEQ ID NO: 1079 |
| ID433 | SCN1A_ T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTGCTATTGCAGATTGGTGAAGAAGTTGAAGCTGTCAGG CCGGCATGGTCCCAGCCTCCTCGCTGGCGCCGGCTGGGCAACAT GCTTCGGCATGGCGAATGGGAC | SEQ ID NO: 1080 |
| ID433 | SCN1A_ T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTGCTATTGCAGATCATCTTGTCATCCTGCACATTTGGC CGGCATGGTCCCAGCCTCCTCGCTGGCGCCGGCTGGGCAACAT GCTTCGGCATGGCGAATGGGAC | SEQ ID NO: 1081 |
| LbaCas12a | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA ATTTCTACTAAGTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1082 |
| ID401 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAG AATTTCTACTGTTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1083 |
| ID402 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1084 |
| ID403 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1085 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAA<br>AATTTCTACTATTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | |
| ID404 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTCTTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1086 |
| ID405 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTG<br>AATTTCTACTGTTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1087 |
| ID406 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTGTTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1088 |
| ID407 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1089 |
| ID408 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTGCTATTGCAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1090 |
| ID409 | FANCF site 1_T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATATGAATCCCTTCTGCAGCACCTGGC<br>CGGCATGGTCCCAGCCTCCTCGCTGGCGCCGGCTGGGCAACAT<br>GCTTCGGCATGGCGAATGGGAC | SEQ ID NO: 1091 |
| ID409 | FANCF site 1_T2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATAAGCACTACCTACGTCAGCACCTGGC<br>CGGCATGGTCCCAGCCTCCTCGCTGGCGCCGGCTGGGCAACAT<br>GCTTCGGCATGGCGAATGGGAC | SEQ ID NO: 1092 |

TABLE S3-continued crRNA cassette sequences HEK293T

| Cas12a nuclease | Target | Full cassette sequence | SEQ ID NO: |
|---|---|---|---|
| ID410 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1093 |
| ID411 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1094 |
| ID412 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTATTGTAGATGTCGGCATGGCCCCATTCGCACGGGC CGGCATGGTCCCAGCCTCCTCGCTGGCGCCGGCTGGGCAACAT GCTTCGGCATGGCGAATGGGAC | SEQ ID NO: 1095 |
| ID413 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1096 |
| ID414 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTGTTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1097 |
| ID415 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTTA ATTTCTACTCTCGTAGATGTCGGCATGGCCCCATTCGCACGGGC CGGCATGGTCCCAGCCTCCTCGCTGGCGCCGGCTGGGCAACAT GCTTCGGCATGGCGAATGGGAC | SEQ ID NO: 1098 |
| ID416 | FANCF site 1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATTCCTAAAAATTACGAAAACGAAAGG CCGGCATGGTCCCAGCCTCCTCGCTGGCGCCGGCTGGGCAACAT GCTTCGGCATGGCGAATGGGAC | SEQ ID NO: 1099 |
| ID416 | FANCF site 1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1100 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAT<br>AATTTCTACTATCGTAGATAAAAACCTCAACACAGATTCTAGGG<br>CCGGCATGGTCCCAGCCTCCTCGCTGGCGCCGGCTGGGCAACAT<br>GCTTCGGCATGGCGAATGGGAC | |
| ID417 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTGTTGTAGATGTCGGCATGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1101 |
| ID418 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATGTCGGCATGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1102 |
| ID419 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAG<br>AATTTCTACTGTTGTAGATGTCGGCATGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1103 |
| ID420 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATGTCGGCATGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1104 |
| ID421 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATGTCGGCATGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1105 |
| ID422 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATGTCGGCATGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1106 |
| ID423 | FANCF site 1_T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCGA<br>AATTTCTACTATCGTAGATAAATAATCTGGGCTTCAGTTCTAGGC<br>CGGCATGGTCCCAGCCTCCTCGCTGGCGCCGGCTGGGCAACAT<br>GCTTCGGCATGGCGAATGGGAC | SEQ ID NO: 1107 |

TABLE S3-continued crRNA cassette sequences HEK293T

| Cas12a nuclease | Target | Full cassette sequence | SEQ ID NO: |
|---|---|---|---|
| ID423 | FANCF site 1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCGA AATTTCTACTATCGTAGATCTCACGTCACAGTATGTCTCTGGGGC CGGCATGGTCCCAGCCTCCTCGCTGGCGCCGGCTGGGCAACAT GCTTCGGCATGGCGAATGGGAC | SEQ ID NO: 1108 |
| ID424 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1109 |
| ID425 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1110 |
| ID426 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTCA ATTTCTACTGTTGTAGATGTCGGCATGGCCCCATTCGCACGGGC CGGCATGGTCCCAGCCTCCTCGCTGGCGCCGGCTGGGCAACAT GCTTCGGCATGGCGAATGGGAC | SEQ ID NO: 1111 |
| ID427 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATGTCGGCATGGCCCCATTCGCACGGG CCGGCATGGTCCCAGCCTCCTCGCTGGCGCCGGCTGGGCAACAT GCTTCGGCATGGCGAATGGGAC | SEQ ID NO: 1112 |
| ID428 | FANCF site 1_T1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATTGGCGTTACTTAATTTTGAAAAAGGC CGGCATGGTCCCAGCCTCCTCGCTGGCGCCGGCTGGGCAACAT GCTTCGGCATGGCGAATGGGAC | SEQ ID NO: 1113 |
| ID428 | FANCF site 1_T2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTATTGTAGATAAGCACTACCTACGTCAGCACCTGGC CGGCATGGTCCCAGCCTCCTCGCTGGCGCCGGCTGGGCAACAT GCTTCGGCATGGCGAATGGGAC | SEQ ID NO: 1114 |
| ID429 | FANCF site 1 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1115 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAT<br>AATTTCTACTGTTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | |
| ID432 | FANCF site 1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTGTTGTAGATGTCGGCATGGCCCCATTCGCACGGG<br>CCGGCATGGTCCCAGCCTCCTCGCTGGCGCCGGCTGGGCAACAT<br>GCTTCGGCATGGCGAATGGGAC | SEQ ID NO: 1116 |
| ID433 | FANCF site 1_T1 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTGCTATTGCAGATTGGCGTTACTTAATTTTGAAAAAGGC<br>CGGCATGGTCCCAGCCTCCTCGCTGGCGCCGGCTGGGCAACAT<br>GCTTCGGCATGGCGAATGGGAC | SEQ ID NO: 1117 |
| ID433 | FANCF site 1_T2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTGCTATTGCAGATAAGCACTACCTACGTCAGCACCTGGC<br>CGGCATGGTCCCAGCCTCCTCGCTGGCGCCGGCTGGGCAACAT<br>GCTTCGGCATGGCGAATGGGAC | SEQ ID NO: 1118 |
| LbaCas12a | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>ATTTCTACTAAGTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1119 |
| ID401 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAG<br>AATTTCTACTGTTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1120 |
| ID402 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTCTTGTAGATGCGGATGTTCCAATCAGTACGCGGCC<br>GGCATGGTCCCAGCCTCCTCGCTGGCGCCGGCTGGGCAACATG<br>CTTCGGCATGGCGAATGGGAC | SEQ ID NO: 1121 |
| ID403 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1122 |

TABLE S3-continued crRNA cassette sequences HEK293T

| Cas12a nuclease | Target | Full cassette sequence | SEQ ID NO: |
|---|---|---|---|
| ID404 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTCTTGTAGATGCGGATGTTCCAATCAGTACGCGGCC GGCATGGTCCCAGCCTCCTCGCTGGCGCCGGCTGGGCAACATG CTTCGGCATGGCGAATGGGAC | SEQ ID NO: 1123 |
| ID405 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTG AATTTCTACTGTTGTAGATGCGGATGTTCCAATCAGTACGCGGC CGGCATGGTCCCAGCCTCCTCGCTGGCGCCGGCTGGGCAACAT GCTTCGGCATGGCGAATGGGAC | SEQ ID NO: 1124 |
| ID406 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATGCGGATGTTCCAATCAGTACGCGGC CGGCATGGTCCCAGCCTCCTCGCTGGCGCCGGCTGGGCAACAT GCTTCGGCATGGCGAATGGGAC | SEQ ID NO: 1125 |
| ID407 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTACTATTGTAGATGCGGATGTTCCAATCAGTACGCGGC CGGCATGGTCCCAGCCTCCTCGCTGGCGCCGGCTGGGCAACAT GCTTCGGCATGGCGAATGGGAC | SEQ ID NO: 1126 |
| ID408 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAA AATTTCTGCTATTGCAGATGCGGATGTTCCAATCAGTACGCGGC CGGCATGGTCCCAGCCTCCTCGCTGGCGCCGGCTGGGCAACAT GCTTCGGCATGGCGAATGGGAC | SEQ ID NO: 1127 |
| ID410 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCAT AATTTCTACTATCGTAGATGCGGATGTTCCAATCAGTACGCGGC CGGCATGGTCCCAGCCTCCTCGCTGGCGCCGGCTGGGCAACAT GCTTCGGCATGGCGAATGGGAC | SEQ ID NO: 1128 |
| ID411 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC GATTTCTTGGCTTTATATATCTTGTGGAAAGGACGAAACACCTA AATTTCTACTGTTGTAGATGCGGATGTTCCAATCAGTACGCGGC CGGCATGGTCCCAGCCTCCTCGCTGGCGCCGGCTGGGCAACAT GCTTCGGCATGGCGAATGGGAC | SEQ ID NO: 1129 |
| ID412 | FANCF site 2 | AAGGTCGGGCAGGAAGAGGGCCTATTTCCCATGATTCCTTCATA TTTGCATATACGATACAAGGCTGTTAGAGAGATAATTAGAATTA ATTTGACTGTAAACACAAAGATATTAGTACAAAATACGTGACGT AGAAAGTAATAATTTCTTGGGTAGTTTGCAGTTTTAAAATTATGT TTTAAAATGGACTATCATATGCTTACCGTAACTTGAAAGTATTTC | SEQ ID NO: 1130 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCTTA<br>ATTTCTACTATTGTAGATGCGGATGTTCCAATCAGTACGCGGCC<br>GGCATGGTCCCAGCCTCCTCGCTGGCGCCGGCTGGGCAACATG<br>CTTCGGCATGGCGAATGGGAC | |
| ID413 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1131 |
| ID414 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTGTTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1132 |
| ID415 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTTA<br>ATTTCTACTCTCGTAGATGCGGATGTTCCAATCAGTACGCGGCC<br>GGCATGGTCCCAGCCTCCTCGCTGGCGCCGGCTGGGCAACATG<br>CTTCGGCATGGCGAATGGGAC | SEQ ID NO: 1133 |
| ID417 | FANCF site 2 | AAGGTCGGGCAGGAAGAGGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTGTTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1134 |
| ID418 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1135 |
| ID419 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAG<br>AATTTCTACTGTTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1136 |
| ID420 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1137 |

TABLE S3-continued crRNA cassette sequences HEK293T

| Cas12a nuclease | Target | Full cassette sequence | SEQ ID NO: |
|---|---|---|---|
| ID421 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1138 |
| ID422 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1139 |
| ID424 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1140 |
| ID425 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTA<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1141 |
| ID426 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCTCA<br>ATTTCTACTGTTGTAGATGCGGATGTTCCAATCAGTACGCGGCC<br>GGCATGGTCCCAGCCTCCTCGCTGGCGCCGGCTGGGCAACATG<br>CTTCGGCATGGCGAATGGGAC | SEQ ID NO: 1142 |
| ID427 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAA<br>AATTTCTACTATTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1143 |
| ID429 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC<br>GATTTCTTGGCTTTATATATCTTGTGGAAAGGACGAAACACCAT<br>AATTTCTACTGTTGTAGATGCGGATGTTCCAATCAGTACGCGGC<br>CGGCATGGTCCCAGCCTCCTCGCTGGCGCCGGCTGGGCAACAT<br>GCTTCGGCATGGCGAATGGGAC | SEQ ID NO: 1144 |
| ID432 | FANCF site 2 | AAGGTCGGGCAGGAAGAGGGCCTATTTCCCATGATTCCTTCATA<br>TTTGCATATACGATACAAGGCTGTTAGAGAGATAATTAGAATTA<br>ATTTGACTGTAAACACAAAGATATTAGTACAAAATACGTGACGT<br>AGAAAGTAATAATTTCTTGGGTAGTTTGCAGTTTTAAAATTATGT<br>TTTAAAATGGACTATCATATGCTTACCGTAACTTGAAAGTATTTC | SEQ ID NO: 1145 |

TABLE S3-continued crRNA cassette sequences HEK293T

| Cas12a nuclease | Target | Full cassette sequence | SEQ ID NO: |
|---|---|---|---|
| | | GATTTCTTGGCTTTATATATCTTGTGGAAAGGACGAAACACCAT AATTTCTACTGTTGTAGATGCGGATGTTCCAATCAGTACGCGGC CGGCATGGTCCCAGCCTCCTCGCTGGCGCCGGCTGGGCAACAT GCTTCGGCATGGCGAATGGGAC | |

TABLE S4 crRNA sequences HEK293T

| Cas12a nuclease | Target | CRNA sequence |
|---|---|---|
| LbaCas12a | DNMT1 | UAAUUUCUACUAAGUGUAGAUCCUCACUCCUGCUCGGUGAAUUU (SEQ ID NO: 1146) |
| ID401 | DNMT1 | AGAAUUUCUACUGUUGUAGAUCCUCACUCCUGCUCGGUGAAUUU (SEQ ID NO: 1147) |
| ID402 | DNMT1 | AAAAUUUCUACUCUUGUAGAUCCUCACUCCUGCUCGGUGAAUUU (SEQ ID NO: 1148) |
| ID403 | DNMT1 | AAAAUUUCUACUAUUGUAGAUCCUCACUCCUGCUCGGUGAAUUU (SEQ ID NO: 1149) |
| ID404 | DNMT1 | AAAAUUUCUACUCUUGUAGAUCCUCACUCCUGCUCGGUGAAUUU (SEQ ID NO: 1150) |
| ID405 | DNMT1 | UGAAUUUCUACUGUUGUAGAUCCUCACUCCUGCUCGGUGAAUUU (SEQ ID NO: 1151) |
| ID406 | DNMT1 | UAAUUUCUACUGUUGUAGAUCCUCACUCCUGCUCGGUGAAUUU (SEQ ID NO: 1152) |
| ID407 | DNMT1 | AAAAUUUCUACUAUUGUAGAUCCUCACUCCUGCUCGGUGAAUUU (SEQ ID NO: 1153) |
| ID408 | DNMT1 | AAAAUUUCUGCUAUUGCAGAUCCUCACUCCUGCUCGGUGAAUUU (SEQ ID NO: 1154) |
| ID409 | DNMT1_T1 | UAAAUUUCUACUAUUGUAGAUUGGGACUCAGGCGGGUCACCUAC (SEQ ID NO: 1155) |
| ID409 | DNMT1_T2 | UAAAUUUCUACUAUUGUAGAUAGCAGGCACCUGCCUCAGCUGCU (SEQ ID NO: 1156) |
| ID409 | DNMT1_T3 | UAAAUUUCUACUAUUGUAGAUAGGCGGGUCACCUACCCACGUUC (SEQ ID NO: 1157) |
| ID409 | DNMT1_T4 | UAAAUUUCUACUAUUGUAGAUACUCCUGCUCGGUGAAUUUGGCU (SEQ ID NO: 1158) |
| ID410 | DNMT1 | AUAAUUUCUACUAUCGUAGAUCCUCACUCCUGCUCGGUGAAUUU (SEQ ID NO: 1159) |
| ID411 | DNMT1 | UAAUUUCUACUGUUGUAGAUCCUCACUCCUGCUCGGUGAAUUU (SEQ ID NO: 1160) |
| ID412 | DNMT1 | UUAAUUUCUACUAUUGUAGAUCCUCACUCCUGCUCGGUGAAUUU (SEQ ID NO: 1161) |
| ID413 | DNMT1 | AUAAUUUCUACUAUUGUAGAUCCUCACUCCUGCUCGGUGAAUUU (SEQ ID NO: 1162) |
| ID414 | DNMT1 | AUAAUUUCUACUGUUGUAGAUCCUCACUCCUGCUCGGUGAAUUU (SEQ ID NO: 1163) |
| ID415 | DNMT1 | UUAAUUUCUACUCUCGUAGAUCCUCACUCCUGCUCGGUGAAUUU (SEQ ID NO: 1164) |
| ID416 | DNMT1_T1 | AUAAUUUCUACUAUCGUAGAUGGCUCUGGGACUCAGGCGGGUCA (SEQ ID NO: 1165) |

TABLE S4-continued crRNA sequences HEK293T

| Cas12a nuclease | Target | CRNA sequence |
|---|---|---|
| ID416 | DNMT1_T2 | AUAAUUUCUACUAUCGUAGAUGCUCAGCAGGCACCUGCCUCAGC (SEQ ID NO: 1166) |
| ID417 | DNMT1 | UAAAUUUCUACUGUUGUAGAUCCUCACUCCUGCUCGGUGAAUUU (SEQ ID NO: 1167) |
| ID418 | DNMT1 | UAAAUUUCUACUAUUGUAGAUCCUCACUCCUGCUCGGUGAAUUU (SEQ ID NO: 1168) |
| ID419 | DNMT1 | AGAAUUUCUACUGUUGUAGAUCCUCACUCCUGCUCGGUGAAUUU (SEQ ID NO: 1169) |
| ID420 | DNMT1 | AUAAUUUCUACUAUUGUAGAUCCUCACUCCUGCUCGGUGAAUUU (SEQ ID NO: 1170) |
| ID421 | DNMT1 | AUAAUUUCUACUAUUGUAGAUCCUCACUCCUGCUCGGUGAAUUU (SEQ ID NO: 1171) |
| ID422 | DNMT1 | AAAAUUUCUACUAUUGUAGAUCCUCACUCCUGCUCGGUGAAUUU (SEQ ID NO: 1172) |
| ID423 | DNMT1_T1 | GAAAUUUCUACUAUCGUAGAUCCUCACUCCUGCUCGGUGAAUUU (SEQ ID NO: 1173) |
| ID423 | DNMT1_T2 | GAAAUUUCUACUAUCGUAGAUCUGAUGGUCCAUGUCUGUUACUC (SEQ ID NO: 1174) |
| ID424 | DNMT1 | AUAAUUUCUACUAUUGUAGAUCCUCACUCCUGCUCGGUGAAUUU (SEQ ID NO: 1175) |
| ID425 | DNMT1 | UAAAUUUCUACUAUUGUAGAUCCUCACUCCUGCUCGGUGAAUUU (SEQ ID NO: 1176) |
| ID426 | DNMT1 | UCAAUUUCUACUGUUGUAGAUCCUCACUCCUGCUCGGUGAAUUU (SEQ ID NO: 1177) |
| ID427 | DNMT1 | AAAAUUUCUACUAUUGUAGAUCCUCACUCCUGCUCGGUGAAUUU (SEQ ID NO: 1178) |
| ID428 | DNMT1_T1 | UAAAUUUCUACUAUUGUAGAUUGGGACUCAGGCGGGUCACCUAC (SEQ ID NO: 1179) |
| ID428 | DNMT1_T2 | UAAAUUUCUACUAUUGUAGAUAGGCGGGUCACCUACCCACGUUC (SEQ ID NO: 1180) |
| ID428 | DNMT1_T3 | UAAAUUUCUACUAUUGUAGAUAGCAGGCACCUGCCUCAGCUGCU (SEQ ID NO: 1181) |
| ID428 | DNMT1_T4 | UAAAUUUCUACUAUUGUAGAUACUCCUGCUCGGUGAAUUUGGCU (SEQ ID NO: 1182) |
| ID429 | DNMT1 | AUAAUUUCUACUGUUGUAGAUCCUCACUCCUGCUCGGUGAAUUU (SEQ ID NO: 1183) |
| ID432 | DNMT1 | AUAAUUUCUACUGUUGUAGAUCCUCACUCCUGCUCGGUGAAUUU (SEQ ID NO: 1184) |
| ID433 | DNMT1_T1 | AAAAUUUCUGCUAUUGCAGAUACUCCUGCUCGGUGAAUUUGGCU (SEQ ID NO: 1185) |
| ID433 | DNMT1_T2 | AAAAUUUCUGCUAUUGCAGAUAGCAGGCACCUGCCUCAGCUGCU (SEQ ID NO: 1186) |
| ID433 | DNMT1_T3 | AAAAUUUCUGCUAUUGCAGAUAGGCGGGUCACCUACCCACGUUC (SEQ ID NO: 1187) |
| LbaCas12a | RUNX1 | UAAUUUCUACUAAGUGUAGAUCAGGAGGAAGCGAUGGCUUCAG (SEQ ID NO: 1188) |
| ID401 | RUNX1 | AGAAUUUCUACUGUUGUAGAUCAGGAGGAAGCGAUGGCUUCAG (SEQ ID NO: 1189) |
| ID402 | RUNX1 | AAAAUUUCUACUCUUGUAGAUCAGGAGGAAGCGAUGGCUUCAG (SEQ ID NO: 1190) |

TABLE S4-continued crRNA sequences HEK293T

| Cas12a nuclease | Target | CRNA sequence |
|---|---|---|
| ID403 | RUNX1 | AAAAUUUCUACUAUUGUAGAUCAGGAGGAAGCGAUGGCUUCAG (SEQ ID NO: 1191) |
| ID404 | RUNX1 | AAAAUUUCUACUCUUGUAGAUCAGGAGGAAGCGAUGGCUUCAG (SEQ ID NO: 1192) |
| ID405 | RUNX1 | UGAAUUUCUACUGUUGUAGAUCAGGAGGAAGCGAUGGCUUCAG (SEQ ID NO: 1193) |
| ID406 | RUNX1 | UAAAUUUCUACUGUUGUAGAUCAGGAGGAAGCGAUGGCUUCAG (SEQ ID NO: 1194) |
| ID407 | RUNX1 | AAAAUUUCUACUAUUGUAGAUCAGGAGGAAGCGAUGGCUUCAG (SEQ ID NO: 1195) |
| ID408 | RUNX1 | AAAAUUUCUGCUAUUGCAGAUCAGGAGGAAGCGAUGGCUUCAG (SEQ ID NO: 1196) |
| ID409 | RUNX1_T1 | UAAAUUUCUACUAUUGUAGAUAGCUUUGCCUGUAAUGAAAUGGC (SEQ ID NO: 1197) |
| ID409 | RUNX1_T2 | UAAAUUUCUACUAUUGUAGAUGGUGCAGAGAUGCCUCGGUGCCU (SEQ ID NO: 1198) |
| ID410 | RUNX1 | AUAAUUUCUACUAUCGUAGAUCAGGAGGAAGCGAUGGCUUCAG (SEQ ID NO: 1199) |
| ID411 | RUNX1 | UAAAUUUCUACUGUUGUAGAUCAGGAGGAAGCGAUGGCUUCAG (SEQ ID NO: 1200) |
| ID412 | RUNX1 | UUAAUUUCUACUAUUGUAGAUCAGGAGGAAGCGAUGGCUUCAG (SEQ ID NO: 1201) |
| ID413 | RUNX1 | AUAAUUUCUACUAUUGUAGAUCAGGAGGAAGCGAUGGCUUCAG (SEQ ID NO: 1202) |
| ID414 | RUNX1 | AUAAUUUCUACUGUUGUAGAUCAGGAGGAAGCGAUGGCUUCAG (SEQ ID NO: 1203) |
| ID415 | RUNX1 | UUAAUUUCUACUCUCGUAGAUCAGGAGGAAGCGAUGGCUUCAG (SEQ ID NO: 1204) |
| ID416 | RUNX1_T1 | AUAAUUUCUACUAUCGUAGAUUUUUUACAAAGGUGCAUUUUUUA (SEQ ID NO: 1205) |
| ID416 | RUNX1_T2 | AUAAUUUCUACUAUCGUAGAUCUCAGCUUUGCCUGUAAUGAAAU (SEQ ID NO: 1206) |
| ID417 | RUNX1 | UAAAUUUCUACUGUUGUAGAUCAGGAGGAAGCGAUGGCUUCAG (SEQ ID NO: 1207) |
| ID418 | RUNX1 | UAAAUUUCUACUAUUGUAGAUCAGGAGGAAGCGAUGGCUUCAG (SEQ ID NO: 1208) |
| ID419 | RUNX1 | AGAAUUUCUACUGUUGUAGAUCAGGAGGAAGCGAUGGCUUCAG (SEQ ID NO: 1209) |
| ID420 | RUNX1 | AUAAUUUCUACUAUUGUAGAUCAGGAGGAAGCGAUGGCUUCAG (SEQ ID NO: 1210) |
| ID421 | RUNX1 | AUAAUUUCUACUAUUGUAGAUCAGGAGGAAGCGAUGGCUUCAG (SEQ ID NO: 1211) |
| ID422 | RUNX1 | AAAAUUUCUACUAUUGUAGAUCAGGAGGAAGCGAUGGCUUCAG (SEQ ID NO: 1212) |
| ID423 | RUNX1_T1 | GAAAUUUCUACUAUCGUAGAUAGACAGCAUAUUUGAGUCAUUUC (SEQ ID NO: 1213) |
| ID423 | RUNX1_T2 | GAAAUUUCUACUAUCGUAGAUACCUCGGUGCAGAGAUGCCUCGG (SEQ ID NO: 1214) |
| ID424 | RUNX1 | AUAAUUUCUACUAUUGUAGAUCAGGAGGAAGCGAUGGCUUCAG (SEQ ID NO: 1215) |

TABLE S4-continued crRNA sequences HEK293T

| Cas12a nuclease | Target | CRNA sequence |
|---|---|---|
| ID425 | RUNX1 | UAAAUUUCUACUAUUGUAGAUCAGGAGGAAGCGAUGGCUUCAG (SEQ ID NO: 1216) |
| ID426 | RUNX1 | UCAAUUUCUACUGUUGUAGAUCAGGAGGAAGCGAUGGCUUCAG (SEQ ID NO: 1217) |
| ID427 | RUNX1 | AAAAUUUCUACUAUUGUAGAUCAGGAGGAAGCGAUGGCUUCAG (SEQ ID NO: 1218) |
| ID428 | RUNX1 | UAAAUUUCUACUAUUGUAGAUCAGGAGGAAGCGAUGGCUUCAG (SEQ ID NO: 1219) |
| ID429 | RUNX1 | AUAAUUUCUACUGUUGUAGAUCAGGAGGAAGCGAUGGCUUCAG (SEQ ID NO: 1220) |
| ID432 | RUNX1 | AUAAUUUCUACUGUUGUAGAUCAGGAGGAAGCGAUGGCUUCAG (SEQ ID NO: 1221) |
| ID433 | RUNX1_T1 | AAAAUUUCUGCUAUUGCAGAUAGCUUUGCCUGUAAUGAAAUGGC (SEQ ID NO: 1222) |
| ID433 | RUNX1_T2 | AAAAUUUCUGCUAUUGCAGAUGGUGCAGAGAUGCCUCGGUGCCU (SEQ ID NO: 1223) |
| LbaCas12a | SCN1A | UAAUUUCUACUAAGUGUAGAUCUCCAUCUUGUCAUCCUGCA (SEQ ID NO: 1224) |
| ID401 | SCN1A | AGAAUUUCUACUGUUGUAGAUCUCCAUCUUGUCAUCCUGCA (SEQ ID NO: 1225) |
| ID402 | SCN1A | AAAAUUUCUACUCUUGUAGAUCUCCAUCUUGUCAUCCUGCA (SEQ ID NO: 1226) |
| ID403 | SCN1A | AAAAUUUCUACUAUUGUAGAUCUCCAUCUUGUCAUCCUGCA (SEQ ID NO: 1227) |
| ID404 | SCN1A | AAAAUUUCUACUCUUGUAGAUCUCCAUCUUGUCAUCCUGCA (SEQ ID NO: 1228) |
| ID405 | SCN1A | UGAAUUUCUACUGUUGUAGAUCUCCAUCUUGUCAUCCUGCA (SEQ ID NO: 1229) |
| ID406 | SCN1A | UAAAUUUCUACUGUUGUAGAUCUCCAUCUUGUCAUCCUGCA (SEQ ID NO: 1230) |
| ID407 | SCN1A | AAAAUUUCUACUAUUGUAGAUCUCCAUCUUGUCAUCCUGCA (SEQ ID NO: 1231) |
| ID408 | SCN1A | AAAAUUUCUGCUAUUGCAGAUCUCCAUCUUGUCAUCCUGCA (SEQ ID NO: 1232) |
| ID409 | SCN1A_T1 | UAAAUUUCUACUAUUGUAGAUUGGUGAAGAAGUUGAAGCUGUCA (SEQ ID NO: 1233) |
| ID409 | SCN1A_T2 | UAAAUUUCUACUAUUGUAGAUCAUCUUGUCAUCCUGCACAUUUU (SEQ ID NO: 1234) |
| ID410 | SCN1A | AUAAUUUCUACUAUCGUAGAUCUCCAUCUUGUCAUCCUGCA (SEQ ID NO: 1235) |
| ID411 | SCN1A | UAAAUUUCUACUGUUGUAGAUCUCCAUCUUGUCAUCCUGCA (SEQ ID NO: 1236) |
| ID412 | SCN1A | UUAAUUUCUACUAUUGUAGAUCUCCAUCUUGUCAUCCUGCA (SEQ ID NO: 1237) |
| ID413 | SCN1A | AUAAUUUCUACUAUUGUAGAUCUCCAUCUUGUCAUCCUGCA (SEQ ID NO: 1238) |
| ID414 | SCN1A | AUAAUUUCUACUGUUGUAGAUCUCCAUCUUGUCAUCCUGCA (SEQ ID NO: 1239) |
| ID415 | SCN1A | UUAAUUUCUACUCUCGUAGAUCUCCAUCUUGUCAUCCUGCA (SEQ ID NO: 1240) |

TABLE S4-continued crRNA sequences HEK293T

| Cas12a nuclease | Target | CRNA sequence |
|---|---|---|
| ID416 | SCN1A | AUAAUUUCUACUAUCGUAGAUCUCCAUCUUGUCAUCCUGCA (SEQ ID NO: 1241) |
| ID417 | SCN1A | UAAAUUUCUACUGUUGUAGAUCUCCAUCUUGUCAUCCUGCA (SEQ ID NO: 1242) |
| ID418 | SCN1A | UAAAUUUCUACUAUUGUAGAUCUCCAUCUUGUCAUCCUGCA (SEQ ID NO: 1243) |
| ID419 | SCN1A | AGAAUUUCUACUGUUGUAGAUCUCCAUCUUGUCAUCCUGCA (SEQ ID NO: 1244) |
| ID420 | SCN1A | AUAAUUUCUACUAUUGUAGAUCUCCAUCUUGUCAUCCUGCA (SEQ ID NO: 1245) |
| ID421 | SCN1A | AUAAUUUCUACUAUUGUAGAUCUCCAUCUUGUCAUCCUGCA (SEQ ID NO: 1246) |
| ID422 | SCN1A | AAAAUUUCUACUAUUGUAGAUCUCCAUCUUGUCAUCCUGCA (SEQ ID NO: 1247) |
| ID423 | SCN1A_T1 | GAAAUUUCUACUAUCGUAGAUUUUGCCUUUUCUUCUGCAAUGCG (SEQ ID NO: 1248) |
| ID423 | SCN1A_T2 | GAAAUUUCUACUAUCGUAGAUUCUGGUGAAGAAGUUGAAGCUGU (SEQ ID NO: 1249) |
| ID424 | SCN1A | AUAAUUUCUACUAUUGUAGAUCUCCAUCUUGUCAUCCUGCA (SEQ ID NO: 1250) |
| ID425 | SCN1A | UAAAUUUCUACUAUUGUAGAUCUCCAUCUUGUCAUCCUGCA (SEQ ID NO: 1251) |
| ID426 | SCN1A | UCAAUUUCUACUGUUGUAGAUCUCCAUCUUGUCAUCCUGCA (SEQ ID NO: 1252) |
| ID427 | SCN1A | AAAAUUUCUACUAUUGUAGAUCUCCAUCUUGUCAUCCUGCA (SEQ ID NO: 1253) |
| ID428 | SCN1A | UAAAUUUCUACUAUUGUAGAUCUCCAUCUUGUCAUCCUGCA (SEQ ID NO: 1254) |
| ID429 | SCN1A | AUAAUUUCUACUGUUGUAGAUCUCCAUCUUGUCAUCCUGCA (SEQ ID NO: 1255) |
| ID432 | SCN1A | AUAAUUUCUACUGUUGUAGAUCUCCAUCUUGUCAUCCUGCA (SEQ ID NO: 1256) |
| ID433 | SCN1A_T1 | AAAAUUUCUGCUAUUGCAGAUUGGUGAAGAAGUUGAAGCUGUCA (SEQ ID NO: 1257) |
| ID433 | SCN1A_T2 | AAAAUUUCUGCUAUUGCAGAUCAUCUUGUCAUCCUGCACAUUUU (SEQ ID NO: 1258) |
| LbaCas12a | FANCF site 1 | UAAUUUCUACUAAGUGUAGAUGUCGGCAUGGCCCCAUUCGCACG (SEQ ID NO: 1259) |
| ID401 | FANCF site 1 | AGAAUUUCUACUGUUGUAGAUGUCGGCAUGGCCCCAUUCGCACG (SEQ ID NO: 1260) |
| ID402 | FANCF site 1 | AAAAUUUCUACUCUUGUAGAUGUCGGCAUGGCCCCAUUCGCACG (SEQ ID NO: 1261) |
| ID403 | FANCF site 1 | AAAAUUUCUACUAUUGUAGAUGUCGGCAUGGCCCCAUUCGCACG (SEQ ID NO: 1262) |
| ID404 | FANCF site 1 | AAAAUUUCUACUCUUGUAGAUGUCGGCAUGGCCCCAUUCGCACG (SEQ ID NO: 1263) |
| ID405 | FANCF site 1 | UGAAUUUCUACUGUUGUAGAUGUCGGCAUGGCCCCAUUCGCACG (SEQ ID NO: 1264) |
| ID406 | FANCF site 1 | UAAAUUUCUACUGUUGUAGAUGUCGGCAUGGCCCCAUUCGCACG (SEQ ID NO: 1265) |

TABLE S4-continued crRNA sequences HEK293T

| Cas12a nuclease | Target | CRNA sequence |
|---|---|---|
| ID407 | FANCF site 1 | AAAAUUUCUACUAUUGUAGAUGUCGGCAUGGCCCCAUUCGCACG (SEQ ID NO: 1266) |
| ID408 | FANCF site 1 | AAAAUUUCUGCUAUUGCAGAUGUCGGCAUGGCCCCAUUCGCACG (SEQ ID NO: 1267) |
| ID409 | FANCF site 1_T1 | UAAAUUUCUACUAUUGUAGAUAUGGAAUCCCUUCUGCAGCACCU (SEQ ID NO: 1268) |
| ID409 | FANCF site 1_T2 | UAAAUUUCUACUAUUGUAGAUAAGCACUACCUACGUCAGCACCU (SEQ ID NO: 1269) |
| ID410 | FANCF site 1 | AUAAUUUCUACUAUCGUAGAUGUCGGCAUGGCCCCAUUCGCACG (SEQ ID NO: 1270) |
| ID411 | FANCF site 1 | UAAAUUUCUACUGUUGUAGAUGUCGGCAUGGCCCCAUUCGCACG (SEQ ID NO: 1271) |
| ID412 | FANCF site 1 | UUAAUUUCUACUAUUGUAGAUGUCGGCAUGGCCCCAUUCGCACG (SEQ ID NO: 1272) |
| ID413 | FANCF site 1 | AUAAUUUCUACUAUUGUAGAUGUCGGCAUGGCCCCAUUCGCACG (SEQ ID NO: 1273) |
| ID414 | FANCF site 1 | AUAAUUUCUACUGUUGUAGAUGUCGGCAUGGCCCCAUUCGCACG (SEQ ID NO: 1274) |
| ID415 | FANCF site 1 | UUAAUUUCUACUCUCGUAGAUGUCGGCAUGGCCCCAUUCGCACG (SEQ ID NO: 1275) |
| ID416 | FANCF site 1_T1 | AUAAUUUCUACUAUCGUAGAUUCCUAAAAAUUACGAAAACGAAA (SEQ ID NO: 1276) |
| ID416 | FANCF site 1_T2 | AUAAUUUCUACUAUCGUAGAUAAAAACCUCAACACAGAUUCUAG (SEQ ID NO: 1277) |
| ID417 | FANCF site 1 | UAAAUUUCUACUGUUGUAGAUGUCGGCAUGGCCCCAUUCGCACG (SEQ ID NO: 1278) |
| ID418 | FANCF site 1 | UAAAUUUCUACUAUUGUAGAUGUCGGCAUGGCCCCAUUCGCACG (SEQ ID NO: 1279) |
| ID419 | FANCF site 1 | AGAAUUUCUACUGUUGUAGAUGUCGGCAUGGCCCCAUUCGCACG (SEQ ID NO: 1280) |
| ID420 | FANCF site 1 | AUAAUUUCUACUAUUGUAGAUGUCGGCAUGGCCCCAUUCGCACG (SEQ ID NO: 1281) |
| ID421 | FANCF site 1 | AUAAUUUCUACUAUUGUAGAUGUCGGCAUGGCCCCAUUCGCACG (SEQ ID NO: 1282) |
| ID422 | FANCF site 1 | AAAAUUUCUACUAUUGUAGAUGUCGGCAUGGCCCCAUUCGCACG (SEQ ID NO: 1283) |
| ID423 | FANCF site 1_T1 | GAAAUUUCUACUAUCGUAGAUAAAUAAUCUGGGCUUCAGUUCUA (SEQ ID NO: 1284) |
| ID423 | FANCF site 1_T2 | GAAAUUUCUACUAUCGUAGAUCUCACGUCACAGUAUGUCUCUGG (SEQ ID NO: 1285) |
| ID424 | FANCF site 1 | AUAAUUUCUACUAUUGUAGAUGUCGGCAUGGCCCCAUUCGCACG (SEQ ID NO: 1286) |
| ID425 | FANCF site 1 | UAAAUUUCUACUAUUGUAGAUGUCGGCAUGGCCCCAUUCGCACG (SEQ ID NO: 1287) |
| ID426 | FANCF site 1 | UCAAUUUCUACUGUUGUAGAUGUCGGCAUGGCCCCAUUCGCACG (SEQ ID NO: 1288) |
| ID427 | FANCF site 1 | AAAAUUUCUACUAUUGUAGAUGUCGGCAUGGCCCCAUUCGCACG (SEQ ID NO: 1289) |
| ID428 | FANCF site 1_T1 | UAAAUUUCUACUAUUGUAGAUGGCGUUACUUAAUUUUGAAAAA (SEQ ID NO: 1290) |

TABLE S4-continued crRNA sequences HEK293T

| Cas12a nuclease | Target | CRNA sequence |
|---|---|---|
| ID428 | FANCF site 1_T2 | UAAAUUUCUACUAUUGUAGAUAAGCACUACCUACGUCAGCACCU (SEQ ID NO: 1291) |
| ID429 | FANCF site 1 | AUAAUUUCUACUGUUGUAGAUGUCGGCAUGGCCCCAUUCGCACG (SEQ ID NO: 1292) |
| ID432 | FANCF site 1 | AUAAUUUCUACUGUUGUAGAUGUCGGCAUGGCCCCAUUCGCACG (SEQ ID NO: 1293) |
| ID433 | FANCF site 1_T1 | AAAAUUUCUGCUAUUGCAGAUUGGCGUUACUUAAUUUUGAAAAA (SEQ ID NO: 1294) |
| ID433 | FANCF site 1_T2 | AAAAUUUCUGCUAUUGCAGAUAAGCACUACCUACGUCAGCACCU (SEQ ID NO: 1295) |
| LbaCas12a | FANCF site 2 | UAAUUUCUACUAAGUGUAGAUGCGGAUGUUCCAAUCAGUACGC (SEQ ID NO: 1296) |
| ID401 | FANCF site 2 | AGAAUUUCUACUGUUGUAGAUGCGGAUGUUCCAAUCAGUACGC (SEQ ID NO: 1297) |
| ID402 | FANCF site 2 | AAAAUUUCUACUCUUGUAGAUGCGGAUGUUCCAAUCAGUACGC (SEQ ID NO: 1298) |
| ID403 | FANCF site 2 | AAAAUUUCUACUAUUGUAGAUGCGGAUGUUCCAAUCAGUACGC (SEQ ID NO: 1299) |
| ID404 | FANCF site 2 | AAAAUUUCUACUCUUGUAGAUGCGGAUGUUCCAAUCAGUACGC (SEQ ID NO: 1300) |
| ID405 | FANCF site 2 | UGAAUUUCUACUGUUGUAGAUGCGGAUGUUCCAAUCAGUACGC (SEQ ID NO: 1301) |
| ID406 | FANCF site 2 | UAAAUUUCUACUGUUGUAGAUGCGGAUGUUCCAAUCAGUACGC (SEQ ID NO: 1302) |
| ID407 | FANCF site 2 | AAAAUUUCUACUAUUGUAGAUGCGGAUGUUCCAAUCAGUACGC (SEQ ID NO: 1303) |
| ID408 | FANCF site 2 | AAAAUUUCUGCUAUUGCAGAUGCGGAUGUUCCAAUCAGUACGC (SEQ ID NO: 1304) |
| ID410 | FANCF site 2 | AUAAUUUCUACUAUCGUAGAUGCGGAUGUUCCAAUCAGUACGC (SEQ ID NO: 1305) |
| ID411 | FANCF site 2 | UAAAUUUCUACUGUUGUAGAUGCGGAUGUUCCAAUCAGUACGC (SEQ ID NO: 1306) |
| ID412 | FANCF site 2 | UUAAUUUCUACUAUUGUAGAUGCGGAUGUUCCAAUCAGUACGC (SEQ ID NO: 1307) |
| ID413 | FANCF site 2 | AUAAUUUCUACUAUUGUAGAUGCGGAUGUUCCAAUCAGUACGC (SEQ ID NO: 1308) |
| ID414 | FANCF site 2 | AUAAUUUCUACUGUUGUAGAUGCGGAUGUUCCAAUCAGUACGC (SEQ ID NO: 1309) |
| ID415 | FANCF site 2 | UUAAUUUCUACUCUCGUAGAUGCGGAUGUUCCAAUCAGUACGC (SEQ ID NO: 1310) |
| ID417 | FANCF site 2 | UAAAUUUCUACUGUUGUAGAUGCGGAUGUUCCAAUCAGUACGC (SEQ ID NO: 1311) |
| ID418 | FANCF site 2 | UAAAUUUCUACUAUUGUAGAUGCGGAUGUUCCAAUCAGUACGC (SEQ ID NO: 1312) |
| ID419 | FANCF site 2 | AGAAUUUCUACUGUUGUAGAUGCGGAUGUUCCAAUCAGUACGC (SEQ ID NO: 1313) |
| ID420 | FANCF site 2 | AUAAUUUCUACUAUUGUAGAUGCGGAUGUUCCAAUCAGUACGC (SEQ ID NO: 1314) |
| ID421 | FANCF site 2 | AUAAUUUCUACUAUUGUAGAUGCGGAUGUUCCAAUCAGUACGC (SEQ ID NO: 1315) |

TABLE S4-continued crRNA sequences HEK293T

| Cas12a nuclease | Target | CRNA sequence |
|---|---|---|
| ID422 | FANCF site 2 | AAAAUUUCUACUAUUGUAGAUGCGGAUGUUCCAAUCAGUACGC (SEQ ID NO: 1316) |
| ID424 | FANCF site 2 | AUAAUUUCUACUAUUGUAGAUGCGGAUGUUCCAAUCAGUACGC (SEQ ID NO: 1317) |
| ID425 | FANCF site 2 | UAAAUUUCUACUAUUGUAGAUGCGGAUGUUCCAAUCAGUACGC (SEQ ID NO: 1318) |
| ID426 | FANCF site 2 | UCAAUUUCUACUGUUGUAGAUGCGGAUGUUCCAAUCAGUACGC (SEQ ID NO: 1319) |
| ID427 | FANCF site 2 | AAAAUUUCUACUAUUGUAGAUGCGGAUGUUCCAAUCAGUACGC (SEQ ID NO: 1320) |
| ID429 | FANCF site 2 | AUAAUUUCUACUGUUGUAGAUGCGGAUGUUCCAAUCAGUACGC (SEQ ID NO: 1321) |
| ID432 | FANCF site 2 | AUAAUUUCUACUGUUGUAGAUGCGGAUGUUCCAAUCAGUACGC (SEQ ID NO: 1322) |

TABLE S5

Primer sequences T7 Endo I

| Target | Primer | Primer sequence 5'→3' | SEQ ID NO: |
|---|---|---|---|
| DNMT1 | DNMT1_dir | GCCAAAGCCCGAGAGAGTG | (SEQ ID NO: 1323) |
| DNMT1 | DNMT1_rev | CCTCACACAACAGCTTCATG | (SEQ ID NO: 1324) |
| RUNX1 | RUNX1_dir | CATCACCAACCCACAGCCAAGG | (SEQ ID NO: 1325) |
| RUNX1 | RUNX1_rev | CCAGCACAACTTACTCGCACTTGAC | (SEQ ID NO: 1326) |
| SCN1A | SCN1A_dir | AGTCCAAGGAATGCAGTAGG | (SEQ ID NO: 1327) |
| SCN1A | SCN1A_rev | GGCACAGTTCCTGTATCAGT | (SEQ ID NO: 1328) |
| FANCF (amplicon 1) | FANCF1_dir | GCCCTACATCTGCTCTCCCTCC | (SEQ ID NO: 1329) |
| FANCF (amplicon 1) | FANCF1_rev | GGGCCGGGAAAGAGTTGCTG | (SEQ ID NO: 1330) |
| FANCF (amplicon 2) | FANCF2_dir | GCGACATAGGACCTTCTCCTCCC | (SEQ ID NO: 1331) |
| FANCF (amplicon 2) | FANCF2_rev | GGAGGGAGAGCAGATGTAGGGC | (SEQ ID NO: 1332) |

TABLE S6

Amplicon sequences

| Target gene | Amplicon sequence (5'→3') | Amplicon size, bp |
|---|---|---|
| DNMT1 | GCCAAAGCCCGAGAGAGTGCCTCAGGTATGGTGGGGTGGGCCAGGCTTCCTCTGGGGCCTGACTGCCCTCTGGGGGTACATGTGGGGGCAGTTGCTGGCCACCGTTTTGGGCTCTGGGACTCAGGCGGGTCACCTACCCACGTTCGTGGCCCCATCTTTCTCAAGGGGCTGCTGTGAGGATTGAGTGAGTTGCACGTGTCAAGTGCTTAGAGCAGGCGTGCTGCACACAGCAGGCCTTTGGTCAGGTTGGCTGCTGGGCTGGCCCTGGGGCCGTTTCCCTCACTCCTGCTCGGTGAATTTGGCTCAGCAGGCACCTGCCTCAGCTGCTCACTTGAGCCTCTGGGTCTAGAACCCTCTGGGGACCGTTTGAGGAGTGTTCAGTCTCCGTGAACGTTCCCTTAGCACTCTGCCACTTATTGGGTCAGCTGTTAACATCAGTACGTTAATGTTTCCTGATGGTCCATGTCTGTTACTCGCCTGTCAAGTGGCGTGACACCGGGCGTGTTCCCCAGAGTGACTTTTCCTTTTATTTCCCTTCAGCTAAAATAAAGGAGGAGGAAGCTGCTAAGGACTAGTTCTGCCCTCCCGTCACCCCTGTTTCTGGCACCAGGAATCCCCAACATGCACTGATGTTGTGTTTTTAACATGTCAATCTGTCCGTTCACATGTGTGGTACATGGTGTTTGTGGCCTTGGCTGACATGAAGCTGTTGTGTGAGG (SEQ ID NO: 1333) | 719 |

TABLE S6-continued

Amplicon sequences

| Target gene | Amplicon sequence (5'→3') | Amplicon size, bp |
|---|---|---|
| RUNX1 | CATCACCAACCCACAGCCAAGGCGGCGCTGGCTTTTTTTTTTTTTAATCTTTAACAATTTGAATATTTGTTTTTACAAAGGTGCATTTTTTAATAGGGCTTGGGGAGTCCCAGAGGTATCCAGCAGAGGGGAGAAGAAAGAGAGATGTAGGGCTAGAGGGGTGAGGCTGAAACAGTGACCTGTCTTGGTTTTCGCTCCGAAGGTAAAAGAAATCATTGAGTCCCCCGCCTTCAGAAGAGGGTGCATTTTCAGGAGGAAGCGATGGCTTCAGACAGCATATTTGAGTCATTTCCTTCGTACCCACAGTGCTTCATGAGAGGTGAGTACATGCTGGTCTTGTAATATCTACTTTTGCTCAGCTTTGCCTGTAATGAAATGGCAGCTTGTTTCACCTCGGTGCAGAGATGCCTCGGTGCCTGCCAGTTCCCTGTCTTGTTTGTGAGAGGAATTCAAACTGAGGCATATGATTACAAGTCTATTGGATTACTTACTAATCAGATGGAAGCTCTTCAGAAATGTTTTAATAAATACTTAGTTATGCTGTTGGAGTGTTCAGTCGGTGCGTGAGAACTTTGTCAAGTGCGAGTAAGTTGTGCTGG (SEQ ID NO: 1334) | 601 |
| SCN1A | AGTCCAAGGAATGCAGTAGGCAATTAGCAGCAAAATATGCCTGATAAAAAACACTCACTTTCTTATTGATATAGTAGGGGTCCAGGTCCTCCAGGGGCTCTGACACCATCTCTGGAGGAATGTCTCCATAAATAAATGGAAGGTTCTTTCCAGCTTCCAAGTCACTATTTGGCTTTGGGCCATTTTCGTCGTCATCTTTTTTGTCTGGTTTGGGATTCTTTGCCTTTTCTTCTGCAATGCGTCTTTCAATAGCCGCAAGAGATTCTCTGGTGAAGAAGTTGAAGCTGTCAGGTCCTGGTGGTACAAGCACTGTTTGCTCCATCTTGTCATCCTGCACATTTTAATTACCATTTATTCTGCATATGAAATTCCTAAAATAAAAGGAATACAGATATTTTAAAGAGTGGACTAAGAGATGTTAATATAAATAAATTCTTGTCATGAAACATGAGCTAGAGGATTTAAAGTCTGTTTTCTCCTTAAATTGAAAGGTGATTTCTAAAGAAAAAATTTTAACACAAATGGTTTCTGTGTTGAGTTTAGTTAAGCATCACTTATTTATTAATTCTTGTGCTTTACTGATACAGGAACTGTGCC (SEQ ID NO: 1335) | 597 |
| FANCF (amplicon 1) | GCCCTACATCTGCTCTCCCTCCACTAAGAAGAACCTCTTTGTGTGGCGAAAGTAAAAGTATTAGGGCTTTTAAGTTGCCCAGAGTCAAGGAACACGGATAAAGACGCTGGGAGATTGACATGCATTTCGACCAATAGCATTGCAGAGAGGCGTATCATTTCGCGGATGTTCCAATCAGTACGCAGAGAGTCGCCGTCTCCAAGGTGAAAGCGGAAGTAGGGCCTTCGCGCACCTCATGGAATCCCTTCTGCAGCACCTGGATCGCTTTTCCGAGCTTCTGGCGGTCTCAAGCACTACCTACGTCAGCACCTGGGACCCCGCCACCGTGCGCCGGGCCTTGCAGTGGGCGCGCTACCTGCGCCACATCCATCGGCGCTTTGGTCGGCATGGCCCCATTCGCACGGCTCTGGAGCGGCGGCTGCACAACCAGTGGAGGCAAGAGGGGGCTTTGGGGGGGGTCCAGTTCCGGGATTAGCGAACTTCCAGGCCCTCGGTCACTGTGACGTCCTGCTCTCTCTGCGCCTGCTGGAGAACCGGGCCCTCGGGGATGCAGCTCGTTACCACCTGGTGCAGCAACTCTTTCCCGGCCC (SEQ ID NO: 1336) | 591 |
| FANCF (amplicon 2) | GCGACATAGGACCTTCTCCTCCCTACTCTCTTGTCACGGTTTTTATTTAATCAAACATTTATTATTGTTCGATGCTCTTAAATGCCATTTCCTTCAGCTGATTATTTGTATGACAGAAGAGTCAATTAAGCTATTTTGTCCTAAAAATTACGAAAACGAAATGTACAATTGTGAAGTAAAATTTTGTTCCTTTGCAAATTTTAATAAATTATTGAAGTTTATTTTTTGTTTCAAATAATCTGGGCTTCAGTTCTAATAATGGAAGGACAATGTGAAGGCCCAGAATTCAGCATAGCGCCTGGCATTAATAGGAGGTCAGTACATTTTTAGTACATGTTTCTCAAATAGATCTTAAAATTTCATTTAAGAGCGTTTCCTCACGTCACAGTATGTCTCTGGCGTTACTTAATTTTGAAAAACCTCAACACAGATTCTAGTTTTAGGCAAAGCTCAGAAAATTTCTACTTAAGGATATTTCCAAAGCGAAAGGAAGCGCGGAGACGTTCATGACTGGCATCATCTCGCACGTGGTTCCGGAAATTCTCGGTAGGATGCCCTACATCTGCTCTCCCTCC (SEQ ID NO: 1337) | 575 |

SEQUENCE LISTING (1559 sequences)

SEQ ID NO: 1 - protein, 1385 aa, synthetic construct
MEELMTNFSDFTGLFSLSKTLRFELKPVGKTKETFKQWLENMNSTNEEGNLLAKDKKIKDAYLALKPVMNSLHEQFIEMSLLSGKAKEIDFSKYYEAYKEKNVSSKLEEELRAKIGETYEIAGNYFYKEISNVLGKEIKPKKDKPYECLTDAKMLKYLSAKVQELAEQNGVDEQTLKGHLEQFKGFWGYLDGYNQNRENYYEYEKEASTAVATRIVHENLPTFCSNVLRFENRKDEYLGIYQYLKDKNRETKIKNSKGEEVDAKAISESVFQIKHFNECLTQPQIEEYNRIIGNYNLLINLYNQARREEAGFKKIDEFETLYKQIGCGKKKSMFETLQNDSDVKDLLQNAKNAGDVMFKNTLPAFIRFLKECDNWDGIYMSSAAVNKISNQYFANWHSIKDKLKDAKANACITYDKNREEQIKLRDAVELSGLFAVLDTEHSEHFFKDSLFKDNETNEYRGILDKDLPPSKNLINLLCFDIERNIKAFLQESDRIAALEKYKDENIQAGEEDQTIKKIKEWFDAATDAMRIVRYFAVRKSKMKGNLPNVTMEQALSNLLYNDDVQWFKWYDLVRNYFTKKPQDDAKENKLKLNFGKGTLLNGFVDSHSDSDNGTQYGGYIFRKKHEKCNEYEYFLGVSKNAQLFRCHLKNEVPSNDKSAFERLEYYQMKSTTPYPNDYGNKKEEIIDVVRKLAEDNEELVEWIDKKNEDKKLTPTELFKRLENTNDPILKNKELLNKVDETISIIKSNLKNFTRINAINDLQNDDQNHGGIDGFKKLVDELKKITAATKLFDFFPVSSSEFNAHNGEDLFLFKISNKDLSYCETFAEGKRKEKTNQKENLHTLIFRALMREDLFGDIVDIGKGEVFLREKVREYDYDDSVRKYGHHYNDLKDRFTYPIISNKRFSEDKILLHLSVILNYKSDNKKNVGVEINDALQQSDNLQFIGIDRGEKHLVYSCTIDKNAKIIKCNHHDNINGTDYVKKLEDVADERIIAKKNWQAQNKIKDLKTGYISHVVHRLVEETIKDGEKIAPHAYIVLEDLNTEMKRGRQKIEKQIYQNLETALAKKLNFVVDKDAKEGELGSVSKALQLTPPISNYQDIEGKKQFGVMLYTRANYTSVTDPATGWRKTIYIKNGKEEDIMNQIFKEFSDFGFDGKDYYFEYTEANAGHTWRLYSGKDGKPLPRFQNKKQIQQDKNIWVPEQINVVKILDEIFADFDKAKSFKTQIEEGIELKKAGGRTETAWQSLRYALELIQQIRNSGEKDSKDDNFLYSPVRNENGEHFDTRHPEKNGDLSKIVDADANGAYNIARKGLIMDAHIKHWIESGRPKTKKDGKEKSDLDLFISDKEWDLWLLDREQWKKDLPAFASLSAKDDADKSKAGRGRKKQ

SEQ ID NO: 2 - protein, 1362 aa, synthetic construct
MEQFTNLFQLSKTLKFELKPIGKTEETFKQWLEEIQKSELDVYNDSNLFLKDKKIKDAYLAIKPIMDKLHEQFIEESLTSDLAKNIDFSEYYEAFRNKTVKDEMETKLRKVFAETYQYAGKLFIDMISKAQKNGKEIKTKKEKPYECLTDSKILNFLSANVKELAKLTDANEQELTNHIKQFRGFWGYLDGFNTNRENYYVTEKEQSTAVATRIVHENLPTFCSNALRFEKRREEYLGIYQYLKDNNRETKIKNSQGEEIEAESIDVSYFEIEHFNECLAQSQIDEYNRVISHYNLLINLYNQARREESQFKKIDEFEILYKQIGCGKKQSMFEILQSDNDVRNLLQKVRRAGDIMFKKGHSEGEIDNVYDFIQFLKECDNWEGIYMSNAAINKISNLYFANWHSIKDKLKESKANACITYDKKREEPIKLRDAVELSGLFEVLDQEQPEHILKESLFKDEATNEYRGVLKKELSPSKNIIMLLCYDIERNTKAFLDSSDSIVAIEKFKDKKQFVGEEDQTIKQVKDWLDAATDAMRIVRYFAVRKSKMKGNLPNVTMEQALSNLLHNEDAQWFKWYDLIRNYLTKKPQDDAKENKLKLNFGTSSLLGGWSDGQEKTKAATLLRNNNALYLCILKTKNVFDTSKDNNPIYNVSQSNASRLILRNLKFQTLAGKGFLGEYGISYGEMGKNDSTKAISCLQKIIKTRYVDKYPLLEKFVTNTYTDKREFDAEILETLKECYVCEFKPIDWTFVIEKQNAGELFLFKISSKDYLPNAKGRKDLQTMYWEDVLSDGSKHQLCAGAEIFMREPVAKESPVMHRIGSKLVNRRDKDGNTIPEHIYREIYSYVNGKMSVVSAKAQKYIDDKRVIVKDVKHEIVKDKRFYGETKYMFHCPIKLYFEAKDPKYAFSEVNKTITDSLQQSPNLQFIGIDRGEKHLVYSCTVDTNCKIIRCNHHDFINGTDYVQKLDAVANDRIIAKKNWQAQSKIKDLKSGYISHVVHRLVDETIKDGNVIAPHAYIVLEDLNTEMKRGRQKIEKQVYQNLEVALAKKLNFVVDKNAKHGELGSVSMALQLTPPINNYQDIEGKKQFGVMLYTRANYTSVTDPATGWRKTIYIKNGKEEDIRKQILEAFRDFGFDGRDYYFEYTEANVGHTWRMYSGNNGKPLPRFRNRKQIFQDKNVWVSEQINVVEILDRLFVKFDKKKSFKEQIEQGKELEKVEWRDESAWQSFRFALDLIQQIRNSGTEDNDDNFLYAPVRNDHGEHFDTRNHKNNGELSEIRDADANGAYNIARKGLIMDAHIKRWIEIGCPTVSEDKAPDLDLFISDLEWDLWLLDRERWEKELPIFASRSAKKKEDKQQTRGKKQ

SEQ ID NO: 3 - protein, 1366 aa, synthetic construct
MKEFTNLYQLSKTLRFELKPIGKTAKTFQRWLEEMNKAELVGDNDGNLFLKDKKIKNAYLAIKPIMDKLHEQLIEMALLSKEAKQIDFSEYFEAYKNKAVRVEMENGLRKAFAKPFQYAGLYFVEEISKSQKNGKEIKTKKDKQYECLTDAKMYNYLSAHVRDLAEQNGIDEQKLKKHIEQFKGFWGYLDGYNQNRENYYEVDKEASTAVATRIVHENLPTFCSNAMRFEKRKDEYLCIHRYLKDNSRETKIKNTKGEEIDVEAISDNIFQIKHFNECLAQSQIEEYNRIIGNYNMLINLYNQLRRGEKDFKKIDEFEKLKKQIGCGKKKSMFETLQGDSDVKKLLLKASEAGKQMFKDVADFSEIKTVPDFIEFLRECDNWDGIYMSKTAIDKISSLYFANWHSIKDKLKEAKADACITYEKKREEPIKLRDAVELSGLFAVLDSEQSEHFFKDSLFKDDDTNDYRGVLNKTLTPSKNLIQLLCFDIERNTNAFLSKSNNIVKLEKYKDENDQAGEEDQTIRKIKEWFDAATDAMRIVRYFSVRKSKMKGNIPNATIEQALSNLLYNDDAQWFKWYDLIRNYLTKKPQDDAKENKLKLNFGTSSLLGGWSDGQEKTKVATLLKYHDEIYLCVLKTKNIFDTSKDNNPIYDITESEASRLLLRNLKFQTLAGKGFLGEYEISYGDMGKENPTKAIKCLQKIIKERYVNKYPLLEKFARNTYTDKAQFDAEITETLKECYVCQFVPIDWNVVTEKQDNEELFLFKILCKDYRPKSVGKKDLQTMYWEDVLSDGSKHQLCAGAEIFMREPVAKESPIIHRIGSKFVNKRDKDGDTIPEQIYREIYSYANGKKKTISAESRKYIDEQKVIIKDVKHKIIKDNRFYGETKYMFHCPIKLQFEAKDPKYAYSEVNTTVSNALQQSDNLQFIGIDRGEKHLVYSCIVDKDCKILKCGHHDVINGTDYVQKLEAVADERIVAKKNWQQQNKIRDLKNGYISHVVHRLVEETIKDNGKIAPHAYIVLEDLNTEMKRGRQKIEKQVYQNLETALAKKLNFVVDKDTKKGEIGSVSKALQLTPPINNYQDIEGKKQFGVMLYTRANYTSVTDPATGWRKTIYIKNGKEDDIKNQILDKFSDFGFDGDYYFEYTEANVGHTWRLYSGKNGKALPRFQNKKQALQDKNVWVPEKINVVDILNKLFAKFDKKKSFKSQIEAGVELQKDEERNETAWQSLRFALDLIQQIRNSGEKNSGDDNFLYSPVRNDKDEHFDTRNYKNNGELSEIRDADANGAYNIARKGLIMDTHIKHWINNGRPKTKIDGSEVSDLDLFISDREWDLWLLDREQWMKELPTFASKIAKYDSDAPQTAKRRKKR

SEQ ID NO: 4 - DNA, 4158 bp, synthetic construct
  source 1..4158: mol_type = other DNA
atggaggaactcatgacgaatttttctgatttcacaggcctcttttctctgtctaagaccctgagattcgaattaaagccagtcgggaaaactaaggagacttttaagcagtggttggagaacatgaactctacaaacgaggagggcaacctgctggccaaagacaagaaaattaaggatgcgtacctggccctgaaaccagttatgaatagcttgcacgaacagtttattgagatgagtctactgtccggcaaggcaaaggagattgacttcagtaaatactacgaggcctacaaggagaaaaatgtgagcagcaaactcgaagaagagttgcgtgccaaaattggagaaacatacgaaatcgcagggaactacttctacaaagagatctccaatgttcttggcaaggaaatcaaacctaagaaagacaagccctatgagtgcctcactgatgctaaaatgctgaaatatttgtcagcgaaggtgcaagaattagcagagcagaacggtgtggacgaacaaacacttaagggacatctggagcaatttaaggggttttgggggtacctggacgggtacaaccagaatagagaaaactactacgagtacgagaaagaggcttccactgcagtggccacccgaatcgtgcatgaaaatctgcccacattttgtagtaacgttctgcgcttcgaaaaccgaaaagacgagtatctaggcatatatcagtacttgaaggacaagaatcgggaaaccaagattaaaaactcaaagggggaagaagttgacgctaaggcaatatcggagtcagtctttcagattaagcacttcaacgaatgtttaacccaaccccaaatcgaagagtataacagaatcatcggcaactacaatctcctgatcaacctgtataaccaggcccgtagggaagaggccggtttcaagaaaatcgacgagttcgagacattgtataaacagatcggctgtggcaaaaaaaaatcaatgttcgagacacttcagaacgacagtgacgtgaaagacttgctgcagaatgccaagaatgctggtgacgttatgtttaaaaatacacttccggccttcatcagattcttgaaggagtgtgataattgggatggcatatacatgagctccgccgccgtgaataagatcagcaaccagtattttgcaaactggcacagtatcaaggataagttgaaggatgctaaagccaatgcctgtatcacctacgataaaaacagggaagaacaaatcaaactgcgggatgctgtagagctatctgggctgttcgctgtgttggacaccgaacactccgaacacttctttaaggactcactgttcaaagacaatgagacgaacgagtataggggcattctcgacaaagacttgccacctagcaaaaatctgatcaaccttctatgcttcgatattgagaggaatataaaagccttcctccaggaatcagatcggatcgctgctttggagaagtacaaagacgagaatatccaggctggagaggaggatcagaccatcaaaaaaatcaaggaatggttcgatgcagcgacagacgccatgaggattgtacgctattttgccgtccggaaatcaaaaatgaagggtaacctgccaaatgtgaccatggagcaggctctgagcaacttactgtacaacgatgatgtgcagtggttcaagtggtacgacttggtcaggaattattttacaaagaagcctcaggacgatgccaaagagaataagcttaaactcaattttggcaagggtaccctattaaatggcttcgtggattcccatagcgatagtgataatggaactcagtacgggggttacatattccgtaaaaaacacgagaaatgcaacgaatacgaatatttcttaggggtatccaagaacgcgcaactcttcagatgccatctgaagaacgaggtccctagcaatgacaaatcagccttcgagcgccttgaatactatcagatgaaatccactacaccctatccaaatgattacgggaataaaaaggaagagatcattgacgtggttagaaaactggccgaggataatgaggaactggtggaatggatcgacaaaaagaatgaggacaaaaagcttactcccactgagctcttcaagcggcttgagaacaccaacgacccaattctgaagaataaggaactgctcaacaaggtggacgaaaccatatccatcatcaagtctaatctcaagaattttacccggatcaacgctattaacgatttacagaatgacgaccagaatcacggtggtattgatggttttaaaaagctcgtcgacgaactaaagaagattactgcagccaccaagcttttcgattttttccctgtgtcgtctagtgaatttaatgcgcacaatggggaagacctgtttctcttcaagatttcaaacaaggatctcagctactgtgaaacatttgcggagggcaagcgcaaagaaaaaaccaatcaaaaggagaacctccataccctgatcttcagagcgctgatgagagaggacctgtttggagatattgtcgacatcggaaagggcgaggtttttctccgagagaaggtgcgggagtacgactatgacgatagcgtgcgcaaatatgggcatcattacaacgacctgaaggataggtttacataccccattatttcaaacaaacgattctctgaggataagattctcctacacctgtctgtcattttgaactacaagtccgataacaagaaaaacgtgggggtcgaaataaacgacgccctgcagcaatccgacaatttgcaattcattggaattgaccgcggggagaagcacctggtttatagctgcaccatcgataagaatgccaaaatcataaagtgcaaccatcacgataacatcaacggaacagactatgtcaagaaactggaggacgtggctgacgaacgaattattgccaaaaagaattggcaagctcaaaacaagattaaggacctgaagaccggatacattagccacgtagtacatcgcctggtggaagagacgatcaaagatggagaaaaaatagctcctcacgcatatatagtgcttgaggatctcaacacagagatgaaaaggggccggcagaagatcgagaaacagatttaccaaaatctggaaactgctcttgcaaaaaagctcaatttcgtagttgataaggatgccaaggaaggcgagctcggcagcgtgtccaaagcccttcagcttactccccctataagcaattatcaggatatcgagggaaagaaacagttcggagtgatgctatatacccgggcaaactacacctcggtcactgacccggctactggctggaggaagaccatctatattaagaatggcaaagaggaggacatcatgaaccagatcttcaaagagttttccgattttggctttgacggaaaggattactattttgagtatacggaagcaaacgccggtcacacgtggagactttacagcggcaaggacggcaagcccttaccccgctttcagaacaagaagcagatacagcaggacaagaacatttgggtcccggaacagatcaatgttgtgaagattctcgacgagatattcgccgacttcgataaggctaagtcgttcaaaacccagatcgaagaggggattgaactgaagaaggcaggagggagaactgaaacggcttggcagtccctgcgatatgcgctggagctgatacagcagatccgcaattctggagaaaaagacagtaaggatgataactttctctattcaccagtccgtaatgagaacggtgaacactttgacacaagacatccagagaagaacggggatctctctaaaattgtggatgcagatgccaatggggcctataacatcgcacgcaagggactgattatggacgctcatatcaaacactggatcgaatctggcaggcctaagactaagaaagatggaaaggagaaaagtgatctggacttgttcataagcgacaaggagtgggacctgtggttacttgatcgggagcagtggaagaaggacctgcctgcctttgcttccctgtctgcaaaagacgatgcagataaaagtaaagccggcaggggacggaaaaagcaatga

SEQ ID NO: 5-6 - skipped (2 entries)

SEQ ID NO: 7 - DNA, 34 bp, synthetic construct
  source 1..34: mol_type = other DNA
ctgctaaaccgctaaaatttctactattgtagat

SEQ ID NO: 8 - DNA, 36 bp, synthetic construct
  source 1..36: mol_type = other DNA
ggctgctaaaccgctaaaatttctactattgtagat

SEQ ID NO: 9 - DNA, 36 bp, synthetic construct
  source 1..36: mol_type = other DNA
atctacgatagtagaaattataatggctttatagcc

SEQ ID NO: 10 - DNA, 23 bp, synthetic construct
  source 1..23: mol_type = other DNA
atctacgatagtagaaattataa

SEQ ID NO: 11 - DNA, 36 bp, synthetic construct
  source 1..36: mol_type = other DNA
gtctataggactcaaataatttctactattgtagat

SEQ ID NO: 12 - DNA, 36 bp, synthetic construct; identical to SEQ ID NO: 11
  source 1..36: mol_type = other DNA

SEQ ID NO: 13 - RNA, 36 nt, synthetic construct
  source 1..36: mol_type = other RNA
ggctgctaaaccgctaaaatttctactattgtagat

SEQ ID NO: 14 - RNA, 36 nt, synthetic construct
  source 1..36: mol_type = other RNA
ggctataaagccattataatttctactatcgtagat

SEQ ID NO: 15 - RNA, 36 nt, synthetic construct
  source 1..36: mol_type = other RNA
gtctataggactcaaataatttctactattgtagat

SEQ ID NO: 16 - protein, 1414 aa, synthetic construct
  VARIANT 629..633: note = X is independently selected from any naturally occurring amino acid or absent
  VARIANT 637..642: note = X is independently selected from any naturally occurring amino acid or absent
  VARIANT 707..712: note = X is independently selected from any naturally occurring amino acid or absent
  VARIANT 741: note = X is independently selected from any naturally occurring amino acid or absent
  VARIANT 742: note = X is independently selected from any naturally occurring amino acid or absent
  VARIANT 763: note = X is independently selected from any naturally occurring amino acid or absent
  VARIANT 764: note = X is independently selected from any naturally occurring amino acid or absent
  VARIANT 777: note = X is independently selected from any naturally occurring amino acid or absent
  VARIANT 778: note = X is independently selected from any naturally occurring amino acid or absent
  VARIANT 871..887: note = X is independently selected from any naturally occurring amino acid or absent
MEELMTNMXXFTNLFQLSKTLRFELKPIGKTXETFKQWLEEMNKXELXXXNDGNLFLKDKKIKDAYLAIKPIMDKLHEQFIEMSLLSXXAKXIDFSEYYEAYKNKXVXXEMEXXLRKXFAETYQYAGXYFXXEISKXQKNGKEIKTKKDKPYECLTDAKMLNYLSAXVXELAEQNGXDEQXLKXHIEQFKGFWGYLDGYNQNRENYYEXEKEASTAVATRIVHENLPTFCSNALRFEKRKDEYLGIYQYLKDNNRETKIKNSKGEEIDAEAISXSXFQIKHFNECLAQSQIEEYNRIIGNYNLLINLYNQARREEXXFKKIDEFEXLYKQIGCGKKKSMFETLQXDSDVKXLLQKAXXAGDXMFKXXXXXXEIXTVPDFIXFLKECDNWDGIYMSXAAINKISNLYFANWHSIKDKLKEAKANACITYDKKREEPIKLRDAVELSGLFAVLDXEQSEHFFKDSLFKDXXTNEYRGVLXKXLXPSKNLIXLLCFDIERNTKAFLXXSDXIVALEKYKDENXQAGEEDQTIKKIKEWFDAATDAMRIVRYFAVRKSKMKGNLPNVTMEQALSNLLYNDDAQWFKWYDLIRNYLTKKPQDDAKENKLKLNFGTSSLLGGWSDGQEKTKXATXXXXXLLRXXXXXXNXXEXYLCVLKTKNXFDTSKDNNPIYXXXXSNASRLXLRNLKFQTLAGKGFLGEYGISYGEMGKXXXXXXEDXTKAIXCLQKIIKXRYVXKYPLLEKFXXXXNTYTDKXEFDAEIXETLKXXECYVCXFXPIDWXXXXVXEKQNXGELFLFKILXKDYXPXXXGXKDLQTMYWEDVLSDGSKHQLCAGAEIFMREPVAKESPXXHRIGSKXVNXRDKDGXTIPEXIYRXXXXXXXXXXXXXXXXXEIYSYXNGKXXXXSAXXRKYIDXXXVIXKDVKHXIIKDKRFYGETKYMFHCPIKLXFEAKDPKYAXSEVNXTIXDALQQSDNLQFIGIDRGEKHLVYSCTVDKNCKIIKCNHHDXINGTDYVQKLEAVADERIIAKKNWQAQNKIKDLKXGYISHVVHRLVEETIKDGXKIAPHAYIVLEDLNTEMKRGRQKIEKQVYQNLETALAKKLNFVVDKDAKXGELGSVSKALQLTPPINNYQDIEGKKQFGVMLYTRANYTSVTDPATGWRKTIYIKNGKEEDIXNQILXXFSDFGFDGXDYYFEYTEANVGHTWRLYSGKNGKPLPRFQNKKQIXQDKNVWVPEQINVVXILDXLFAKFDKKKSFKXQIEXGXELXKXEXRXETAWQSLRFALDLIQQIRNSGEKDSXDDNFLYSPVRNDXGEHFDTRNXKNNGELSEIRDADANGAYNIARKGLIMDAHIKHWIEXGRPKTKXDGXEXSDLDLFISDXEWDLWLLDREQWXKELPXFASXSAKXDXDKXQTXXRRKKQ

SEQ ID NO: 17 - DNA, 4158 bp, synthetic construct
  source 1..4158: mol_type = other DNA
atggaggagttgatgacaaatttttctgatttcacggggcttttttcgcttagcaagactctcaggtttgaacttaaacctgttgggaaaactaaagaaacctttaagcaatggcttgaaaatatgaatagcaccaatgaggaaggcaacttgttggcaaaggataagaaaatcaaagatgcctatttagcattaaagccagtaatgaatagtctgcatgagcagtttattgaaatgtctttgctctctggtaaagcgaaggaaatcgatttctcgaaatactatgaagcatacaaagaaaaaaacgtttcaagcaagcttgaggaagaattacgcgcaaaaattggtgaaacctatgagattgctgggaattatttttataaagaaataagcaatgttcttggcaaagaaatcaaaccaaagaaagataagccatacgaatgccttactgatgctaaaatgctcaagtacttatcagccaaagtacaggaattggctgaacaaaacggcgtagacgaacaaacccttaaaggtcatcttgaacaattcaaaggattttggggatatttggacggatataaccagaatcgtgagaattattatgaatatgagaaagaggcttcaaccgctgttgctacacgtattgtccacgaaaatctacccacattttgcagcaatgttttgcgttttgagaatcgcaaggacgagtatctcggcatttaccagtatttgaaagataagaaccgcgaaacaaagattaaaaattcaaaaggcgaagaagttgacgcaaaagcaatttctgaaagtgtttttcaaatcaagcattttaacgaatgccttacgcagccgcaaattgaagagtacaaccgaattattggcaattacaatttgctaatcaacctatacaatcaggcacgacgagaggaagcaggtttcaagaagatagacgagtttgaaaccttatacaaacaaattggttgcggtaaaaagaaatcgatgtttgaaacgttgcaaaacgacagtgatgtaaaagatcttctgcaaaatgctaaaaatgcaggcgatgtaatgtttaaaaataccctgccggcatttatccggtttttgaaagagtgcgataactgggacggcatttatatgtcaagtgccgccgtcaataaaatatcaaaccagtactttgctaattggcacagtatcaaggataaattaaaagacgcaaaagcaaacgcatgcatcacatacgataaaaacagggaagagcaaataaaactgcgtgatgctgtggaattgtcgggattgttcgctgtgttggatacagaacattcggaacactttttcaaagactcgcttttcaaggataacgaaaccaacgagtatcgtggcattttggataaagatcttccgccaagcaaaaatctcatcaatttgttgtgctttgatattgagcgcaacataaaggcatttctgcaagaatctgataggattgccgcattggaaaaatacaaagacgaaaacattcaggcaggtgaagaagaccagacgataaagaaaataaaagagtggtttgatgcagcaaccgatgctatgcgtattgtgcgctattttgctgtgcgtaaaagcaagatgaaaggcaacttgccaaatgtgacgatggaacaggcattgagcaacttgctatacaacgatgatgtccagtggttcaagtggtatgaccttgttcgcaactattttaccaagaaacctcaagacgatgcaaaagaaaataaattgaagttgaattttggaaaaggaacattgttaaatggatttgttgattctcatagtgattcggataatggtacgcaatatggtggctatatttttagaaagaaacatgaaaagtgcaatgaatatgaatatttcttgggtgtcagtaaaaatgcgcaactgtttagatgtcatttgaaaaatgaagttccttccaatgataaaagtgcttttgagcgtttggagtattaccaaatgaaatcaacgacaccgtatccaaatgactatggtaacaaaaaagaggaaattatagatgttgtgagaaaattagccgaagataatgaagaattggtagagtggattgataagaaaaatgaagacaagaaattaacaccaacagagttgtttaagagattggagaatacaaatgatcctatattgaaaaataaagaactattaaacaaggtagatgagaccatttctataatcaaatctaatctcaaaaactttacacgtattaatgcgattaatgaccttcaaaacgatgaccagaaccatggtggcatagacggttttaagaagctggtagatgaattaaagaaaattactgcagcaactaaactgtttgatttctttcctgtcagctcaagtgagtttaatgctcacaatggagaagatttgtttttgtttaaaatatcaaacaaagatttgtcatactgcgaaacatttgcagaaggaaaaagaaaagaaaaaacaaatcaaaaagaaaatctacatacattaatttttagagctttgatgcgtgaagatttatttggtgatattgtcgatattgggaaaggagaagtctttttacgtgaaaaggtcagagaatatgattacgatgatagtgtacgaaagtatggacatcactacaatgatttaaaggacagatttacttatcccattatttcaaacaagcgtttttcagaagataaaattcttttacatttgtcagtaatattgaattataagtctgataataagaaaaacgtaggagtagaaattaacgacgctctccaacaatccgacaacctacaatttatcggcattgatcgtggcgaaaagcaccttgtgtatagctgcacgatagataagaatgctaagatcataaaatgcaaccaccacgataatatcaatggaactgactatgtgaaaaagttagaggatgttgccgacgagcgtattattgccaaaaagaattggcaggcacagaacaaaatcaaggatttgaagaccggctatatatcacatgttgtgcatcgtttggtggaagaaaccatcaaagacggcgagaaaattgccccgcacgcttacatcgttttggaagatttaaacaccgagatgaagcgcggtcgccaaaagattgaaaagcagatttatcaaaacctggaaacagcgctcgcaaagaaactcaattttgttgtggataaagacgctaaggagggcgaacttggctctgtgagcaaggctttgcaacttacgccgccaatcagcaactatcaagatattgagggcaagaaacaattcggtgtaatgctttatacgagagcaaattatacttctgttactgatccggcaacaggatggcgcaaaaccatttatataaaaaatggcaaggaagaagacattatgaaccagatatttaaggaattcagtgattttggttttgacggaaaagactattactttgaatacaccgaagccaatgcagggcacacttggcgtttgtattccggcaaagatggcaaaccgctacctcgtttccaaaacaagaagcaaatacagcaggacaagaatatttgggtgcctgagcaaataaatgtggtaaaaatccttgatgaaatttttgctgattttgataaagcgaagtcgtttaaaacacagattgaagaaggtattgaattaaaaaaggctggtggacgaaccgaaacggcttggcaatcgcttcgatatgcgcttgaattgattcagcaaatccgcaattcaggtgaaaaggattccaaagacgacaacttcttatattcccccgtccgcaacgaaaacggtgaacactttgacacgcgccatccagaaaagaatggcgacttgtccaaaatcgtagatgccgatgccaatggcgcatacaacatcgctcgcaaaggcttgattatggatgcgcacatcaagcattggattgaaagcggacggccaaaaacgaaaaaagacggaaaagaaaaatctgatttagatttgtttatttctgataaagagtgggatttgtggcttttggatagagagcaatggaaaaaagatttgcctgcatttgcctctctaagcgcaaaggatgatgctgataaatccaaagcaggaagaggaagaaaaaaacaataa

SEQ ID NO: 18 - DNA, 4089 bp, synthetic construct
  source 1..4089: mol_type = other DNA
atggaacaatttacaaatctttttcagttatcaaaaacattgaagtttgaattgaaacccattggtaaaacggaagaaacttttaaacagtggctggaggaaattcaaaaatctgaattagatgtttataatgatagcaacttgtttctgaaagataagaaaatcaaagatgcctatttggctattaagccgattatggacaagttgcatgaacagtttattgaagagtctttgacgtctgatttggccaaaaatatcgatttctcggaatactatgaagcttttagaaataagactgtaaaggatgagatggaaacgaaattgcggaaggtttttgccgagacctaccaatatgcaggcaaactttttatagatatgatttctaaagcccaaaaaaacggcaaagaaatcaagactaaaaaggaaaaaccatacgagtgccttaccgattctaaaatacttaactttttatctgcaaacgtaaaggaattggcaaaacttacagatgctaatgagcaagaactgactaatcatataaagcagttccgtggtttttggggatatttagatggtttcaatacaaacagggaaaactattatgtaacagagaaagagcagtctacagctgttgccactcgtattgtccatgaaaacttgcccacattctgcagcaatgctttacgttttgaaaagcgcagggaagagtatctcggtatttatcagtatctaaaagataataaccgcgagaccaaaattaagaactcgcagggcgaagagatagaagcggagtccattgacgtaagttatttcgaaatagagcattttaatgaatgccttgcacagtctcaaatagatgagtataatcgtgtcatcagccattataacctattgattaatctttacaatcaggcacgtcgcgaagaatcgcaatttaaaaagattgacgaattcgaaatcctctataagcaaattggttgtggcaaaaagcaatcaatgtttgaaatcttacaaagtgacaatgatgtgagaaatttattacaaaaagtaagacgtgctggtgatataatgtttaaaaaaggccatagtgaaggcgaaatagataatgtctacgattttatccaattcttgaaagaatgtgataattgggaaggaatctatatgtcaaatgctgctattaataagatttcaaatttatactttgccaattggcacagcataaaagacaaattaaaggagtcaaaggcaaatgcatgtattacatacgacaaaaaacgtgaagagccaatcaaattacgtgatgccgtggagttgtctggcttgtttgaagtgctggatcaggaacagccagaacacattctcaaagaatcgcttttcaaagatgaggccactaatgagtatcgtggtgttttgaaaaaggaactttctccgagtaagaatatcataatgctattgtgctatgatattgaacgtaatacaaaggcttttttggattcttcagatagcattgttgcaatagaaaagtttaaagacaagaaacagtttgtaggagaagaagaccaaacgataaaacaagtaaaagattggcttgatgcggcaacagacgctatgcgtatagttcgttattttgctgtgcgtaaaagtaaaatgaaggggaacttaccaaatgtaacgatggaacaagcgttgagcaaccttctacataatgaagatgcacaatggtttaaatggtatgaccttatccgtaactatcttaccaagaagccgcaagatgatgcaaaagagaacaaactaaagcttaattttggcacttcttctttacttggcggctggagtgacggacaggagaaaacaaaagctgctactttattgaggaataataatgccttatatctatgtatattaaaaacgaaaaacgtttttgacacgtcaaaggataataatcccatttataatgtttcacaatcaaatgcaagtcgcttgattttaagaaatctcaaatttcagacacttgcagggaaaggctttttaggtgagtatggtatttcttatggagagatggggaaaaatgattctaccaaagcaattagttgtttacaaaaaatcataaaaacgcgatatgtggataaatatcctttactggagaaatttgtaacaaacacatatacagataagcgtgaattcgatgctgagattctcgagacattgaaagaatgttatgtctgcgagttcaaaccaatagattggacttttgtcattgaaaaacaaaatgccggtgagttgtttttgtttaaaatatctagtaaagattacttaccaaacgctaagggtagaaaagatttgcagacaatgtattgggaagatgtgttgtctgatggtagtaaacatcaattgtgcgcaggtgccgaaatctttatgcgcgagccagtcgccaaagagtcaccagtgatgcatagaataggatcaaaactcgtaaacaggagagacaaagacggaaacactattccagagcatatatatagagaaatttattcttatgttaatggcaaaatgagtgtcgtttcagctaaagcccaaaagtatatagatgacaaaagagtgattgtcaaggatgtaaagcatgaaattgtcaaagacaagcgcttttatggtgaaacgaaatatatgttccattgtccaattaagttgtattttgaggcaaaagatcccaaatatgcattctcggaagttaataaaacaataacagattcgcttcaacagtcccccaatttgcaatttataggcatagatcgtggcgaaaagcaccttgtatatagttgtacggttgatacgaattgtaaaatcatcagatgtaaccatcatgattttatcaatgggaccgactatgtgcagaaattggatgcagttgctaatgatcgcatcattgctaaaaagaattggcaagcccagagtaaaattaaggatttgaaaagtggttatatatcgcatgtggtacatcgtttagtggatgaaaccataaaagacggtaacgtaattgccccacacgcgtatattgtcttggaagacctgaacacggaaatgaagcgaggccgccaaaagatagaaaagcaagtctaccaaaatttggaagttgcccttgccaagaaattaaattttgtagtagataaaaacgccaagcatggagaactaggttcagtgagcatggcattgcagcttacgccgccaatcaacaactaccaagatattgagggtaaaaaacaatttggagtaatgctttacacacgagccaattacacatcggtgaccgatcctgcaacaggatggcgtaaaaccatctatataaagaatggaaaagaagaagatataagaaaacaaattctcgaagcatttcgcgactttggctttgacggcagggattattactttgaatatactgaagccaatgtggggcacacttggcgtatgtattctggcaataatggtaaacctctacctcgcttccggaacagaaaacagatattccaggacaagaatgtatgggtatcagagcaaattaatgtagtggagatcctcgacaggctgtttgtcaaattcgataaaaagaaatctttcaaggagcagatagaacagggcaaagaacttgaaaaggtagaatggcgagacgagtccgcttggcaatcttttcgatttgcgcttgatttgattcagcaaattcgcaattctggtacggaagacaacgatgataatttcttgtatgctccagtgcgcaacgaccacggcgaacactttgacacacgcaatcataagaataatggcgaattatctgaaatcagagatgctgatgctaatggagcatacaatattgctcgcaaaggattgataatggatgctcatattaagcgttggattgaaatcggctgtcccacagtgagtgaagataaagcgccagatttagatttatttatctcagatttggaatgggatttgtggcttctggatagagaacgttgggaaaaagaactacccatcttcgcatcacggagtgcaaagaagaaagaagataaacagcaaacgagagggaaaaaacaataa

SEQ ID NO: 19 - DNA, 4101 bp, synthetic construct
  source 1..4101: mol_type = other DNA
atgaaagaatttacgaacctgtatcagttatcaaaaactctgagatttgaactgaagcctattggcaagaccgcaaaaacctttcaaagatggcttgaggaaatgaataaagccgaacttgttggtgataatgatggcaacttatttttgaaggacaagaaaattaagaatgcctatttggctattaaaccaataatggacaaactgcatgagcagcttatagagatggctttgctttctaaagaagcaaaacaaattgatttttcggaatattttgaagcatataagaataaagccgtaagggttgaaatggaaaatggcttgcggaaagcattcgcaaaaccatttcaatatgcaggcctatactttgtcgaagagatttctaaatcccaaaagaatgggaaagagatcaagactaaaaaagataagcaatacgaatgtctcaccgatgcgaagatgtataattatctatcagcacatgtcagggatttagctgaacagaacggtattgatgaacaaaaacttaagaaacatattgaacaattcaaaggcttttgggggtatttggatgggtacaaccaaaatagggagaattattatgaggttgacaaagaggcttcaaccgctgttgccacacgtattgttcatgaaaacttacccactttctgtagcaatgctatgcgttttgaaaagcgcaaggatgaatatctctgtattcatcgatatttgaaagataatagccgtgaaacgaagattaaaaacacgaaaggcgaagagattgatgtagaagcgatttccgataatatttttcaaataaagcattttaacgaatgccttgctcagtcacaaattgaagagtacaaccgcattattggcaattacaatatgctgattaatttatacaatcagttgcgacgtggcgaaaaggattttaagaaaattgacgaatttgaaaaattaaaaaagcaaattggttgcggcaaaaagaaatcaatgtttgagacattgcagggggatagcgatgtgaaaaaacttctgctaaaagcaagtgaagcaggaaaacagatgtttaaggatgtcgctgatttctcagaaattaaaacggtgccagattttattgaattcttgagagaatgcgataattgggatggcatttatatgtcgaaaacagcgattgacaaaatatctagcttgtattttgccaactggcacagcatcaaggataaattaaaagaagctaaagcggatgcctgtatcacatacgaaaagaaacgtgaagaacctataaaattacgtgatgcagtggaattgtctgggttgtttgccgtgttggattctgagcaatctgaacattttttcaaagattcgttattcaaagatgatgataccaacgactatcgtggtgttttgaataaaactcttacgccaagcaagaacctcatccaattgctgtgttttgatattgagagaaatacgaatgcatttctatctaaatctaataacattgttaaattagaaaagtataaggacgaaaacgatcaggctggtgaagaagaccaaacgattaggaaaataaaagaatggtttgatgcggcaaccgatgctatgcgtattgtgcgctatttctccgtgcgcaaaagcaaaatgaaaggtaatattccaaatgccacaatagaacaggcgttgagcaatctgttatacaacgatgatgcacagtggtttaagtggtatgacctcatccgcaattatctaaccaagaaaccgcaagacgatgcaaaagaaaacaagttgaagttgaattttgggacttcgtctttactaggtggttggagtgatggacaagaaaaaacaaaagtcgccaccttattaaagtaccatgatgaaatatatttatgtgtattgaagaccaagaatatttttgatacatcaaaggataataatccgatttatgacataacggaatcagaagcaagtcgcctgttattaagaaacctgaagttccaaactcttgcaggaaaaggctttttgggagaatatgaaatttcatatggcgatatggggaaagaaaatccaaccaaagcaattaagtgtttacagaaaataattaaagaacgatacgtaaacaaatatcccttattggagaaatttgcaagaaatacctatacagacaaagctcaattcgatgcagaaattacagaaacattaaaagaatgttatgtctgtcaatttgttccaatagattggaatgttgttactgaaaaacaagataatgaggaattattcttgttcaaaatactctgcaaggattataggccgaaaagcgttggaaagaaagatctacaaacaatgtattgggaggacgtgttgtcagatggaagcaaacatcaattgtgtgctggtgccgaaatatttatgcgtgaaccagtagcaaaggaatcaccaattatacatagaatcggttctaagtttgtaaacaaacgagacaaagacggcgatactattccagaacagatttatagagaaatatattcgtatgccaatggtaagaagaaaacaatatccgctgaatctagaaagtatattgatgaacaaaaggtgataattaaagatgtgaagcacaaaatcattaaggataatcggttttatggtgaaacaaaatacatgttccattgcccaattaaattgcaatttgaagctaaagatcctaaatacgcttattcggaagtaaacacaaccgtcagcaacgcacttcagcaatctgacaacctacaatttatcggcatagaccgtggtgaaaagcatcttgtttatagttgtatagttgacaaggattgcaagatactaaagtgtggtcatcacgacgttatcaatggaacggactatgttcaaaaattagaggctgttgccgacgaacgcattgttgccaaaaagaattggcaacagcagaacaaaatcagagatctgaaaaacggctatatatcgcatgtggtacatcgcttggtagaggagacaataaaagataacggaaaaatagctccacacgcatacattgttttggaagacctgaatacagaaatgaaacgtggtcgccaaaagattgagaaacaggtttatcaaaacctggaaacagcgcttgcaaaaaaactcaattttgtagtggataaagatactaagaaaggtgaaataggatctgtaagtaaggcattacaacttacgccccctatcaataactaccaagacattgaaggtaagaaacaatttggcgtaatgctatatactcgagccaattatacgtcagtcaccgaccccgcaacaggttggcgcaaaaccatctacattaagaatggcaaagaagatgatattaaaaatcagattcttgacaaattcagcgactttggctttgatggagattattattttgaatacacagaagccaatgtgggacacacttggcgtttgtattctggtaaaaatggcaaagcattgccacgtttccaaaacaaaaagcaagcgcttcaagataaaaatgtttgggtgccagaaaagatcaatgtagttgatatcctcaataagctttttgcgaagtttgacaagaagaaatcctttaaatcacaaattgaagctggagttgaattacaaaaagatgaggaacgtaatgaaacagcttggcaatcgttacgctttgcacttgatttgattcagcaaatccgtaattcgggtgagaagaattccggagatgataatttcttgtactctcctgtccgcaacgataaagacgaacactttgacacgcgtaattataaaaataatggcgaactatcagaaatcagagatgccgatgcaaacggtgcatacaacattgctcgcaagggcttaattatggatacacacataaagcattggattaataatgggcgacccaaaacgaaaattgatggcagcgaagtctctgatttggatttgtttatttccgatagagagtgggatttgtggcttttagatagagaacaatggatgaaagaattgcccacattcgcttcgaaaattgcaaaatacgacagcgacgcccctcaaactgcaaaaagaagaaagaagagataa

SEQ ID NO: 20 - protein, 1297 aa, synthetic construct
MEMRLMVVFEDFTKQYQVSKTLRFELIPQGKTLENMERAGIVKGDCQRSEDYQEAKKIIDKIYKHILNSSMAKVEIDWSTLAEATKEFRKNKDKKKYENVQVRVRKKLLEDIKNQTITVEKGAKDLYKAMFEKEIVTGEVCAAFPEIDLTDEEKAILDKFKKFTTYFTGFFENRKNIFTDEGISTSFTYRLVNDNFIKFYDNCNLYKDIIASVPGLKGEFKKCFKDLQLFSKCRLEEIFETSFYNHILTQDGIDEFNQLLGGISAKEGEKKKQGLNEVINLAMQKDEGIRNKLRYRAHKFTPLFKQILNDRSTLSFIPETFENDRKVLESIEAYKLYLSEQNILEKAQELLCSMNRYDSRKLSIDGKYISKLSQAIFNSWSKIHDGIKDYKKSLLPKETKKALKGIDMELKQGVSVQDILDALPEENFHEVIVDYTHNLVQKCQAVLSGSLPGNIETDKDKTDIKLVMDPLLDLYRFLEIFSHDNSQGVKTAFEEQLMEILADMKEIIPLYNKVRNFATKKAYSVEKFKLNFNVATLASGWDQNKENANCAIILRKKDMYYLGIYNSSNQPFFEIVEQDDDGFEKMIYKQFPDFNKMLPKCTVSRKNDVAVHFNKSDADFLLNVNTFSKPLLITKEVYDLGTKTVQGKKKFQIDYKRNTGDEAGYKAALKAWIDFGKEFIKAYESTAIYDISLLRKSEDYPDIQSFYKDVDNICYKIAFQKISDEAVNQCVENGSLYLFKLHAKDFSPGASGKPNLHTLYWKYVFEEENLKDVVVKLNGQAELFYRPRSLTQPVVHKKGEKILNKTTRSGEPVPDDVYVELSHFIKNGSTGNLSNEAKKWQAKVSVRNVPHEITKDRRFTQDKFFFHVPLTLNYKSANTPRRFNDLVKAYIKKNPDVHVIGIDRGERNLIYAVVIDGKGKIVEQRSFNIVGGYNYQEKLWQKENERQAARRDWTAVTTIKDLKQGYLSAVVHELSKMIVKYKAIVVLENLNAGFKRMRGGIAERSVYQQFEKALIDKLNYLVFKDAVPAVPGGVLNAYQLTDKFDSFSKMNQQTGFLFYVPAAYTSKIDPLTGFVDCFNWKQIKKNTESRKAFIGLFESLCYDANTNNFVLHYRHKANRYVRGGNLDITEWDILIQENKEVVSKTGKSYRQGKRIIYRKGSGNHGEASPYYPHEELQSLLEEHGISYKAGKNILPKIKAANDNALVEKLHYIIKAVLQLRNSNSETGEDYISSPVEGRKDWCFDSRAADDALPQDADANGAFHIAMKGLLLMKRIRNDEKLAISNEDWLNYIQGLRS

SEQ ID NO: 21 - protein, 1293 aa, synthetic construct
MRDVVTFENFTKQYQVSKTLRFELIPQGKTLDNMKRDGIISVDRQRNEDYQKAKGILDKLYKYILDFTMETVVIDWDELATATEDFRKSKDKKAYEKVQSKIRTALLEHVKKQKVGTEDLFKGMFSSKIITGEVLAAFPEIRLSDEENLILEKFKDFTTYFTGFFENRKNVFTDEALSTSFTYRLVNDNFIKFFDNCIVFKNVVNISPHMAKSLETCASDLGIFPGVSLEEVFSISFYNRLLTQTGIDQFNQLLGGISVKEGEHKQQGLNEIINLAMQQNPEVKEVLKNKAHRFTPLFKQILSDRSTMSFIPDAFADDGEVLSAVDAYRKYLSEKNIGDRAFQLISDMEAYSPELMRIGGKYVSVLSQLLFNSWSEIRDGVKAYKESLITGKKTKKELENIDKEIKYGVTLQEIKEALPKKDIYEEVKKYAMSVVKDYHAGLAEPLPEKIETDDERASIKHIMDSMLGLYRFLEYFSHDSIEDTDPVFGECLDTILDDMNETVPLYNKVRNFSTRKVYSTEKFKLNFNNSSLANGWDKNKEQANGAILLRKEGEYFLGIFNSKNKPKLVSDGGAGIGYEKMIYKQFPDFKKMLPKCTISLKDTKAHFQKSDEDFTLQTDKFEKSIVITKQIYDLGTQTVNGKKKFQVDYPRLTGDMEGYRAALKEWIDFGKEFIQAYTSTAIYDTSLFRDSSDYPDLPSFYKDVDNICYKLTFEWIPDAVIDDCIDDGSLYLFKLHNKDFSSGSIGKPNLHTLYWKALFEEENLSDVVVKLNGQAELFYRPKSLTRPVVHEEGEVIINKTTSTGLPVPDDVYVELSKFVRNGKKGNLTDKAKNWLDKVTVRKTPHAITKDRRFTVDKFFFHVPITLNYKADSSPYRFNDFVRQYIKDCSDVKIIGIDRGERNLIYAVVIDGKGNIIEQRSFNTVGTYNYQEKLEQKEKERQTARQDWATVTKIKDLKKGYLSAVVHELSKMIVKYKAIVALENLNVGFKRMRGGIAERSVYQQFEKALIDKLNYLVFKDEEQSGYGGVLNAYQLTDKFESFSKMGQQTGFLFYVPAAYTSKIDPLTGFINPFSWKHVKNREDRRNFLNLFSKLYYDVNTHDFVLAYHHSNKDSKYTIKGNWEIADWDILIQENKEVFGKTGTPYCVGKRIVYMDDSTTGHNRMCAYYPHTELKKLLSEYGIEYTSGQDLLKIIQEFDDDKLVKGLFYIIKAALQMRNSNSETGEDYISSPIEGRPGICFDSRAEADTLPYDADANGAFHIAMKGLLLTERIRNDDKLAISNEEWLNYIQEMRG

SEQ ID NO: 22 - DNA, 3894 bp, synthetic construct
  source 1..3894: mol_type = other DNA
atggaaatgaggctgatggttgtttttgaggattttaccaagcagtaccaagtatctaaaacgctgcgctttgaactcatcccccagggcaagacgctggagaatatggaaagggctgggatcgtgaagggtgactgtcaaagatccgaggattatcaggaagccaagaagattatcgacaagatctacaaacacatcctgaacagcagcatggccaaggtggagatcgactggtctactctcgccgaggcaaccaaggagttccgtaagaacaaggataagaagaagtacgagaacgtccaagtgcgggtgcggaagaagttacttgaggacattaagaaccagactattaccgtggagaaaggtgcaaaagacttgtataaggctatgtttgagaaggaaatcgtgacaggagaggtttgcgcagccttccctgaaattgatctgacggatgaggaaaaagccatcctcgacaagttcaaaaagttcaccacatactttacaggcttttttgagaaccgcaagaatatcttcacagacgagggaatctcaacttcctttacttacaggctggttaatgacaacttcattaagttctacgacaactgcaacctttataaggacatcattgccagtgtgcccggattgaaaggtgagttcaagaagtgttttaaggacttgcagctgttttccaagtgccgacttgaagagatctttgagacatccttttacaaccatatccttacacaagacgggatcgacgagtttaaccagctgttaggggggatttctgctaaagagggcgaaaaaaagaaacagggcctgaacgaggtgataaatttggctatgcagaaagacgagggaattcgaaacaaactccgctatagagcacacaaatttacccctttgttcaagcagattttaaacgatcggagcaccctgagttttattccagagacatttgagaacgacagaaaggtgcttgagagtattgaagcttacaagctctatctgtccgagcagaatattcttgaaaaagcccaggaactgttatgttcaatgaaccggtacgactctcgtaaactcagcatcgacggcaaatatatctcaaaactcagtcaggcgatcttcaacagttggagcaaaatccatgatggcatcaaggactataagaagagtctgcttcctaaagagacaaagaaagccttaaaaggcattgatatggagctaaaacagggagtgtctgtccaggacatcctggatgccctacccgaagagaattttcacgaagtgattgttgattacactcacaacctagtgcaaaagtgtcaagctgtcctgtcagggtcacttccaggtaacatcgaaacagataaagacaagaccgatattaagcttgtcatggaccccttactggatctctacaggttcctggagatattctcacatgataatagccagggggtgaagacggcttttgaagaacagctcatggagattctggctgatatgaaggagatcataccactttataacaaggttaggaactttgcgacgaaaaaggcttattccgtcgaaaagttcaagctcaatttcaatgttgcgacactcgcctctgggtgggatcagaacaaagaaaacgccaattgcgcaattattctcagaaagaaggacatgtactacctcggaatctacaacagctccaatcagccattcttcgagatcgtggagcaggacgacgacgggttcgagaaaatgatttacaaacaattccctgacttcaacaagatgttgcccaagtgtaccgtgagcaggaagaatgacgtagcggttcattttaataagtccgacgccgacttcctcctaaatgtgaacaccttctccaagccgctcctgataacaaaggaagtatatgacctcggcacgaagaccgtgcaaggcaagaagaaatttcaaattgactacaagcgcaataccggcgatgaggctggatacaaagcagcactgaaggcgtggatcgatttcggcaaagagttcattaaagcctatgaaagtacagccatctatgatataagcctgctcaggaagagcgaagactatccagatatacagtctttctataaggacgtcgataacatctgctacaaaatagcgttccagaagatttcagatgaggcagttaatcagtgtgttgaaaatggctctctgtacttgttcaaactccacgctaaggatttttcacctggagcatccggcaaacccaatcttcacactctgtactggaagtatgtatttgaagaggaaaatctgaaggatgtcgtcgtcaaacttaatgggcaggccgaactgttctatcgcccacggtcactgacccaacccgtggtccacaagaaaggcgaaaaaatcttgaacaaaaccacccggtcaggtgagcctgtaccagatgacgtctacgtggaactctcacattttatcaaaaacggttctactggcaatctgagtaatgaagcgaaaaaatggcaggctaaggtgagcgtgaggaacgtaccccacgaaattactaaagatcgccgcttcactcaagacaaattcttctttcatgtgcctctgacactgaactataaaagcgcaaataccccacgaagattcaatgatctggttaaggcttacatcaagaaaaatccagacgtccatgtgatcgggatcgaccggggtgagcggaacttgatttacgctgtggtaatcgacgggaaagggaagatcgtggagcagagatcgttcaacatagtgggaggatacaactaccaggaaaaactgtggcagaaagagaatgaaaggcaggctgctcgtcgagattggactgccgtgaccacaataaaagatctgaaacagggctatctcagcgctgtggtgcacgaactttccaagatgatagtaaaatacaaggccattgtcgtcctggagaatttaaatgcgggatttaagcgaatgagaggcggtattgcagaaagatccgtgtaccagcaatttgagaaagctctaattgacaagttgaattacctggttttcaaggacgccgtacctgcagtgccgggaggagtcctcaacgcctatcagcttaccgacaagtttgattccttttccaaaatgaaccagcaaacagggttcctgttttacgtccccgccgcatacactagcaagattgaccctttgaccggattcgtggactgctttaactggaaacagatcaaaaagaacaccgagagtcgaaaggcatttatcgggctattcgaatctctgtgctatgacgcaaatactaataatttcgtgttgcattaccggcacaaggccaataggtatgttcgcggggggaatctggatattactgagtgggatatccttatccaggagaacaaggaagtcgtttccaaaaccggcaaatcctatcgtcagggcaaaagaataatctatcggaagggaagcggcaaccatggcgaagccagcccttactacccgcacgaggagctgcagagtctcctggaggagcacggtatctcttacaaggctgggaaaaacatactgcccaagataaaggctgcaaatgacaacgccctagtcgagaaactgcactatattataaaagctgtgctacagctgaggaatagtaattctgagactggagaagattatatttcgtctccggtggagggccgcaaagattggtgcttcgatagcagagccgccgatgatgccttgccccaggatgccgatgccaacggtgcctttcatatagccatgaaaggcctgttattaatgaaacggatcagaaatgatgagaagctggcaatctcgaatgaagactggttgaactatattcaaggactgcgctcttga

SEQ ID NO: 23 - skipped

SEQ ID NO: 24 - DNA, 36 bp, synthetic construct
  source 1..36: mol_type = other DNA
atctacgagagtagaaattaacattgtcagttagac

SEQ ID NO: 25 - DNA, 35 bp, synthetic construct
  source 1..35: mol_type = other DNA
tctacgagagtagaaattaacattgtcagttagac

SEQ ID NO: 26 - DNA, 36 bp, synthetic construct
  source 1..36: mol_type = other DNA
atctacgagagtagaaattaacatatactgtcagac

SEQ ID NO: 27 - DNA, 36 bp, synthetic construct; identical to SEQ ID NO: 26
  source 1..36: mol_type = other DNA

SEQ ID NO: 28 - RNA, 36 nt, synthetic construct
  source 1..36: mol_type = other RNA
gtctaactgacaatgttaatttctactctcgtagat

SEQ ID NO: 29 - RNA, 36 nt, synthetic construct
  source 1..36: mol_type = other RNA
gtctgacagtatatgttaatttctactctcgtagat

SEQ ID NO: 30 - DNA, 3894 bp, synthetic construct
  source 1..3894: mol_type = other DNA
atggagatgagattaatggttgtatttgaggatttcacaaaacagtatcaagtgtcgaaaacattaagatttgaattgattccccaaggaaagaccttggaaaatatggaacgggcaggtattgtaaaaggagattgtcaacgtagtgaggactatcaagaagcaaagaaaattatcgataaaatttataaacacattttaaattcatccatggctaaggttgaaattgattggtcaaccttagcggaagcaactaaagaatttaggaaaaataaggataaaaagaaatatgaaaatgttcaagttcgtgttagaaagaaactgcttgaagatataaaaaatcaaacaatcacagtagaaaagggggcgaaagatctttataaggcaatgtttgagaaagaaatcgttacgggggaagtatgtgctgcatttcccgaaatagatttaacggatgaagaaaaagccatattggataaatttaaaaaatttacaacgtattttacaggattctttgaaaacagaaaaaatatctttactgatgaaggtatcagtacttcttttacgtatcgactggtaaatgataattttataaaattttatgataattgcaatctttataaagatattattgcctctgttccgggattgaagggcgagtttaagaaatgttttaaagacttacagcttttttctaaatgtagactagaagaaatctttgagacttctttttataatcatattttgacacaagacggtatcgatgaatttaatcaactcttgggcggaatttccgcaaaagagggagaaaaaaagaaacaaggcttaaatgaagttatcaatttagctatgcaaaaagacgagggaattagaaataagttaagatatagagctcataaatttacgcctctttttaaacaaattttaaatgaccggtctaccttgtcatttatacccgaaacttttgaaaatgaccgtaaagttttggagtctatagaggcatataaattatatttatctgaacagaatatattagaaaaagcacaagaattactgtgcagcatgaatcggtatgattctcgaaagttaagtattgacggtaagtatatttcaaagctgtctcaggctatctttaactcttggagtaagattcatgatggaataaaagattataagaagtctttacttcctaaagaaacgaaaaaagctttgaaaggcattgacatggaattaaagcagggagtaagcgtgcaggacatattggacgcacttcctgaagaaaattttcatgaagttatagttgattatactcataatcttgtgcaaaaatgtcaagctgtattgagcgggtctttgcctggtaatattgaaacggataaagataaaacagatattaagctagtaatggacccactgttggatttgtatcggtttttagaaatattcagccatgataattcccaaggtgtaaaaacggcatttgaagaacaattgatggaaattttggcagatatgaaggaaatcatccctttgtacaataaggttagaaatttcgctactaaaaaagcatattcagtagaaaaatttaaacttaattttaatgtagcgacattggcatccggttgggatcagaacaaagaaaatgcaaattgtgcaattatacttcgaaagaaggatatgtattatttgggtatatataattcttccaatcagccgttttttgaaatagtcgagcaagatgatgacgggtttgaaaagatgatatataaacaatttcccgattttaataaaatgttacctaaatgtacagtatcacgtaaaaatgatgttgcagttcattttaataagtctgatgcagattttttattaaatgtaaatacgttcagtaaaccgcttcttataactaaagaagtctatgatttaggcactaaaactgttcaaggaaaaaagaaattccagattgattataagagaaacactggggatgaggccgggtataaggctgccttgaaggcatggattgacttcgggaaagagttcataaaggcttatgaaagcacagctatatacgatatatcattgttacgaaaaagcgaagattatcccgatatccaatctttttacaaggatgtagacaatatatgctataaaatcgcctttcaaaagatctctgatgaagcagtaaatcaatgtgtagaaaatggttctttatatctttttaaattgcacgccaaggatttttcgcccggtgccagtgggaaaccgaatttacacacgctgtattggaagtatgtatttgaagaagaaaacttgaaagatgtagttgtgaaattaaacggacaggcagaattgttttatcgcccccgaagtttaacgcagccagttgtacataaaaaaggagagaaaattcttaataaaactactcgatcgggagaacccgttcccgatgacgtatatgttgagttgtctcactttattaaaaacggaagtacgggcaatttgtcgaatgaggcaaaaaagtggcaggcgaaggtaagcgttcgcaatgtgcctcatgagattacaaaggatcgcagatttacacaggataaattctttttccatgtgcctctgactttgaattataaatctgccaatacaccccggcgctttaatgatttagtcaaagcgtatattaagaagaatccggatgtgcatgtcattggaattgaccggggcgaacgaaatcttatttatgcagttgttattgacggaaaaggtaagattgttgaacagcggtccttcaatatcgtagggggctataattaccaagaaaaattatggcaaaaagaaaatgaacggcaggcagcgagacgcgattggaccgctgtcaccacgattaaggatttaaaacaaggatacctgtccgctgttgtacatgagttatctaaaatgatagtgaagtataaggctattgttgtacttgaaaacctcaacgcgggttttaaacgtatgcgaggcggcattgcggaacgatccgtttaccagcagtttgaaaaggccttaatcgataaattaaattatttagtttttaaagatgcagtccctgcggtgcccggaggagtcttaaatgcgtatcaattaaccgacaaatttgacagtttcagtaaaatgaaccagcaaacgggatttttgttttacgtgcccgcagcttatacttctaaaattgatcccttaacaggatttgtagattgttttaattggaaacaaataaagaaaaatactgagagtcggaaggcatttattggtttgtttgaatcgctttgctatgacgcgaatacgaataattttgtgcttcattataggcataaggctaaccgatatgttcgtggcggtaatttggacattacggaatgggatatactgattcaagaaaataaagaagtagtaagtaaaaccggcaaatcctatcgccaagggaaacgcattatctacaggaaaggctccggtaatcatggggaagcgtctccctactatcctcacgaagaactgcaatctttgttggaagaacatggaatttcatataaagcaggcaagaacatcttacccaagattaaagccgctaatgacaacgcattggtagaaaagttgcactacattattaaggccgtgcttcaattacgcaacagcaatagtgaaaccggagaggattatatcagttctcccgttgaaggccgcaaagattggtgctttgatagtagagctgcagatgatgcgttaccacaagatgctgatgctaacggtgcctttcatattgccatgaaaggattgttattaatgaaacggattcggaatgatgaaaagcttgcaattagtaatgaagattggctgaattacatacaaggattgagaagctaa

SEQ ID NO: 31 - DNA, 3882 bp, synthetic construct
  source 1..3882: mol_type = other DNA
atgagagatgtggtgaccttcgagaattttacaaaacagtaccaggtgagcaagactctgaggtttgaactgatcccccaggggaaaacactggataacatgaaaagagatggaatcatttccgtggacaggcagcgcaacgaggactatcagaaggccaagggcatcctggataagctgtataaatacatcctggacttcaccatggagaccgtggtgatcgactgggacgagctggcaaccgccaccgaggatttcaggaagagcaaagataagaaggcctacgagaaggtccagagcaagatcagaacagctctgctggagcacgtgaaaaaacagaaagtgggcaccgaggatctgttcaaggggatgttcagcagcaagatcattaccggcgaagtgctggcagctttccccgagatccgcctgtccgacgaagagaatctgattctcgaaaagttcaaggacttcacaacctacttcacaggattcttcgagaaccggaagaatgtgtttactgacgaggccctgagcaccagcttcacttaccggctcgtgaacgataattttatcaagttcttcgataactgcatcgtgtttaagaacgttgtgaatatcagccctcatatggccaagagcctggagacctgcgcctccgatctgggcatcttccctggcgtttccctggaggaggtgttctccattagtttctacaatagactgctgacccagactggcattgatcagttcaaccagctgctgggcggaatctctgtgaaggaaggagagcacaagcagcaggggctgaatgagatcatcaaccttgccatgcagcagaatcctgaggtcaaagaggtgctgaagaataaggcccaccggtttacccccctctttaagcagattctgtccgacaggtccaccatgtcctttattcctgatgccttcgccgatgacggcgaagtgctgagcgccgtcgacgcataccgaaaatacctgagtgagaagaacatcggcgatagggcctttcagctgatcagcgatatggaagcctacagccccgagctgatgagaatcggcggcaagtatgtgtccgtgctgtcacagctgctgttcaactcttggagcgagatcagggatggagtgaaggcctacaaggaaagcctgatcactggcaagaagaccaagaaggaactggagaacatcgacaaggagatcaaatatggagtgacactccaggagatcaaggaggctctgcctaagaaagacatttatgaggaggtgaagaaatacgccatgtccgtggtgaaggactatcatgcaggcctggccgagcctctgccagaaaaaattgagaccgatgatgagagggcttcaatcaagcacatcatggatagcatgctggggctgtatagatttctggagtactttagtcacgacagcatcgaggacactgatcctgtgttcggagagtgcctggacactatcctggacgatatgaatgagacagtgcctctgtacaataaggtgcgcaatttcagcacaaggaaggtgtacagcacagagaagttcaagctgaacttcaataatagctccctggccaacggatgggataaaaacaaagagcaggctaatggcgcaattctgctgagaaaggagggggagtatttcctgggaatcttcaacagcaagaataaacccaagctcgtgtccgacggcggcgccggcatcggctacgagaagatgatttacaagcagttccctgacttcaagaaaatgctgccaaagtgcaccatcagcctgaaggacaccaaagcccacttccagaaatctgatgaagactttaccctgcagaccgataaattcgagaagtccatcgtgatcacaaagcagatctacgacctggggacccagactgtgaacggcaagaaaaagttccaggtggattaccccaggctgaccggagatatggagggataccgggccgcactgaaagagtggatcgatttcggcaaggagtttatccaggcctacacatccacagccatctacgacacttccctgttccgggactcatcagattaccctgacctgcccagcttttacaaggacgttgacaacatctgctacaagctgacctttgaatggatcccggacgcagtgattgacgattgcatcgatgacgggtccctgtacttgttcaagctgcacaacaaagacttttccagcggctccatcggcaagccaaatcttcacacactctattggaaagccctgttcgaggaggaaaacctgtccgatgtggtggtgaagctgaatggccaggcagagctgttttatcggccaaagagcctgacaaggcctgtggtgcacgaggagggtgaggtgatcatcaataagactaccagcaccggcctccctgtgccagatgacgtgtacgtcgagctgtccaagttcgtgcgcaacggcaagaagggaaacctgaccgacaaagccaagaactggctggacaaagtgaccgtgcggaaaaccccccacgccatcaccaaagatcggcgctttacagtggacaagttcttcttccacgtgcccattacactgaactataaggctgactcaagcccttatagattcaacgacttcgtgcgccagtacattaaggactgctcagatgtgaagattatcggcattgacaggggagagaggaacctgatttacgccgtggtgatcgacggcaagggcaacatcatcgaacagagaagttttaatacagtgggcacctacaactaccaggagaaactggaacagaaggaaaaggagaggcagaccgccaggcaggactgggcaaccgtgacaaaaattaaagatctgaagaagggctacctgtctgccgtggtgcacgagctgtccaagatgatcgtgaagtacaaggctatcgtggccctggagaacctgaatgtggggtttaaacggatgagggggggcattgccgagaggtctgtgtatcagcagttcgaaaaggccctgatcgacaagcttaattacctcgtgtttaaggacgaagaacagagtggttatggtggggtcctgaacgcctaccagctgaccgataagttcgagtccttcagcaaaatgggccagcagaccgggtttcttttctacgtgcccgcagcctacaccagcaaaatcgaccctctcacaggcttcattaaccctttctcttggaaacacgtgaagaatcgggaggacaggaggaacttcctgaacctgttcagcaagctgtattacgatgtgaacacccacgacttcgtgcttgcctaccaccacagcaacaaagatagtaaatacacaatcaagggaaactgggagatcgccgactgggacattctgatacaggagaacaaggaggtgttcggcaagaccggcacaccttactgcgtgggcaaaaggattgtgtacatggatgattccaccaccggccacaatagaatgtgtgcttactatccacataccgaactgaaaaaactgctgtccgagtacggaattgagtacacatctggacaggatctgttgaagatcatccaggagttcgatgacgacaaactggtgaaaggcctgttctacatcattaaggctgctctgcagatgcggaattccaacagtgagacaggcgaagactacatctcctcccccatcgagggcaggcctggcatctgttttgacagcagagccgaggccgacacactgccttatgacgcagacgccaatggcgcttttcacattgccatgaaggggctgctgctgaccgagcggatccggaatgatgataagctggccatcagcaacgaggaatggctgaactatatccaagagatgcggggctag

SEQ ID NO: 32 - protein, 1262 aa, synthetic construct
MKNLKEFHNLYPVQKTLRFKLEPIGKTEEFIERAQILENDERRADEYLKVKEYIDRYHREFIENALSQPLLKVESEGKQDSLEDFADCYNNDNSEKRSDNLEKIQDKLRTQIVKGFSKLPAFARIAKKELIKEDLPKFLKDKNEKEIVSHFDEFTTYFTGFHQNRMNMYTAEAKSTSIAFRLINQNLVKFVDNSNILEKVVPVLGKDIIAQLDKDFEPFLNVDSALDLFKIDNYNEVLTQLQIELYNAIIGGRVDEGNKVEIKGLNQYINEFNQTHEKSLRIPKLKPLFKQILSENVGVSFRMEQFTDASQVQTAIKEEYIKLESSVFDKLKEMIKSLPTFNLNGIYLANDLGLTDICQRYYGAWDKLNNALVAEFDAVVPRKKTQSQEKRDNQVKKYLKSVKSISLGKIDSLLADVTEKSIVDYFTNLGAIDNETTQRENLFALIQNRYISLKEVLDCPTPSDELLRKNIEGIKDLLDAIKDLQRFIKPLCGCGEELDKDEMFYSDFSPLYETLDDIITPLYNKVRSYLTKKPYKLDKFKLNFETPTLLQSWPNYQAYSCAIFKEDDNHYYLAILDKNNRSCLNTIVPPISKNDIIGLVKHLQGGDMGKNVQNLMRIDGKTRKVNGRKETSGPNAGQNIRLEESKKTYLPHEINEIRIEKSFSLNSPNYRRECLNKYIDFYKPLVEEYYSEFDFEFKEASEYRDFSQFTNHINQQSYQLKIIPFSKKYLKTLVDNGQVFLFRILNKDFSPYSKGRPNLHTIYWKMLFDDNNLKDVIYKLNGKAEMFFRRSSITNPVIHAANKEIANKSAYNKQHKAVSKFDYDIIKDRRFTRNQYEFHVPITMNFKSAGSVRFNQEVLSFIKEKGIKHIIGIDRGERHLLYLTMINMKGEIVEQFSLNDVASNPNNPEYKQDYNELLSIKEGDRLSARRNWSTIENIKELKSGYLSQIVHLLSKMMIENDAILVLENLNTGFMRGRQKVEKSVYLKFEKMLIDKLNYVVDKTAAPNEPSGALKALQLTDTYDNFNKYQKGNVRQCGFVFYIPAWNTSKTDPVTGYVNLFDTRLSTIGEIKSFFSKFDRIKYNSKNDAFEFTFDYNNFTTRAEGTRTCWTISSQGERIFTHRSKEQNNQFVSETVHPTQIFKDVFKMAGCEINGNLKEGIASIESLEPLKQLLHAFKLVIQMRNSITGTEVDFLLSPAIDAKGTNFDSRKGISTLPENADANGAYNIARKGLMIVEQIQNADDIANIKYSVSNNDWLKFAQG

SEQ ID NO: 33 - protein, 1273 aa, synthetic construct
LCSIFAHMAINFAREIKKYYLCIINIKKILNMECLKDFYNQYSVQKTLRFKLEPVGKTEEFIERAQVLENDERRAAEYKKVKDLIDNYHRWFIEQALSAPLLKVDSTGDNDSLEDFQDCYNNDTSEKRSDNLEKIQGKLRSQIVKGFSKHPAFKHIDKKELITTDLKQFLTDPNEIDIVSHFANFTTYFTGFHQNRMNMYSVEAKSTSISFRLINQNLVKCVDNSKILEKVKPALGADIFSKLNHDFEPFLNVVDALDLFKVENYNEVITQPQIELYNAIIGGRVDNDSKVEIKGLNQYINEYNQTHSKQERLPKLKPLFKQILSEREGVSFRIEQFEKANQVQDAINEAYNDLHANVFTKLKDLLLNLSSFDLDGVFVANDQSLTDISQRHYGAWDTVKNAVVASYDMTNPRKKSQSQEKRDEQVKKHLKSIKSLSLATIDNMLKDSTGLSIVDYFTTLGAVNNENLQHENLFALIENRYNAARSVLDSDSPSDELLRKNITQIKDLLDSIKDLQRFIKPLCGSGEEPLKDEIFYSDFSALYESLDDTITPLYNKVRSYLTRKPYSLDKFKLNFDNSQLLDGWDVNKEKDYLSILLRKNGYYYLAIANKNDKSALSQINQCDMISGDCYEKLNYKLLPSPFKMLPKVFFSRKGIEVYNPSQEILDIYNEKKFQLGDKFDKESLIKLIDFYKNAIPQNESWQSFDFSFAPSQSYESINEFYSVIENQGYKIDFKKVPSSLINLLIDQGLLYVFKIANKDFSPHSKGRPNLHTIYWRMLFDENNLKNVVYKLNGRAEMFYRKSSIQNPVIHKAHHDIKNKSEYNKLHKPSSKFDYDIIKDRRFTRNQYEFHVPITMNFKPAGSGQFNRDVLKFIKAKGIKHIIGIDRGERHLLYLTMIDLKGRIVEQFSLNSVASNPNNPDFKQDYNTMLAIKEGDRLNARRNWSTIENIKELKQGYLSQIVHLLSKMMIENDAILVLENLNSGFMRGRQKVEKSVYLKFEKMLIDKLNYVVDKGTDLNEPCGALKALQLTDSYEKFNKFQKGNVRQCGFVFYIPAWNTSKIDPATGFVNLFDTRLSTIGEIKAFFSKFDRISYDASNDVFEFSFDYNNFTSRAQGTRTRWTVTTRGERIFTHRSKEKNNQFVSELVSPTSLLKDVLEKTGTNLQGNLKEAIASLQSLDELKQLLHAFKLTMQMRNSVTGTDVDYLISPAIDAKGNNFDSRECDSTMPLNADANGAFNIARKGLMIVEQIQKVDDIGNLKYAVTNKDWLTFAQK

SEQ ID NO: 34 - DNA, 3789 bp, synthetic construct
  source 1..3789: mol_type = other DNA
atgaagaacctcaaggagtttcataatctctatcctgtgcagaagactctgcggtttaagctggaacccatcggtaagaccgaagaattcatcgagagagcacagattttggagaatgatgagcggcgcgccgacgaatatctgaaggtaaaggaatacattgaccggtaccatagggaattcattgagaacgccttgtcacagcctctgctcaaagtcgagagtgaaggcaaacaggattccttggaagacttcgcagactgttataacaacgacaatagcgagaaaagatccgataatctggagaagatccaagataaactgagaacccagatcgttaaaggattcagcaaactaccagcctttgcccggatcgcaaagaaggagctaattaaggaagatctgcccaaattcttaaaggataaaaacgagaaggagatcgtgtctcattttgacgaatttacaacctactttaccggctttcatcagaataggatgaacatgtatactgcagaggcaaagagtacatccatagcatttcgccttatcaatcagaacctggtgaagtttgtagacaactctaatattctcgaaaaggttgtcccagtactgggaaaagacatcatcgctcaactggacaaagatttcgagcctttcctcaacgtagattctgctctggacttattcaagatcgataactacaacgaggtgctcactcagcttcagattgagctgtataatgccatcatcgggggcagagtggatgaaggtaacaaagtcgagataaagggactgaatcagtatattaacgagttcaaccagacccatgagaagagtctgcgtatacccaaactcaaacctctgttcaagcagatacttagcgagaacgtgggcgtgtcgttccgcatggagcagttcacagatgccagccaagtgcagactgctatcaaagaggaatacatcaaactggaatcctcagttttcgacaaactcaaggagatgataaaatcactccccaccttcaacctgaacgggatctacctggctaatgatttgggtctgacggacatctgccaaagatactatggcgcgtgggataaacttaacaacgccctggttgcagaattcgacgcggtggtacctaggaagaaaacccagagtcaagagaaaagggacaaccaggtcaaaaaatacctgaagagcgtgaagtccatcagcttggggaaaatagactcccttctcgctgacgttacagaaaagtcaattgtggactatttcacaaatctcggagctatcgataacgaaaccactcagcgcgaaaacctgtttgctctcatacagaatcgctacatctctctcaaggaggtccttgactgtccaacaccttctgatgaactgcttaggaagaatattgaggggattaaggacttattggatgcaataaaggatctacaacggtttataaaacccctatgtggctgcggagaggaactagataaggatgaaatgttttacagcgacttttcacctctctacgagactctggatgacattataactcccctgtataataaggtgaggagctacttgaccaagaaaccctataagcttgacaagttcaagctcaattttgagacgcccaccctcttgcagtcttggcctaactatcaagcctactcatgtgcgatcttcaaggaggatgataatcattactacttagccatcctggacaaaaacaacaggtcgtgcctgaataccatcgttccacctatatccaagaacgacataatcggcctggtcaagcacttacagggcggcgatatgggaaaaaatgtgcagaatttgatgcgaatcgacggtaaaactcggaaagttaatggccggaaagagacatctggcccaaatgctggccagaacattaggcttgaggagtcgaagaagacatatctgccgcacgagattaacgagatccgaattgagaaaagtttcagcttaaactctccgaattatagacgcgaatgcctgaacaagtacattgatttctacaaacctctggtcgaggagtactattcagagtttgactttgagttcaaagaggctagcgaatatcgggacttctcccagtttactaatcacatcaaccagcaatcataccagctgaaaattatccccttcagcaaaaagtacctgaaaaccctagtggataacgggcaggtgtttttattccggatcctcaacaaggactttagcccatattctaaggggcgtccaaacctgcacacgatctactggaagatgttgtttgacgacaataacctgaaggacgtgatttataagctcaatggtaaagcggagatgttttttaggcggtcctctattacaaacccagtgatacatgctgcaaacaaagaaattgccaataagtctgcctacaataaacaacataaggccgtgtccaagttcgattatgacattataaaggatcgccgattcacaagaaaccagtacgagttccacgtccccatcaccatgaactttaagtccgccggatcagtcaggttcaatcaagaggttttgagcttcattaaggagaagggtattaagcacattattggaattgatcgaggtgaacggcaccttctttatctgacaatgatcaacatgaaaggagagatcgtcgaacaattttctctcaatgacgttgcctcaaatccgaataatcccgaatacaaacaagactataacgagctcctctctatcaaggagggagatagactgtcggcccgcaggaattggtccacaatcgagaacattaaagagctaaagtctggttaccttagccagattgttcacctgcttagtaagatgatgatcgaaaatgacgccattttagtgctagagaatctgaacacgggctttatgagaggtagacagaaggtggaaaaaagcgtctatctgaagttcgagaaaatgcttatcgataagctgaattatgtggtagacaaaacagctgcaccaaacgaaccaagtggggcattaaaagctctccagctcactgacacgtacgataacttcaacaagtaccagaagggaaatgtgaggcagtgcggctttgtcttttatatcccagcctggaacacctctaaaaccgaccccgtcacagggtatgtcaacttgttcgacactcgtctcagtaccatcggggaaatcaagagttttttcagcaagttcgatcgtatcaaatacaacagtaagaacgatgccttcgagttcacattcgactacaataatttcactacgcgagcggaggggactcgtacctgctggaccatctccagccagggagaaagaatatttacccaccgctcaaaggaacagaacaatcagttcgtgtccgaaaccgtgcaccccactcagatctttaaagacgtgttcaagatggctggatgtgaaatcaatgggaacctgaaagaagggatcgcatccattgaatccctggagccgttgaagcagcttctgcacgcctttaaactggtgattcagatgcgcaatagtattaccggaactgaagtggactttctgctgagccctgcaattgacgctaaaggcacaaattttgattcccgaaaaggcattagcacattgcccgaaaatgccgacgccaacggggcttacaatatagccagaaaaggcttgatgattgtagagcagattcaaaatgcggatgatatcgctaatatcaagtactcagtttccaataacgattggctgaagtttgcccaaggctga

SEQ ID NO: 35 - DNA, 3819 bp, synthetic construct
  source 1..3819: mol_type = other DNA
ctttgcagcattttcgcccacatggccatcaacttcgccagagaaatcaagaagtactacctgtgcatcatcaacataaagaagatcctgaacatggaatgcctgaaagatttctataatcaatacagcgtccagaagaccctgagattcaagctggaacctgttggaaagaccgaggaattcatcgagagagcccaagtgctggagaacgatgaacgccgggccgctgaatacaagaaggtcaaggacttgatcgataactaccacagatggttcatcgagcaggccctgagcgctcctttgttaaaggtggacagcaccggggataacgattccctggaagatttccaggactgctacaacaacgataccagcgagaagagaagcgacaatctggagaaaatccagggcaagctgcggtctcagatcgtgaagggctttagcaagcaccccgccttcaagcacatcgacaaaaaggagctgatcacaaccgacctgaaacagtttctgaccgaccccaacgagatcgacatcgtcagccacttcgccaacttcaccacctacttcaccggcttccaccagaacagaatgaacatgtacagcgtggaagccaagagcacctccatctcttttagactgatcaaccagaatctggtgaagtgcgtggataattccaagatcctggaaaaagtgaagcctgctctcggcgccgacatcttcagcaagctgaaccacgattttgagcctttcctgaatgtggtggacgccctggacctgttcaaggtggaaaactacaatgaggtgatcacacaacctcagatcgaactgtacaacgccataattggaggcagagtggacaacgactcgaaggtggaaatcaaaggcctgaaccagtacatcaacgagtacaaccaaacacactctaaacaggagcggctgcctaagctgaaaccactgtttaagcagatcctgagcgagagagagggcgtgagcttcagaatcgagcaatttgagaaagcgaaccaggtccaggacgccatcaacgaggcctacaatgacctgcacgccaacgtgttcacaaagctgaaggatctgctgctgaacctgtctagcttcgatctggacggcgtgttcgtggccaacgaccagtctcttacagacatcagccagcggcattacggcgcctgggatactgtgaagaacgctgtagtggccagctacgacatgacaaatcccagaaaaaaaagccagtctcaggagaagagagatgagcaagtgaagaagcacctgaagtctatcaagtcactaagcctggccaccatcgacaatatgctgaaggattctaccggcctgagcatcgtggattatttcaccaccctgggcgcggtgaacaatgaaaatcttcagcacgagaacctgttcgccctgatcgaaaaccggtacaacgccgccagaagcgtgctggacagcgactccccaagcgacgaactgctgagaaagaatatcacccagatcaaagacctgctcgacagcatcaaggacctgcagcggttcatcaagcccctgtgcggaagcggcgaagagcctctgaaggacgagattttctacagcgatttttctgccctgtacgaaagcctcgatgacaccatcacccctctgtataacaaggtgcggtcttacctgaccagaaagccatactctctggacaagttcaagctgaacttcgataacagccagctgctggacggctgggacgttaacaaggaaaaagactacctgagcatcctgctgagaaagaacggatactactacctggctattgccaataagaacgacaagagcgccctgtcccagatcaaccagtgtgatatgatcagcggcgactgttacgagaagctgaattacaaactgctgcctagccctttcaagatgctgcctaaggtgtttttcagcagaaagggcatcgaggtttacaaccccagccaggagatcctggacatctacaacgagaaaaagtttcagctgggcgataaattcgataaggaatctttaatcaagctgatcgacttctacaagaatgccatccctcagaacgagtcctggcagtcattcgacttcagctttgccccttcccaatcctacgagagcatcaacgaattctactccgtgatagagaaccagggctacaaaatcgactttaagaaggtgccctcttctctcatcaacctgctgatcgaccagggcctgctgtacgtgttcaagatcgccaataaggacttttctcctcacagcaagggtaggcctaatctccatacaatctactggcgcatgcttttcgacgagaacaacctgaagaacgtggtgtataagctgaacggcagagccgagatgttctacagaaaaagctctatccagaaccctgtgatccacaaggctcaccacgacatcaagaacaaatctgaatataacaagctgcacaagccaagcagcaagtttgattacgacattatcaaggacagaaggtttaccagaaatcagtacgagttccacgtgccaatcaccatgaacttcaagcctgcaggcagcggccagttcaaccgggacgtgctgaaattcatcaaagccaagggaattaagcacattatcggaatcgatagaggcgagaggcacctgctgtatctgacaatgatcgacctgaagggccgaatcgtggaacagttcagtctgaacagtgtcgccagcaaccccaacaaccctgacttcaagcaggattacaacacaatgctggccatcaaagagggcgaccgcctgaacgcccggagaaactggagcaccatcgagaacatcaaggaactgaagcagggctatctgagccagatcgtgcacctcctgagcaagatgatgatcgagaatgacgccatactggtactggaaaacctgaacagcggattcatgagaggcagacagaaggtggagaagagcgtgtacttgaaattcgagaagatgctgattgacaagctgaactacgtggtggacaagggcacggatctgaacgagccttgcggcgccctgaaagctctgcagctgacagacagctacgagaagttcaacaaattccagaagggaaatgtgcggcagtgcggcttcgtgttctacatccccgcctggaacacctccaagatcgaccctgctaccggcttcgtgaacctgtttgataccagactgtccacaatcggcgagatcaaggccttcttcagcaagttcgaccggatctcttacgacgccagcaacgacgtgttcgagttcagctttgattacaacaacttcaccagcagagcccagggcacacggaccagatggaccgtgaccacacggggcgagagaatctttacccacagatccaaagagaagaacaaccagttcgtgagcgagctggtgagccccacatctctgctgaaagacgtgctggaaaagacaggaacaaacctccagggcaatctgaaggaagccatcgccagcctgcagagcctggatgagctgaagcaactgcttcatgccttcaagctgacaatgcagatgcggaattccgtgaccggcaccgacgtggactacctcattagcccagccatcgacgctaaaggaaacaacttcgatagccgggaatgtgactctaccatgcctctgaatgctgacgccaacggcgccttcaatatcgctagaaagggcctgatgatcgtggaacaaatccagaaagtggatgacatcggcaacctgaagtacgccgtaacaaacaaagattggctgaccttcgcccagaag

SEQ ID NO: 36 - DNA, 36 bp, synthetic construct
  source 1..36: mol_type = other DNA
atctacaatagtagaaattttggtctatagttagac

SEQ ID NO: 37 - DNA, 36 bp, synthetic construct; identical to SEQ ID NO: 36
  source 1..36: mol_type = other DNA

SEQ ID NO: 38 - DNA, 36 bp, synthetic construct
  source 1..36: mol_type = other DNA
gtctatactaagaccaaaatttctactattgtagat

SEQ ID NO: 39 - DNA, 36 bp, synthetic construct; identical to SEQ ID NO: 38
  source 1..36: mol_type = other DNA

SEQ ID NO: 40 - RNA, 36 nt, synthetic construct
  source 1..36: mol_type = other RNA
gtctaactatagaccaaaatttctactattgtagat

SEQ ID NO: 41 - RNA, 36 nt, synthetic construct
  source 1..36: mol_type = other RNA
gtctatactaagaccaaaatttctactattgtagat

SEQ ID NO: 42 - protein, 1297 aa, synthetic construct
LCSIFAHMAINFAREIKKYYLCIINIKKILNMXXLKXFXNXYXVQKTLRFKLEPXGKTEEFIERAQXLENDERRAXEYXKVKXXIDXYHRXFIEXALSXPLLKVXSXGXXDSLEDFXDCYNNDXSEKRSDNLEKIQXKLRXQIVKGFSKXPAFXXIXKKELIXXDLXXFLXDXNEXXIVSHFXXFTTYFTGFHQNRMNMYXXEAKSTSIXFRLINQNLVKXVDNSXILEKVXPXLGXDIXXXLBXDFEPFLNVXXALDLFKXXNYNEVJTQXQIELYNAIIGGRVDXXXKVEIKGLNQYINEXNQTHXKXXRJPKLKPLFKQILSEXXGVSFRXEQFXXAXQVQXAIXEXYXXLXXXVFXKLKXXJXXLXXFBLBGXXXANDXXLTDIXQRXYGAWDXXXNAXVAXXDXXXPRKKXQSQEKRDXQVKKXLKSXKSJSLXXIDXXLXDXTXXSIVDYFTXLGAXBNEXXQXENLFALIZNRYXXXXXVLDXXXPSDELLRKNIXXIKDLLDXIKDLQRFIKPLCGXGEEXXKDEXFYSDFSXLYEXLDDXITPLYNKVRSYLTXKPYXLDKFKLNFXXXXLLXXWXXNXZXXXXXIXXXXBXXYYLAIXBKNBXSXLXXXXXXIXXXDXIXXXXXXXXGDXXXXXXNXXXJXXXXXXXXXXXXXXXXXXXXXXXXXXXXXXYXPXXEIXXIXXEKXFXLXXXXXXXEXLXKXIDFYKXXXXXXEXXXXFDFXFXXXXXYXXXXZFXXXIXXQXYXJXXXXXXXXXJXXLXDXGXXXXFXIXNKDFSPXSKGRPNLHTIYWXMLFDXNNLKBVXYKLNGXAEMFXRXSSIXNPVIHXAXXXIXNKSXYNKXHKXXSKFDYDIIKDRRFTRNQYEFHVPITMNFKXAGSXXFNXXVLXFIKXKGIKHIIGIDRGERHLLYLTMIBXKGXIVEQFSLNXVASNPNNPXXKQDYNXXLXIKEGDRLXARRNWSTIENIKELKXGYLSQIVHLLSKMMIENDAILVLENLNXGFMRGRQKVEKSVYLKFEKMLIDKLNYVVDKXXXXNEPXGALKALQLTDXYXXFNKXQKGNVRQCGFVFYIPAWNTSKXDPXTGXVNLFDTRLSTIGEIKXFFSKFDRIXYBXXNDXFEFXFDYNNFTXRAZGTRTXWTXXXXGERIFTHRSKEXNNQFVSEXVXPTXJXKDVXXXXGXXJXGNLKEXIASJZSLXXLKQLLHAFKLXXQMRNSXTGTXVDXLJSPAIDAKGXNFDSRXXXSTXPXNADANGAXNIARKGLMIVEQIQXXDDIXNJKYXVXNXDWLXFAQX

SEQ ID NO: 43 - DNA, 3789 bp, synthetic construct
  source 1..3789: mol_type = other DNA
atgaagaatttaaaggaatttcacaacctgtatccagtacagaaaactcttcgttttaagttggagcctatcggaaaaacagaggagttcattgaacgtgcacaaatcttagagaatgatgagcgccgcgctgatgaatatctcaaggttaaggagtatatagaccgatatcatcgtgagttcattgagaacgctttaagtcaacctctacttaaggtggaatcggaagggaagcaggattctcttgaagattttgccgactgctacaacaatgacaatagcgaaaaacgcagtgataatcttgaaaaaattcaagacaaacttagaacgcaaattgtcaaaggattcagtaaattacccgcttttgcacgaatagctaaaaaggagcttattaaggaggatttacccaagtttctaaaagacaaaaacgaaaaagaaattgtttcgcattttgatgagttcacaacctatttcactggtttccatcagaatcgcatgaacatgtatactgccgaagcaaagtcgacttctatagcttttaggcttattaaccagaaccttgtaaaatttgttgacaatagcaatatccttgaaaaggttgttcctgtacttggaaaagacattattgcacaacttgataaagattttgaaccgttcctcaacgttgattctgctcttgatttgtttaaaattgacaattacaatgaagtgcttacacaattgcaaattgagctatacaacgcgattataggtggaagagtggatgaggggaacaaagttgagattaaaggattgaaccagtatatcaacgagtttaatcaaacgcacgaaaagtcactaaggattccaaaactcaaaccattgtttaaacaaatattgagtgaaaatgtgggtgtttcatttagaatggagcaattcaccgatgccagccaagtacaaaccgccataaaagaagaatacatcaagttggagtctagtgtttttgacaagctaaaagaaatgattaagagtttgccaacattcaacttaaatggtatttatctagccaatgatttggggcttaccgacatatgccaacgttattatggtgcttgggacaaattgaataatgcccttgtcgctgaatttgacgctgttgtgcctcgcaagaaaacacagtcacaggaaaaacgtgacaaccaagtgaagaagtaccttaaaagtgtcaagagcatatctttaggcaaaatcgacagcctcttggctgacgtaacagagaagtcaattgttgactatttcaccaacctgggtgctatcgacaatgaaaccacgcagcgtgagaacttgtttgcactcattcaaaaccgatatatttctttaaaggaagttcttgattgccctacaccgtccgacgaactcttgcgcaagaatattgaaggcatcaaggatttacttgatgctatcaaagacttacaacgatttatcaaaccgctgtgcggttgcggtgaggaacttgataaagatgagatgttctatagcgatttttctcctctttatgaaacgcttgacgacatcattactcctctatacaacaaggtgagaagctatctgacaaagaagccttacaaacttgacaagttcaagctgaatttcgaaactccgactttattgcaaagttggccaaattatcaagcatattcttgtgctatttttaaagaagatgataatcactattatctagcaattcttgataagaataatcgaagctgtcttaatactatagtaccaccaatatcaaaaaacgatatcattggattagttaagcacttacaaggtggtgacatgggaaagaacgttcagaacttaatgagaatagatggcaaaacaagaaaagtcaatggtcgtaaagagacttctggcccaaatgcaggacaaaacatacgtcttgaggaatcaaaaaagacatatttgccacatgaaattaatgaaataagaattgaaaaatctttttcattaaatagcccaaattataggagagaatgcctcaacaagtatattgacttttataaaccacttgtagaagagtattattctgaatttgattttgaattcaaagaagcatctgaatatagagatttctctcagtttaccaatcacattaatcagcagtcttaccaattaaagattattcctttttcgaaaaagtatctaaaaactcttgttgataatggtcaagtatttctttttagaatactaaacaaagacttctctccttattctaaaggacgtcctaatttgcacacgatttactggaagatgctctttgatgacaacaacctcaaggatgtaatctacaagcttaacggcaaagccgagatgtttttccgcaggagctctatcacgaatccagtaatccatgctgccaacaaggagattgccaacaagagcgcttataacaagcagcacaaagcggtgagcaagtttgattatgatataatcaaggatcgtcgcttcactcgcaaccaatatgagttccatgttccaataaccatgaacttcaaatcggcaggaagtgttcgtttcaatcaagaagtgttgtctttcatcaaagagaaaggcatcaagcatattattgggattgatagaggcgagcgtcatcttctttacttaacgatgattaacatgaaaggagagattgtggagcagttctcgcttaatgacgtggcaagcaatcctaataatcctgaatataagcaagattacaatgagttgctttcaatcaaggaaggcgaccgactgagcgcgcgtcgtaactggtcaactatcgagaacatcaaggagctgaaatcaggatatctaagccagattgttcatctcttgtcaaagatgatgatagagaatgatgccatcttggttcttgagaaccttaatacaggattcatgagaggacgtcaaaaggttgaaaaatcggtatatctcaaatttgagaaaatgcttattgacaagctcaattatgtggtagacaaaacagctgcccctaatgagcctagtggagcattgaaagcattgcaacttaccgacacttacgacaacttcaacaagtatcaaaagggcaatgtgcgccagtgcggttttgttttctacattccagcatggaacaccagcaagaccgaccctgttactggctacgtaaacctatttgacacacgactgtcaacaattggtgagattaagtctttcttcagcaaatttgaccgcatcaagtataattctaaaaatgacgcttttgaattcactttcgattacaacaactttactacaagagcagaaggcactcgcacttgctggactataagctcacaaggagagcgcatttttactcatcgcagcaaagagcagaacaatcagtttgtctctgaaacagttcacccaacacaaatctttaaggatgtgttcaaaatggctggttgtgagattaacggcaatctgaaagaaggaattgcttcaatcgaaagtctagaacctttaaagcagctattgcatgcttttaagcttgtgattcaaatgagaaacagcattactggaaccgaagttgacttcttgctatctcctgctatagatgctaaaggcacgaacttcgattctcgaaaaggcattagtactttgcccgaaaatgccgatgctaatggcgcttataacatagctcgaaaaggcttgatgattgttgagcaaatccaaaatgccgatgatattgctaatattaaatattcagtaagcaacaatgactggctcaagtttgcgcaaggataa

SEQ ID NO: 44 - DNA, 3822 bp, synthetic construct
  source 1..3822: mol_type = other DNA
ctgtgctcgatttttgcacacatggccattaattttgcgcgtgagataaaaaagtattatctttgtatcataaacatcaaaaaaatattgaacatggaatgcttaaaagatttttacaaccagtattcagtccaaaagactctaaggttcaagctggaacctgttggaaagaccgaggaattcattgaacgagcgcaggtcttagagaatgatgaacgtcgagcagccgaatacaagaaagttaaggaccttatcgacaactaccaccgttggtttattgagcaagcacttagtgcccctttattgaaggtagacagcactggcgacaacgattctttggaggattttcaagattgttacaacaacgacacgagtgagaaacgcagtgataatcttgagaaaattcaaggtaaattgaggagccaaatcgtcaagggatttagtaagcatccagcctttaaacacatcgacaagaaggaactcatcactaccgatttaaaacaattcctcaccgaccctaacgagattgatattgtttcacattttgccaatttcactacctatttcactggatttcatcaaaaccgaatgaacatgtattcggtcgaggctaaatcaacctcaatttcatttaggctgattaaccaaaatcttgtgaaatgcgttgacaacagcaagattcttgaaaaagtcaaaccagcattaggtgctgatatcttctcgaaactcaatcacgattttgagccattccttaatgtagttgatgctcttgacttgttcaaggtagagaactacaatgaagtcataacacaaccccaaattgaactctacaacgccatcattggcggacgtgttgacaatgacagcaaggttgagattaaaggacttaatcagtatataaatgagtataatcaaacccattccaagcaagagcgtttgccaaaactcaaaccccttttcaagcaaatcctgagcgagcgtgagggcgtttcatttagaatagaacagtttgaaaaagccaaccaagtccaagatgcaattaatgaagcctacaatgatctccatgctaatgtctttacaaaactcaaggaccttctcctgaatttaagcagttttgaccttgatggagtgtttgttgccaacgatcagtctttaaccgacatttcgcagcggcattatggtgcatgggatacagtcaagaatgctgtggtagcctcttacgacatgaccaacccgcgcaagaaatctcagtcgcaagaaaagcgcgacgagcaagtcaagaagcatctcaagagcattaagagtctttctttggccacaatcgacaatatgcttaaagatagcactggactgtcaattgtagattatttcacaacactgggggctgtcaacaatgagaacttgcaacacgagaatctatttgcacttattgagaaccgttacaatgcagctaggtctgttcttgacagtgattcgccaagcgatgaattgttgcgaaagaacataacccaaattaaagatttgcttgattccatcaaggacttgcagcgatttatcaaacctttgtgcggtagtggtgaagagccattgaaagacgagatattctatagcgatttctcggcactttacgaatcgctcgatgacacaataacccctctttataataaggtaaggagttacttgacaaggaaaccttattctctcgacaagtttaaactgaatttcgacaactctcaattgctggatggctgggatgtaaataaggaaaaagactatctgtcaatcctattgcgcaagaatggctactattatttagccatcgccaacaagaacgacaagagcgctttgtcgcagattaatcaatgcgatatgattagcggtgattgttacgagaagcttaactacaagctattgccatctcccttcaaaatgctacctaaagtgttcttctctcgtaagggtattgaagtctataatccgtcgcaagagatactagacatctacaatgagaaaaagtttcaactgggtgacaagtttgacaaggagtcacttatcaagcttattgatttctacaagaatgcaatacctcagaatgaaagctggcaatcatttgatttctcttttgcaccatcacagtcttatgagtcaataaatgagttttatagcgtgattgaaaaccagggctataaaatcgatttcaagaaagtgccttcaagcttaatcaacttgcttattgatcaagggcttctctatgtcttcaagattgccaataaggacttctcgccccattctaagggtagacccaaccttcacaccatctattggagaatgctctttgacgagaacaatcttaagaatgtagtttacaagttgaatggtagagccgagatgttttaccgtaaaagctctattcagaaccctgtcatccacaaggctcaccacgatataaaaaacaagagtgagtacaacaagcttcacaagccttcaagcaagtttgactacgatatcatcaaagaccgccgtttcacccgtaaccaatatgagttccatgtgcccatcactatgaatttcaaaccagcaggtagtgggcagttcaatcgtgacgtgctcaaattcattaaggctaaaggcatcaagcacatcattggcatcgaccgcggtgagcgtcatctgctttatctcaccatgattgacttgaaaggtcgcattgttgagcagttctcgcttaatagtgttgccagcaaccctaataatcccgacttcaagcaggattataacacaatgcttgctatcaaagagggcgaccgcctcaacgcacgtcgcaactggtctactatcgagaatatcaaagagctcaagcaaggctatctaagtcaaatagttcatctgctctcgaaaatgatgattgaaaatgatgctattctcgtgcttgagaacctcaactcgggatttatgcgtggtaggcaaaaagtagaaaaatcggtctatctcaagtttgagaaaatgcttatagacaagctcaactatgttgttgacaagggcactgacctcaatgaaccatgcggcgctctaaaagccctgcagcttaccgatagttatgaaaaattcaataagtttcaaaaaggcaatgtgcgccaatgcggtttcgtgttctacataccagcctggaacacaagcaagattgacccggcaacaggttttgtcaatctctttgacactcgtctatcaacaattggggaaatcaaagctttcttcagcaaatttgaccgcatctcttatgatgcttccaatgatgtctttgagttcagttttgattacaacaatttcacgtcaagggctcaaggtactcgcacgcgatggactgttaccacccgaggtgaacgcatctttactcatcgaagcaaggagaagaacaatcagtttgtttctgaattagtttcgccaaccagcctgctcaaggacgttttggaaaagactggcaccaacttgcagggaaatctcaaagaggcaatagcttcattgcaaagccttgacgaactcaagcaattgcttcatgctttcaagctcactatgcaaatgcgaaacagcgtcactggaaccgatgttgactatttgatttcaccagctatagatgctaagggtaacaacttcgattctcgtgagtgtgactccaccatgcctctaaatgccgacgccaatggggctttcaacattgctcggaaaggacttatgattgttgagcaaatccagaaggtagacgatattggcaatttaaaatatgctgtcaccaacaaggactggctaacttttgctcaaaaatga

SEQ ID NO: 45 - protein, 1226 aa, synthetic construct
MSNLYRNLHNFYSVQKTLRFELIPQGKTKENMEKEGILKADEHRAEIYSKVKKYCDEYHKLFIDKCLKNIRLNELNKYYELYSVVKKDEKQKEEFIKIQEKLRKQISESFRNNNEYKGLFQKDIINIYLITMYKDDKEKIKDISEFNKFTTYFSGYNKNRENMYSEEEKPTGIAYRLINENLPTFIENFKIYNKVIKFMPEIINKIHTDLMEYIQVEDIDEIFDINYYNEVLTQKGIECYNIIISGKSKSNGEKIKGLNEYINEFNQKHNEKIPKLQELYKQILSDTDTASFKFDTIESDEELLNNIESYYTKLLPVFNKINQLFAKFNKYNLDLIFINNDGTLNTISNEIYKDWSYIRNRIGERYDIEYTGKLKKDTEQYSKQKQEYMKKQKQYSLKFLNDSLRDNYLIEYISNYIEQSKIMEKMKTDFTEVQKIESRGDTKQLIKDENSIVKIKNLLDDIKFLQEFAKILVLKDRTIEKDAEFYSELMPYYNELKDIIPLYNKTRNYLTQKPYSTEKIKLNFECPTLLNGWDLNKEEANLGVILLKNEKYYLGIINPYCKKIFKIQEKDSNSENNYKKMEYKLLPGPNKMLPKVFFSKSKIDEFMPSDELLEKYNKGCHKKGKDFDINFCHELIDFYKTSLNKHKDWKKFDFKFKSTSEYNDISEFYKDVEEQGYKIEYSEYSEKYINELVDRGELYLFQIYNKDFSEYSKGRPNLHTMYWKAVFDIENIKNPVYKLNGEAEIFYRKKSLERKITHSANEPVANKNENTIKSGKPTSLFKYDLIKDKRYTVDKFQFHVPITMNFKSEKMFNINQVVNKYLKYNDDINVIGIDRGERNLLYVCVIDKNEKIVYQKSLNEIVNEYKSIKYSTNYHTLLNKKEKEREIAREDWKNIENIKELKEGYMSQVIHILVELMRKYNAIIVIEDLNKGFKNSRIKVEKQVYQKFEKMFIDKLNYLVFKDEPKESEGGVLNAYQLTNKFETFNKIGKQSGVLYYIPAWCTSKIDPTTGFINRFYIKYENLDKSKEFINKIDDISYNSSEKLFEFDIDYSKFTDRLNETRNKWTLYTNGERIYTYRNDKGEWIDKKIQLTNEFNKLFEKYSINLDNIKNEILEKANIEFFKGNNETLGFIQLFKLMVQMRNSLTGKEEDNLISPVKNSNGKFFNTNEQIEGLPKDADANGAYNIARKGLMLIEQMRNTEDDKLNKIKYNITEKEWLDYVQNRGM

SEQ ID NO: 46 - protein, 1241 aa, synthetic construct
MLYDNIIVNEIYGRYDMSNLYNSLHNFYPVQKTLKFELIPQGKTKENMEREGILKTDQHRAAVYKKVKKYCDEYHKVFIDRCLKDLQLKELERYYELYSLTNKDDEKKEELKKIQEKLRKQISDSFKNNSEFKGLFQKDIINSYLMAMYKEDEEKIKEISEFNKFTTYFSGYNKNRENMYSEEEKSSAISYRIINENLPTFIDNLRIYNKIIKLIPEIMEKIYTDLIEYIQVENINKVFNINHYNKVLTQRGIECYNIIISGKVQNEGEKIKGINEYINEFNQTHNEKIPKMQELYKQILSDTDTASFKYDVIECDRDLLDNIESYGRRILQILDGTGSLLEKINDYNLDLIFINNDGILSKVSNDIYSDWSYIRNRISDIYDEKYNGKLSKNTEKYFKQKQDYIKKQKCYSLKFLKQSLEDDRVIKYISSYIRETSLVERIRSSFIEVQNIKERSNEKNLIKDENSITKIKTLLDNIKLLQEFVKMLIPKDRTEEKEAKFYSELMTYYDELENVIPLYNKTRNYLTQKPYSTQKIKLNFECPTLLNGWDSNKEQANLGVILLKDEKYYLGIINPYCRKIFETEEQDINSENNYKKMEYKQLPGSKMLAKVFFSKSRKDEFNPSDELLKKYEKGLHKKGPNFDIQFCRELIDFYKNSLNKHEEWKKFDFKFRDTLEYNNIGEFYKEFEEQGYKIEYSEYSESYINELVNRGELYLFQIYNKDFSEYSKGNPNLHTMYWKAVFDLQNIKDPIYKLNGNAEIFYRQRSLEKRITHPANTPVNNKSEETIKAGKPQSIFKYDLIKDKRYTMDKFQFNVPITMNFKSEKLLNINGIVNKYLKYNDDIYVIGIDRGERNLLYVCVIDKNEKIVYQKSLNEIVNEYRNIKYSIDYHLLLDKKEKEREAAREDWKNIENIKELKEGYMSQVIHVLIELMRKYNAIIVIEDLNKGFKNSRIKIEKQVYQKFEKMFIEKLNYLVFKNEVEKAEGGILNAYQLTNKFESFNKIGKQSGILYYIPAWCTSKIDPVTGFINRFYIKYENLDKSKEFVNKIEDIRYNSREDLFEFDIDYGKFTDKLNDTRNKWTLCSNGERIYTHKNNTGEWIDNRIQLTKEFKKLFEEYDVDLNNIKPEILQKSNIEFFKGNNENLGFMQLFKLMVQMRNSLTGKDEDNLISPVKNRNGKFFDTKDQIEGLPKDADANGAYNIARKGLMLVKQMKDTEDENLNKIKYNITEKEWLNYLQNRGM

SEQ ID NO: 47 - DNA, 3681 bp, synthetic construct
  source 1..3681: mol_type = other DNA
atgtctaacctgtacaggaacctacataatttctactctgtacagaaaaccctcagatttgaattgattccccagggaaaaaccaaggaaaacatggaaaaagaaggcatactgaaggccgacgagcatcgggccgaaatctatagcaaggttaagaaatactgtgacgagtatcacaaactgttcatagataaatgccttaagaacattcggctgaatgagctcaataagtattacgagttgtactccgtggtaaaaaaagatgagaagcagaaagaagagttcattaaaatccaggaaaagctgagaaagcaaatttcagagagtttcagaaacaataacgagtataagggccttttccagaaggacatcattaacatctatctcattaccatgtacaaggacgacaaagagaagatcaaggatatcagcgagtttaacaaatttaccacttacttcagtggctacaacaaaaatagggagaatatgtattcggaggaggagaaacctaccggaatagcttatcgtctgattaacgagaacttgcccacctttatcgagaacttcaagatctataacaaggtgatcaagtttatgcctgagatcatcaacaaaatccatacagacctgatggaatatatccaggtcgaagacattgatgagatcttcgacatcaactactataacgaagtgttaacacagaaaggcatagagtgctacaatatcattatttctggcaagtcaaagtccaatggagaaaagatcaaagggctgaatgagtatatcaacgaatttaaccagaagcacaatgaaaaaatcccaaagttacaggaactgtacaaacagatacttagcgacacagatacagctagcttcaagtttgatactatagaatctgacgaggaactcctgaataatatcgaaagctactataccaaactgctccctgtttttaacaaaatcaatcagctgttcgcaaaatttaacaagtataacctggacctcattttcattaacaatgatggaactctcaacacaattagcaacgagatatacaaagattggagctacattcggaatcgaattggtgaacgatacgatattgagtataccgggaaattaaagaaagatacggagcaatacagcaaacaaaaacaggagtacatgaagaagcaaaaacagtacagccttaagttcctgaatgacagccttcgagataactacttgatagaatacatctccaactacattgagcagtctaagataatggaaaagatgaaaaccgacttcaccgaagtgcagaagattgaaagcaggggagacaccaaacagttgataaaagacgaaaattccatcgtgaaaatcaaaaatctccttgacgacattaagtttctacaggaatttgccaagatcctagtgcttaaagacagaacaatcgagaaggatgcggaattttacagtgaattaatgccgtactacaatgagctgaaagacatcataccactgtataataagacccgcaactacctcactcagaaaccttactccactgagaaaattaaactgaacttcgagtgtcctacactcctcaatgggtgggatcttaataaagaggaggctaacctgggagttattctcctgaagaacgagaagtattatttaggcatcataaacccctactgtaagaagattttcaagatccaagaaaaggatagtaactcagagaacaactataagaagatggaatacaagctcttgcccggtcccaataaaatgctgccgaaagtctttttttccaagtccaagatagatgaattcatgccatctgacgagttgttagagaaatataacaagggttgccacaagaaaggaaaagatttcgacattaacttctgccatgaactgatcgatttttataaaacctccctcaataagcacaaggattggaaaaagttcgactttaagttcaagtccacttcggaatacaacgacatctctgagttttacaaagatgttgaagaacaggggtacaaaattgagtattcagagtacagtgagaaatacattaacgaactggtggatcgcggggaactttatctgtttcaaatctacaacaaggactttagtgagtattcgaaagggcgtccaaatctgcacaccatgtactggaaagcagtgttcgatatcgagaacatcaaaaatccggtgtataagctgaacggggaagcagaaatcttctatagaaagaaatctctggagcgtaaaattacacacagtgctaatgagccagtggccaataagaacgaaaatacaatcaagtctggaaaacctacgagtcttttcaagtacgacctcataaaggataagcgctatacggtggataagtttcaatttcatgtcccaataaccatgaatttcaagtccgagaaaatgtttaacatcaatcaggtagtcaacaagtacctcaaatataacgatgacataaacgtgatcggcatcgaccgcggggagaggaatttactgtatgtctgtgtcatcgataagaatgagaagatcgtttaccaaaagtctctaaatgagattgtcaacgagtacaagtctatcaagtattcaaccaactatcacacactgctgaacaaaaaagagaaagagagagagattgcacgggaagactggaagaacattgaaaacattaaggagttgaaggaaggatatatgagccaggtgattcacatcttggtggaactgatgcggaaatacaatgccataattgtaatcgaagacctgaataaaggttttaagaattcccggatcaaggtggagaagcaggtgtatcagaagtttgagaagatgttcattgacaagctcaactatttggtgtttaaagacgaacccaaagagtccgaaggcggcgtcctaaatgcatatcagctgacaaataagttcgaaacgttcaacaaaatcggcaagcaatcaggtgtgctctactatatccccgcctggtgcacaagcaagattgatccaactacaggcttcattaacaggttctacataaagtacgagaatctagataagagcaaggagttcatcaataagatcgacgacatttcatacaattcctccgaaaaacttttcgagttcgacatcgattactcaaaatttactgaccggctaaacgagacgaggaataagtggactctttacactaatggtgagcgcatttatacttacagaaatgacaaaggagagtggattgataagaagattcagctgacaaatgagtttaacaagctgttcgagaaatatagcatcaacctggataacatcaaaaatgagattttggagaaggccaatatcgaatttttcaagggtaacaacgaaaccctggggtttattcagttgtttaaactgatggtccaaatgaggaattctctgactggaaaggaggaggataatcttattagtcccgttaagaactcaaacggcaaattcttcaataccaatgaacagatagagggcttacctaaagatgctgacgccaatggcgcttataatatcgcgcgcaaggggctcatgctgattgagcaaatgaggaatacggaagacgataagctgaacaagataaagtacaacatcactgagaaagaatggctcgactacgttcagaatcgagggatgtga

SEQ ID NO: 48 - DNA, 3726 bp, synthetic construct
  source 1..3726: mol_type = other DNA
atgctgtacgacaacatcattgtgaacgagatctacggcaggtacgacatgagcaatctgtacaacagcctgcacaacttctatcccgtccagaagactcttaagttcgaactgatacctcaggggaagaccaaggagaacatggagagagagggcattctgaagaccgaccagcaccgggccgcagtgtataagaaggtgaagaaatactgtgacgaataccacaaagtgttcatcgatagatgcctgaaagaccttcagctgaaagagttggagcgctattacgagctgtacagcctgaccaataaggacgacgagaagaaagaggagctgaagaagattcaggaaaaactgcgcaaacagatcagcgatagctttaagaacaatagtgagttcaagggcctgttccagaaggatatcatcaattcttatctgatggccatgtacaaggaggacgaggaaaagatcaaggagatttccgagtttaacaagttcaccacttatttttctgggtacaataaaaatcgcgagaacatgtattcagaagaggagaagtctagcgctatcagctataggatcatcaacgagaacctgcccacctttatcgacaacctgcggatctataacaaaattatcaaactgattcccgagatcatggagaagatctataccgacctgatcgagtacatccaggtggagaacatcaataaagtgttcaatattaaccactacaataaggtgctgacccagcgggggatcgaatgctacaatatcatcatcagtggaaaggtgcagaacgagggcgagaagatcaagggcatcaacgaatacattaacgaattcaaccagacccataatgaaaagatcccaaaaatgcaggaactgtacaaacagatcctgagtgatacagacaccgcttctttcaagtacgacgtgatcgagtgtgatagggacctgctggacaacatcgagtcgtatggaaggaggatcctgcagatcctggacggaacaggcagcctgctcgagaagatcaatgactataacctcgacctgatcttcattaataatgatggcatcctgtccaaagttagcaacgatatttattccgattggagctacatcagaaatcgcatttccgacatctacgatgagaagtataacggtaagctgagcaaaaacaccgaaaaatacttcaaacagaagcaggattacatcaagaaacagaagtgctacagcctgaaatttctaaagcagagcctggaggatgatagggtgatcaaatacatctcttcctacatcagggagacctcactggtggagaggatcagaagcagctttatcgaggtgcagaacattaaagagagatcaaacgaaaagaatctgatcaaggacgagaatagcatcacaaagatcaagaccctgctggacaacatcaagctgctgcaggagttcgtgaagatgctgatcccaaaggacagaaccgaggagaaggaggccaaattctactctgagctgatgacatactacgatgagctggagaacgtgatcccactgtacaataagaccagaaattacctgacacagaagccctactctactcagaagatcaagctgaactttgagtgcccaacactgctgaatggctgggacagcaataaagaacaggctaacctgggcgttatcctgctcaaggacgagaagtactatctgggcatcatcaacccatactgccggaagatcttcgagacagaggaacaggacatcaactccgagaacaactacaagaagatggaatataagcagctgcccggctcaaagatgctggccaaggtgttcttctccaagagccggaaagacgagtttaaccccagtgacgagctgctgaagaagtacgaaaagggcctccacaaaaaggggcccaacttcgatattcagttttgtagggagctgatcgatttttacaagaatagcctgaataagcacgaagaatggaagaagtttgactttaagtttcgcgacaccctggagtataacaacatcggggagttttacaaggagttcgaggagcagggctataagattgaatactctgaatatagcgaatcctacattaacgaactggtgaacaggggcgagctgtatctgttccagatctacaataaggatttttctgaatattccaagggcaaccccaatctccacaccatgtactggaaggctgtgtttgacctgcagaacatcaaggatcccatctataaactgaacggcaacgccgaaatcttttataggcagcggtcactggaaaaaagaatcacccaccccgctaacaccccagtgaacaacaaaagcgaggagaccatcaaagccggaaagccccagtctatctttaagtatgacctcatcaaggataagcggtacaccatggacaagttccagttcaatgtgcccatcaccatgaatttcaagtccgagaagctgctgaacatcaacggcatcgtgaataagtatctgaaatacaacgacgacatctacgtgattggaatcgatagaggcgagcgcaatctgctgtatgtgtgtgttatcgacaagaacgagaaaatcgtctaccagaagagcctgaacgagatcgtgaacgaatacagaaatattaagtactccatcgactaccatctgctgctggacaagaaggaaaaggaaagggaggctgcccgggaagactggaaaaatatcgagaatatcaaggaactgaaggaaggatacatgagccaggttatccacgtgctcatcgagctgatgaggaagtacaacgctatcattgtgatcgaggacctgaataagggcttcaaaaacagccgaattaagatcgaaaaacaggtgtatcagaagttcgagaagatgtttattgaaaaactgaactacctggtgttcaagaacgaagtggaaaaggccgaaggcgggatcctgaacgcctaccagctgaccaataagtttgaatcctttaataagatcggcaagcagagcggcatcctgtactacatccctgcctggtgtaccagcaaaatcgatccagtgaccggcttcatcaacagattctacattaagtatgagaatctggacaagagcaaagagttcgtgaacaagatcgaagatattagatataatagccgggaggacctgttcgaattcgacatcgattatggcaagtttaccgacaagcttaacgacacccggaacaaatggacactgtgcagtaatggagagagaatctacacccataagaacaatacaggagagtggatcgacaacagaatccagctgaccaaagagtttaaaaagctgttcgaggagtacgacgtggacctgaacaatattaaacctgagatcctgcagaagtctaacatcgagttcttcaagggcaacaacgagaacctgggcttcatgcaactgttcaagctgatggtgcagatgcgaaatagcctcaccggcaaggacgaggataatctgattagccccgtgaagaataggaacggcaagttctttgacaccaaagaccagatcgagggactgcccaaggacgccgacgccaacggcgcctacaatattgcccggaagggcctgatgctggtgaagcagatgaaggacacagaggacgagaatctgaataaaattaaatacaacatcaccgagaaagagtggctgaactatctgcagaatagaggcatgtga

SEQ ID NO: 49 - DNA, 36 bp, synthetic construct
  source 1..36: mol_type = other DNA
gtttaataccttatataaatttctactattgtagat

SEQ ID NO: 50 - DNA, 35 bp, synthetic construct
  source 1..35: mol_type = other DNA
tttaataccttatataaatttctactattgtagat

SEQ ID NO: 51 - DNA, 36 bp, synthetic construct; identical to SEQ ID NO: 49
  source 1..36: mol_type = other DNA

SEQ ID NO: 52 - DNA, 35 bp, synthetic construct; identical to SEQ ID NO: 50
  source 1..35: mol_type = other DNA

SEQ ID NO: 53 - RNA, 36 nt, synthetic construct
  source 1..36: mol_type = other RNA
gtttaataccttatataaatttctactattgtagat

SEQ ID NO: 54 - RNA, 36 nt, synthetic construct; identical to SEQ ID NO: 53
  source 1..36: mol_type = other RNA

SEQ ID NO: 55-56 - skipped (2 entries)

SEQ ID NO: 57 - protein, 1250 aa, synthetic construct
MKEQFINRYSLSKTLRFSLIPVGETENNFNKNLLLKKDKQRAENYEKVKGYIDRFHKEYIESVLSKARIEKVNEYANLYWKSNKDDSDIKAMESLENDMRKQISKQLKSNARYKRLFGKELICEDLPSFLTDKDERETVECFRSFTTYFKGFNTNRENMYSSDEKSTAIAYRCINDNLPRFLDNVKSFQKVFDNLSDETITKLNTDLYNIFGRNIEDIFSVDYFEFVLAQSGIEIYNSMIGGYTCSDKTKIQGLNEYINLYNQQISKNEKSKRLPLIKPLYKQILSEKDSVSFIPEKFNSDNEVLLAIDDYYNNHIGDFDLLTELLQSLNTYNANGIFVKSGVAITDISNGAFNSWNVLRSAWNEKYEALHPVTSKTKIDKYIEKRDKVYKAIKSFSLFELQSLGNENGNEITDWYISSINESNRKIKEAYLQAQELLKSDYEKSYNKRLYKNEKATESVKNLLDTIKEFQKLIKPLNGTSKEENKDELFYGKFTSLYDSVADIDRLYDKVRNYITQKPYSKDKIKLNFDNPTFLNGWALGNEFANSAQLLRDGDNYYLAIMDKELKNNIPKKYNSPTNEEDMLQKIIYQQAANPANDIPNLLVIDGVTVKKNGRKEKTGIHAGENIILENLRNTYLPDNINRIRKEKTFSTSSENFSKDDLCEYIQYYICRVQEYYSSYNFTFKNASEYKNFPEFSDDVNSQAYQISYDNISKKQIMELVDNGYIYLFQIYNKDFSKYSKGTPNLHTLYFKMLFDERNLSNVVYKLNGEAEMFYREASIGDKEKITHYANQPIENKNPDNKKKESVFEYDIVKDKRFTKRQFSLHVPITINFKAHGQEFLNYDVRKAVKYKDDNYVIGIDRGERNLIYISVIDSNGKIVEQMSLNEIISDNGHKVDYQKLLDTKEKERDKARKNWTSVENIKELKEGYISQVVHKICELVVKYDAVIAMEDLNFGFKRGRFPVEKQVYQKFENMLISKLNLLIDKKADPTENGGLLRAYQLTNKFDGVNKAKQNGIIFYVPAWDTSKIDPATGFVNLLKPKCNTSMPEAKKLFETIDDIKYNTNTDMFEFYIDYSKFPRCNSDFKKSWTVCTNSSRILTFPNKEKNNMWDNKQIVLTDEFKSLFNEFGIDYKGNLKSSILSISNADFYRRLIKLLSLTLQMRNSITGSTLPKDDYLISPVANKNGEFYDSRNYKGTNAALPCDADANGAYNIARKALWAINVLKDTPDDMLNKAKLSITNAEWLEYTQK

SEQ ID NO: 58 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 59 - protein, 1227 aa, synthetic construct
MKEQFINCYPLSKTLQFSLIPVGKTDDNFNKKLLLERDKQRAENYEKVKGYIDRFHKEYIESVLVNARVEKIDEYADLYWKSNKDDSDAKAMESLENDMRKQISKQLKSNARYKRLFGKELICEDLPSFLTDKEERETVECFRSFTTYFKGLNTNRENMYSSDEKSTAISYRCINDNLPRFLDNVKSFQKVFDNLSDETITKLNTDLYNTFGRNIEDVFSVDYFEFVLAQSGIDIYNSMIGGYTCSDGTKIQGLNECINLYNKQDAKNEKSKRLPLMKPLYKQILSEKDSVSFIPEKFNSDNEVLLSIEDYYSSHIGDLDLLTELLQSLNTYNANGIFVKSGAAVSDISNGAFNSWNVLRLAWNEKYEALHPVTSKTNLDNYIEKRDKIYKAIKSFSLFELQSLGNENGNEITDWYISSSKECNSKIKEAYLQARELLKSDYEKSYNKRLSKNGKATQSIKNILDAIKDFHHLVKSLNCTGKEENKDELFYGKLTSYYDSITDIDRLYDKVRNYITQKPYSKDKIKLNFDNPQLLGGWDKNKESDYRTVLLRKDDFYYLAVMDKLHSKAFVDAPNITSKDEDYYEKMEYKLLPGPNKMLPKVFFAAKNIDTFQPSDRILDIRKRESFKKGATFNKSECHEFIDYFKNSIEKHYDWSQFGFEFTPTENYNDISEFYREISDQGYSVSFNKISKSYVDELVDNGYIYLFQIYNKDFSKYSKGTPNLHTLYFKMLFDERNLSNVVYKLNGEAEMFYREASINDKEKITHQANQPIENKNPDNEKKESTFEYDIIKDKRFTKRQFSLHVPITINFKAHGQEFLNYDVRKAVKYKDDNYVIGIDRGERNLIYISVIDSNGKIVEQMSLNEIISDNGHRVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKAKQNGIIFYVPAWDTSKIDPVTGFVNLLKPKYTSVSEAKKLFETIDDIKYNANTDMFEFCIDYGKFPRCNSDYKNTWTVCTNSSRILTCRNKEKNNMWDNKQIVLTDEFKSLFGEFGIDYKGNLKTSILSISNADFYRRLIKLLSLTLQMRNSITGSTLPEDDYLISPVANDRGEFYDSRNYKGMNAALPCDADANGAYNIARKALWAINVLKSTPDDMLNKANLSITNAEWLEYTQK

SEQ ID NO: 60 - DNA, 3753 bp, synthetic construct
  source 1..3753: mol_type = other DNA
atgaaagagcaattcatcaaccgctactccctgtcgaaaaccctgcgcttttctttgataccagtgggggagacggagaacaatttcaataagaacttgctgctgaagaaggacaagcaacgggcggaaaactacgagaaggtgaagggatacattgaccggtttcacaaagagtatatagaatccgtgctgtcaaaggccaggatcgagaaggtgaacgagtatgccaatttgtattggaagagtaacaaagacgatagcgatatcaaggcaatggagagtttggagaacgacatgaggaaacaaatctctaagcagctgaaatccaatgcccgctataagcgactgttcgggaaagaattaatatgtgaggatctgccaagttttctgacagacaaggatgagagagaaacagtcgaatgttttcgctcattcaccacctactttaaaggatttaacaccaatagggagaatatgtattcctctgatgagaaaagtaccgccatcgcttaccgttgcatcaatgataatctaccacggttccttgacaatgtaaagagtttccagaaagtcttcgataacctctctgatgagactattactaaacttaacaccgacctgtataacatttttggacgcaatatagaggacattttttccgtggactatttcgaattcgtgctcgctcagagcggtatcgaaatttataatagcatgattggaggctacacttgttcagacaaaactaaaatccagggcctcaacgagtacatcaacttatacaatcaacagatcagcaagaatgagaagtcaaaaaggctgccccttattaaacctctgtacaagcagattctttctgaaaaggattccgttagcttcattcccgagaaatttaattcggacaacgaggtactcctggccatcgacgattattataataatcatatcggcgacttcgacctgctgacggaactcctacagagcctcaacacgtacaacgccaatgggatatttgtgaagtctggcgtggctatcactgatatctctaatggtgcctttaattcatggaacgtcctgcggtcagcttggaatgagaaatatgaggcgcttcacccagtgactagcaagaccaaaatcgacaaatacattgagaagagagacaaagtctataaagccatcaaaagctttagcctgtttgaactgcagtccctcgggaatgaaaatggcaatgagataactgactggtatatcagtagcattaacgagtccaacaggaaaatcaaggaagcgtatttgcaggcccaggaactcctgaagtctgactacgaaaaaagctacaataagaggctttacaagaacgaaaaggcaactgagagcgtcaaaaaccttttggataccataaaagagttccagaagctgattaagccattgaatggcacatcaaaggaagagaacaaagatgagctgttttatggtaaattcacgtccctatacgactccgtggctgacatagaccggctgtacgacaaggttcgaaattacatcacccagaagccctactctaaggataagatcaagctgaactttgacaaccctaccttcctgaatggctgggcactggggaacgagttcgctaatagcgctcaactgttaagagacggtgacaactactacctcgcaattatggacaaggagctgaaaaataacattccgaagaagtacaacagcccaacaaacgaggaggatatgttacagaaaatcatttaccagcaagccgccaaccctgcaaacgatattcccaatctactcgtaatagatggtgtgaccgtgaaaaagaacggccgcaaggagaagaccggcattcatgcaggcgaaaatatcattctggagaacttgaggaacacttatcttcccgataatattaaccggatacgtaaggagaaaacattttcaacgagcagtgaaaactttagcaaagacgatctgtgcgagtacatccaatactatatttgtagagttcaggagtactattcctcctataacttcacttttaagaacgcctccgagtataaaaattttcccgagtttagtgatgacgtgaattctcaggcataccagattagctatgacaacataagcaagaaacagattatggagcttgttgacaatggctatatttacctcttccagatctacaacaaagatttcagcaaatactccaaggggacaccaaacctgcacactctatatttcaagatgctgtttgatgagcgtaatctgtccaatgtcgtttacaagcttaacggcgaagctgaaatgttctacagagaagccagtattggggacaaagagaagattacccactacgctaatcaacctatagagaacaagaatcctgataacaagaagaaagagtctgtttttgagtatgacatcgttaaggacaagcgatttacgaagcgccaattcagccttcatgtccccataacaattaacttcaaggctcatggacaggaattcctcaactatgatgtgcgaaaagccgtcaagtacaaggatgataactatgtgatcggaattgaccgtggcgagagaaacttaatatacatcagtgttatcgactcgaacgggaaaatcgtggaacaaatgtcgctgaacgaaatcattagtgacaatggacacaaggtggattatcagaagctcttggatacaaaggaaaaggaaagggataaggctcgcaaaaattggacatctgtcgaaaacatcaaagaactaaaggaaggttacatctctcaggtggtgcacaagatctgcgaattagtcgttaaatacgatgctgtaattgcaatggaagacctgaattttgggtttaaacggggaagatttcctgtggaaaaacaggtgtatcagaaattcgagaacatgctcatctccaaactgaaccttctcatcgacaagaaagcggatcccactgagaatggaggattactccgggcctaccagctgacaaataagtttgacggcgtcaataaggctaagcagaacggaatcatcttctatgtacccgcctgggatacatcaaagattgacccggccacaggattcgtgaatctgttgaaaccgaaatgcaacacatctatgcctgaagccaagaagctcttcgaaacaattgacgacattaagtacaacactaataccgacatgttcgaattttacattgattactccaagttccctcgctgcaattcagatttcaaaaaatcatggaccgtatgcacaaattctagtagaatcctgaccttccctaataaggagaaaaacaacatgtgggacaataaacagatcgtgctgacagatgaattcaagtccttattcaacgagtttgggatcgattataaaggcaacctgaagtcaagcatcctcagtatttcaaatgctgatttctacaggaggctcatcaaactcctgtctttgactcttcagatgcgaaattctataaccgggtcgactctgccaaaggacgattatctaatctcccccgtcgcaaataagaacggggagttctacgacagccggaactataaaggcaccaacgcggccttgccatgtgatgccgacgccaacggtgcttacaatatcgccagaaaggcactttgggcgataaatgtgctcaaggatacccccgacgatatgttgaataaggcaaaattgtccatcaccaacgcagaatggctggagtatacccaaaaatga

SEQ ID NO: 61 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacaccaacagaaagaatatgtactctagcgagaagaagtccacagccatcgcctatagatgcgtgaacgataatctgcctagatttctggacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagctgaacttcgacaacccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcagcctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagctgctggacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 62 - DNA, 3681 bp, synthetic construct
  source 1..3681: mol_type = other DNA
atgaaggaacagttcatcaactgctaccctctgtccaaaacactgcagttcagcctgatccccgtgggcaagaccgatgataacttcaataaaaagctgctgttagagcgggacaagcagcgggccgagaactacgagaaggtgaagggctacattgacagatttcacaaagagtacatcgaaagcgtcctggtgaacgcaagagttgaaaagatcgacgagtacgccgacctgtactggaagagcaataaggacgatagcgacgccaaggccatggagagcctggaaaacgacatgcggaagcagatctctaagcaactgaagagcaacgcccggtacaaaagactgttcggcaaagagctgatctgtgaggacctgccttccttcctgaccgacaaggaagagcgcgaaaccgtggagtgttttcggagcttcaccacctactttaagggcctgaacacgaacagagagaacatgtacagcagcgacgagaagagcaccgccataagctaccgctgcatcaacgacaaccttcctagattcctggataatgtgaagtctttccagaaagtgttcgacaatctgtccgacgaaaccatcaccaagctcaacacagatctgtataacacattcggaagaaacatcgaggacgtgttctctgtggactactttgagttcgtgctcgctcagagcggcatcgacatctacaacagcatgattggcggctacacatgcagcgacggaacaaagatccagggcctgaacgaatgcatcaacctgtacaacaagcaagatgccaagaacgagaaatctaagagactgcctctgatgaagcctctgtacaagcagatcctcagcgagaaggattctgtctccttcatccctgagaagtttaacagcgacaacgaggtcctgctgagcatcgaggactactactctagccacatcggcgacctggacctgctaaccgagctgctgcaaagcctgaacacctataacgctaacggaatcttcgtgaaaagcggcgccgctgtgagtgatatcagcaacggagccttcaacagctggaacgtcctgcggctggcctggaacgaaaaatacgaggccctgcaccccgtgaccagcaagaccaatctggacaactacatcgagaagagagataagatctacaaagccatcaagagcttcagcctgtttgagctgcagagcctgggcaacgagaatggaaatgagatcaccgactggtacatcagctctagcaaggagtgtaattccaaaatcaaggaggcctacctgcaggccagagaactgttgaaaagcgattacgagaagtcctacaacaagagactgtcgaagaacggcaaggccacccagtccatcaaaaatatcctggatgccatcaaagacttccaccacctggtgaagtcactgaactgtacaggcaaggaggaaaacaaggatgagctgttctacggcaagctgaccagctattacgatagcatcaccgacatcgatagactgtacgacaaggtgcggaactacatcactcagaaaccttacagcaaggacaagatcaagctgaatttcgacaacccccagctgctcggcggatgggacaagaacaaggaaagcgattacagaaccgtgctgctgcgtaaggacgacttctactacctggcggtgatggacaaacttcattcaaaagccttcgtggacgcccctaatatcacctccaaggatgaggattactacgagaaaatggaatacaagctgctgcccggccctaacaaaatgctgccaaaggtgttcttcgccgccaagaacatcgacacatttcagcctagcgatcggatcctcgacatcagaaagcgggaaagcttcaaaaagggcgctacctttaacaagtcagaatgccacgagttcatcgactattttaagaacagcatcgagaagcactacgactggagccagttcggcttcgaattcacacctaccgagaattacaacgacatcagcgagttctaccgggagattagcgaccagggctactctgtcagctttaacaagatctccaaatcctacgtggatgagctggtggataatggctacatctatctgttccagatctacaacaaagacttcagtaaatacagcaagggcaccccaaacctgcataccctgtacttcaaaatgctgttcgacgaaagaaacctgagcaacgtggtgtacaagctgaacggcgaggccgagatgttctacagagaggcttctataaacgacaaagaaaagatcacacaccaggccaaccagcctatcgaaaacaagaaccccgacaacgagaagaaagaatctaccttcgagtacgacatcatcaaggacaagcggttcaccaagcgacagttcagcctgcacgtgcctatcaccatcaacttcaaggcccacggccaggagtttctgaactacgatgtgcggaaggccgtgaagtataaggacgacaactatgtgataggcatcgatagaggcgagagaaacctgatctacatcagcgtgatcgattctaacggcaaaatcgtggaacagatgagcctgaatgaaatcatcagcgacaatggccacagagtggactaccagaagctgctcgacaccaaggaaaaggaacgggataaggcccggaagaactggaccagcgtggaaaacatcaaggagctgaaggaaggctacatctctcaggtggtgcacaagatctgcgagctggtggtcaaatatgacgccgttatcgccatggaagatctgaacttcggcttcaagagaggcagatttcctgtggaaaaacaagtgtaccaaaagttcgagaacatgctcatttctaaactgaacctgctgatcgacaagaaggccgatcctacagaggacggtggcctgcttagagcctaccagctgacaaacaagttcgacggcgtgaacaaggctaagcagaacggcatcatcttctacgtgcccgcttgggacaccagcaagatcgaccccgtgaccggatttgtgaacctgctgaagcctaagtacacaagtgtgtctgaagctaagaagctcttcgaaacaatcgacgatatcaagtacaatgccaacaccgacatgttcgagttctgcatcgactacggcaagttcccaagatgcaatagcgattacaagaacacttggacagtgtgcaccaacagctccaggatcctgacctgtagaaacaaggaaaagaataacatgtgggataataagcagatcgttctgaccgatgagttcaagagcctgtttggcgaatttggaattgactacaagggcaatctgaaaacctccatcctgtctatcagcaacgccgacttctaccggagactgatcaagctgctgagcctgaccctgcagatgagaaacagcatcaccggcagcacattgccagaggatgactacctgatcagccccgtggccaatgacagaggagaattctacgacagccggaattacaagggcatgaacgccgctctgccgtgcgacgctgatgcgaatggcgcttacaacatcgctagaaaggccctgtgggccatcaacgtgctgaagtctacacctgacgacatgctgaacaaggccaacctctctatcactaacgctgaatggctggagtatacacagaag

SEQ ID NO: 63 - DNA, 25 bp, synthetic construct
  source 1..25: mol_type = other DNA
atctacaacagtagaaattattagg

SEQ ID NO: 64 - DNA, 25 bp, synthetic construct
  source 1..25: mol_type = other DNA
atctacaacagtagaaattattagg

SEQ ID NO: 65 - DNA, 36 bp, synthetic construct
  source 1..36: mol_type = other DNA
gattaataatccctaataatttctactgttgtagat

SEQ ID NO: 66 - DNA, 35 bp, synthetic construct
  source 1..35: mol_type = other DNA
attaataatccctaataatttctactgttgtagat

SEQ ID NO: 67 - DNA, 36 bp, synthetic construct
  source 1..36: mol_type = other DNA
atctacaacagtagaaattattagggattattaatc

SEQ ID NO: 68 - DNA, 36 bp, synthetic construct; identical to SEQ ID NO: 67
  source 1..36: mol_type = other DNA

SEQ ID NO: 69 - RNA, 25 nt, synthetic construct
  source 1..25: mol_type = other RNA
cctaataatttctactgttgtagat

SEQ ID NO: 70 - RNA, 36 nt, synthetic construct
  source 1..36: mol_type = other RNA
gattaataatccctaataatttctactgttgtagat

SEQ ID NO: 71 - RNA, 36 nt, synthetic construct; identical to SEQ ID NO: 70
  source 1..36: mol_type = other RNA

SEQ ID NO: 72 - protein, 1253 aa, synthetic construct
  VARIANT 604..621: note = X is independently selected from any naturally occurring amino acid or absent
  VARIANT 628..633: note = X is independently selected from any naturally occurring amino acid or absent
  VARIANT 656: note = X is independently selected from any naturally occurring amino acid or absent
  VARIANT 1047: note = X is independently selected from any naturally occurring amino acid or absent
MKEQFINCYPLSKTLRFSLIPVGKTEDNFNKKLLLEXDKQRAENYEKVKGYIDRFHKEYIESVLXNARIEKINEYAXLYWKSNKDDSDAKAMESLENDMRKQISKQLKSNARYKRLFGKELICEDLPSFLTDKXERETVECFRSFTTYFKGFNTNRENMYSSDEKSTAIAYRCINDNLPRFLDNVKSFQKVFDNLSDETITKLNTDLYNIFGRNIEDIFSVDYFEFVLAQSGIDIYNSMIGGYTCSDGTKIQGLNECINLYNQQXAKNEKSKRLPLMKPLYKQILSEKDSVSFIPEKFNSDNEVLLAIEDYYNNHIGDXDLLTELLQSLNTYNANGIFVKSGAAVSDISNGAFNSWNVLRLAWNEKYEALHPVTSKTKIDKYIEKRDKVYKAIKSFSLFELQSLGNENGNEITDWYISSINECNRKIKEAYLQARELLKSDYEKSYNKRLYKNEKATESVKNLLDAIKEFQXLVKXLNGTGKEENKDELFYGKFTSLYDSVADIDRLYDKVRNYITQKPYSKDKIKLNFDNPQLLGGWDKNKESDYRTVLLRKXDFYYLAVMDKXHSKXFVXAPNITSXDEDYYEKMEYKLLPGPNKMLPKVFXXXXXXXXXXXXXXXXXXFAXXNIXXXXXXDTFQPSDRILDIRKRESFKKGAXTFNKSECHEFIDYFKXSIXKHYDWSXFGFEFXPTEXYNDISEFYREVSDQGYXISFXKISKXYIDELVDNGYIYLFQIYNKDFSKYSKGTPNLHTLYFKMLFDERNLSNVVYKLNGEAEMFYREASINDKEKITHXANQPIENKNPDNEKKESVFEYDIVKDKRFTKRQFSLHVPITINFKAHGQEFLNYDVRKAVKYKDDNYVIGIDRGERNLIYISVIDSNGKIVEQMSLNEIISDNGHXVDYQKLLDTKEKERDKARKNWTSVENIKELKEGYISQVVHKICELVVKYDAVIAMEDLNFGFKRGRFPVEKQVYQKFENMLISKLNLLIDKKADPTEXGGLLRAYQLTNKFDGVNKAKQNGIIFYVPAWDTSKIDPVTGFVNLLKPKYXTSVXEAKKLFETIDDIKYNTNTDMFEFCIDYGKFPRCNSDFKKTWTVCTNSSRILTFRNKEKNNMWDNKQIVLTDEFKSLFNEFGIDYKGNLKXSILSISNADFYRRLIKLLSLTLQMRNSITGSTLPEDDYLISPVANDRGEFYDSRNYKGXNAALPCDADANGAYNIARKALWAINVLKDTPDDMLNKAKLSITNAEWLEYTQK

SEQ ID NO: 73 - DNA, 3753 bp, synthetic construct
  source 1..3753: mol_type = other DNA
atgaaagaacagtttataaatcgttattcattatctaaaactttaagattctctttaattcccgttggggaaacagaaaataattttaataaaaatcttttgcttaaaaaagataaacaacgagcagaaaattatgaaaaggttaaaggctatattgatcgctttcacaaagaatatattgaatccgtgttgagcaaagcaagaattgaaaaagttaatgaatatgcaaatttatattggaaaagcaacaaggatgattccgatataaaggctatggaatcattagaaaatgatatgcgtaagcaaatatcaaaacagctcaaatcaaatgcacgctataaaagactgtttggaaaagaacttatatgtgaagatttaccgtcttttttaacggataaagacgagagagaaacagttgagtgctttagaagctttacaacatatttcaaaggctttaatactaatcgagaaaacatgtattcaagtgatgaaaaatcaactgcaatagcttatcgttgcataaatgacaacctaccacgctttttagataatgtaaaaagttttcaaaaagtatttgataatctttctgatgaaactatcacaaagctaaacacagatttatataatatattcggcagaaatattgaagatattttttctgttgattactttgaatttgttttagctcaatcgggcattgaaatttataattctatgattggcggatacacttgctctgacaaaactaaaatccaaggtcttaatgaatacataaatctttataaccagcagatttcaaaaaatgaaaaatcaaaaagattgccattgataaaacctttatataaacaaattttgagtgaaaaggacagcgtatcgttcattcccgagaaattcaattcagacaatgaagtgttgcttgcgattgatgattattataacaaccacattggtgattttgatttactaacagagcttttgcaatcattaaacacttataatgccaatggaatatttgtaaaatcaggtgtggccattactgatatttcaaacggtgcatttaactcatggaatgtattacgctcagcttggaatgagaaatacgaagcattgcatcccgtaacaagcaaaacaaaaattgataaatatattgaaaaacgagacaaggtatataaagcaataaaaagcttttcgctttttgagcttcaaagccttggcaacgaaaacggcaacgaaataaccgattggtatatttcctcaatcaatgaaagtaacagaaaaataaaagaagcttatttgcaggcacaggaattactgaaatccgattatgaaaaaagctacaataaaagactttataaaaatgaaaaagcaacagagtcagttaaaaacctgcttgacacaataaaggaatttcaaaagcttattaagccgttaaacggtaccagtaaggaagaaaacaaggatgaacttttttacggcaaattcacttcactttatgactcggtagcagatattgacaggctttacgataaggttagaaactatattacccaaaagccttattccaaagataaaattaaattgaattttgacaatcctactttcttaaacggttgggcattaggaaacgaatttgcaaattctgcacaattgcttagagatggtgataattactatcttgcaattatggataaagaattaaaaaacaatataccaaaaaaatacaattcaccaaccaacgaagaagatatgctgcaaaagattatttatcaacaggctgctaatccggcaaacgatattccaaatcttcttgttattgatggagtaactgtaaaaaagaacggaagaaaagaaaaaacaggaatacatgcaggtgaaaatatcatattggaaaatcttagaaacacctatcttcccgacaacataaatcgtataagaaaagaaaaaacattttcaacatcaagcgaaaacttttcaaaagatgacttgtgcgagtatatccaatattatatctgccgtgtacaagaatactattcttcatacaacttcacctttaaaaatgcctcagaatataaaaacttcccagagttttcagatgatgtaaactcacaggcatatcaaattagctatgataatatttcaaaaaagcaaattatggaacttgtagacaacggatatatctatcttttccaaatctacaataaagacttttcaaagtacagcaaaggaactcctaatttacatactctgtatttcaaaatgctttttgacgagagaaacttatcaaatgtagtttataaactcaacggtgaggcagagatgttctaccgtgaagcaagtatcggtgataaagagaaaataactcactatgccaatcaaccgatagaaaataaaaaccctgataacaagaaaaaagaaagcgtttttgagtatgatattgtaaaagacaagagatttaccaaaaggcaattttcacttcacgtgcctattacaatcaactttaaggcacacggtcaggaatttttaaattatgatgttcgcaaggcggttaaatacaaagatgataattatgttatcggcattgaccgaggagagagaaacctgatttatataagcgttattgattcaaacggtaaaatcgttgagcaaatgtcgcttaatgaaataatcagtgataacgggcacaaagttgattatcaaaagcttttggacacaaaagaaaaggaaagagataaagcaagaaagaattggacctctgttgaaaatataaaggaactcaaagaaggctatatcagtcaggttgttcacaaaatttgtgaattagtcgtcaaatatgacgctgttatcgccatggaggatttgaattttggctttaagcgtggcagattccctgttgaaaagcaagtttatcaaaaatttgaaaatatgcttatttcaaaactcaatttgcttattgataaaaaggcagacccaacagaaaacggcggacttttaagagcatatcagcttacgaataaatttgacggtgtaaataaggctaagcaaaacggtatcatcttttatgttcctgcgtgggatacaagtaaaatagacccggcaacaggttttgttaatcttttgaagccaaaatgcaacacaagcatgccggaggcgaaaaaactttttgaaacaattgatgatatcaaatataatacaaacaccgatatgtttgagttctatattgattacagcaaattcccaaggtgcaattcagacttcaaaaaatcttggactgtttgcactaattcaagcaggattttaaccttcccaaacaaagaaaaaaataatatgtgggacaataaacaaattgttcttaccgatgaatttaagtcgttatttaatgaattcggcattgattataaaggtaatcttaagagctctattttaagcatttccaatgctgatttttacaggcgattaataaagcttctttcattaacacttcaaatgagaaacagtattaccggcagcacattaccgaaagatgactatctcatctcccctgttgcaaataaaaacggtgagttctatgacagtcgtaattataaaggtacaaatgccgctttgccttgcgatgccgatgccaacggtgcatataacattgcaagaaaagcactttgggcaataaatgtattaaaagacactccggacgatatgcttaataaagctaagcttagtataactaatgccgaatggcttgaatacacgcaaaaatga

SEQ ID NO: 74 - DNA, 3684 bp, synthetic construct
  source 1..3684: mol_type = other DNA
atgaaagaacagtttataaattgctatccattatccaaaactttaagattttctttaatccctgttggaaaaaccgaagataatttcaataaaaagcttttgcttgaaagcgataaacaaagagcggagaattatgaaaatgtcaaaagctatattgaccgctttcataaagaatatattaaatctgcattagcaaacgcaagaattgaaaaaatcaatgaatatgcggctttatattggaaaaacaataaggatgattctgacgcaaaagctatggaatcgttagaagatgatataagaaagcaaatatccaaacaacttacatcaaccgcaaactttaaaagactgtttggaaaagagttgatatgtgaagacttaccggcttttttaacagatgaaaatgaaaaagaaacagttgaatgctttagaagctttacaacatattttaatggttttaatactaatcgaaagaatatgtattcgagtgaaaaaaagtcaactgcaatagcttatcgttgtgtaaatgacaaccttcctcgctttttagataatataaaaacctttcaaaaaatattcgataatctttctgatgaaactatcacaaaactaaacacagatttatataatatattcggcagaaaaattgaagatattttttctgttgattattttgattttgttttgactcaatcaggcattgatatttataattatatgatcggcggatatacttgctcagacggaaccaaaatccaaggtcttaatgaatgtataaatctttataaccagcaggttgccaaaaatgaaaaatcaaaaagattgccgttaatgaaaccgttacgtaagcaaatcttaagtgaaaaggacagtgtatcgttcattcccgagaaattcaattcagacaacgaagtgttgcttgcgattgaagaatattataataaccacattagtgatatcgattcgcttacagagcttttgcaatcattaaacacttataatgccaatggaatatttataaaatcaggtgctgccgtttccgatatttcaaacgctgcatttaactcatggaatgtattacgcttagcttggaatgaaaagtatgaagctttgcatcccgtaacaagcacaacaaaaatcgataaatatattgaaaagcgagacaaggtatataaatcaataaaaagcttttcgctttttgaacttcaagagcttggtgcggaaaatgggaatgaaataaccgattggtatatttcatcaatcaatgaatgtaaccgcaaaataaaagaaacttatttgcaggcacgggaattgctggaatccgattatgaaaaggactacgataaaagactttataaaaatgaaaaagcaacagagttagtaaaaaacctgcttgacgcaataaaggaatttcaacagcttgttaaactgttaaacggcacaggtaaagaagaaaacaaggacgagcttttttacggcaaattcacttcactttatgactcggtagcagatattgacaggctttacgataaggttagaaactacattactcaaagaccttattccaaagataaaataaagctgaattttgacaatccccaacttcttggcggatgggataaaaacaaagaaagcgattacagaaccgttattcttcgcaaaaatgatttttactatcttgccgttatggacaaatcacacagtaaggtttttgttaatgcacctgagataacctctgaagacgaggattattacgaaaaaatggaatataagcttttgcccggtcccaataaaatgttgccaaaggttttcttcgcctctagaaatattgacaaatttcaaccgtcagacagaatacttgatattcgcaaaagagaaagctttaaaaaaggagcgacatttaacaaatccgaatgtcatgagtttatagattattttaaggaatctattaagaagcatgatgattggtcaaaattcggatttgagttttctcctacagaaagctataacgatattagcgaattttatcgagaagtttcagatcaaggctattatattagctttagtaaaatatcaaaaaactatatcgataagcttgtagaaaacggatatctttatctttttaaaatctataataaagacttttcaaagtacagcaaaggaactccgaatttacatactttgtatttcaaaatgctttttgacgagagaaatttatcaaatgtggtatacaagctcaacggtgaagccgagatgttctaccgtgaagcaagtataaatgacaaagagaaaataactcatcatgccaatcaaccgataaaaaacaaaaatcctgataacgagaaaaaagaaagcgtttttgagtatgatattgtaaaagacaaaagatttaccaaaaggcaattttcacttcacgtgtctgttacaatcaacttcaaggcacacggtcaggaatttttgaactatgatgttcgcaaggcggttaaatataaagatgataattacgttatcggcattgaccgtggcgaaaggaatctgatttatatcagcgttatcaattcaaacggtgaaattgttgaacaaatgtcgcttaatgaaataatcggtgacaacggatacagtgttgattatcaaaagcttttggataagaaagaaaaggaaagagataaagcaagaaaaaactggacctctgttgaaaatataaaggaactgaaagaaggctacatcagccaggttgttcacaaaatctgtgaattagtcgttaaatatgatgccgttatcgctatggaggatttaaacttcggcttcaagcgcggtaggtttcctgttgaaaagcaagtttatcaaaaatttgaaaatatgcttatttccaaactcaatttgcttattgataagaaggcggaaccgaccgaaaccggcggtcttttgcgagcatatcagcttacgaataaattcgacggcgtaaataaggctaagcaaaacggtatcatcttttatgttccggcttgggatacaagtaaaatagatccggtaacgggctttgttaatcttttaaagccaaaatacacaagtgtgcgggaagctaaaaagttatttgaaacaattgatgatatcaaatataacacaaacaccgatatgtttgagttctgtattgattatggtaaattcccgagatgcaattcggatttcaaaaaaacttggactgtttgcactaattcaagcagaattttatccttccggaatgaaaaaaagaataacgagtgggacaataagcaaattgttcttaccgatgaattcaaatcgttgtttaatgaatttggcattgattatacaagtgatcttaaggcttctattttaagcatttccaatgccgatttttacaatcgattgataagacttctttcattaacacttcaaatgagaaacagtattatcggcagcacattaccggaagatgactaccttatttcgcctgttgcaaatgacagaggtgagttctatgacagtcgtaattataaaggctcaaatgccgctttgccttgcgatgccgatgcgaatggcgcatataatattgcaagaaaagcgctttgggcaataaatgttttaaaagacactccggatgatatgcttcaaaaagcaaaacttagtataactaatgccgaatggcttgaatatacacaaagatga

SEQ ID NO: 75 - DNA, 3684 bp, synthetic construct
  source 1..3684: mol_type = other DNA
atgaaagaacagtttataaattgctatccattatccaaaactttacagttttctttaattcccgtcggaaaaacggatgataattttaataaaaagctgttacttgaaagggataaacaaagagcggagaattacgaaaaggttaaaggttatattgaccgctttcacaaagaatatattgaatccgtactagtcaatgcaagggttgaaaaaatcgatgaatatgcggatttgtattggaaaagcaacaaggacgattccgacgcaaaggctatggaatcattagaaaatgatatgcgaaagcaaatatcaaaacagcttaaatcaaatgcacgctataaaaggctgtttggaaaagaacttatatgtgaagatttaccgtcttttttaacggataaagaagagagagaaacagttgagtgcttcagaagctttacaacgtatttcaaaggccttaatactaatcgagaaaatatgtattcaagtgatgaaaaatcaactgcaatatcttaccgttgcataaatgacaacctgccacgctttttagataatgtaaaaagttttcaaaaagtatttgataatctttctgatgaaactatcacaaagctaaacacagatttatataatacattcggcagaaatattgaagatgttttttctgttgattattttgaatttgttttggctcaatcgggcattgatatttataattctatgattggcggatatacttgctctgacggaacaaaaatccaaggtcttaatgaatgcataaatctttataacaagcaggatgcaaaaaatgaaaaatcaaaaagattgccattgatgaagccgttatataaacaaatcttgagcgaaaaggacagcgtatcgttcattcccgagaaatttaattcagacaatgaagtgttgctttcgattgaagattattatagcagccacattggcgatttggatttgctaacagagcttttgcaatcgttaaacacttataatgctaatggaatatttgtaaaatccggcgctgccgtttccgatatttcaaacggtgcatttaattcatggaacgtattacgtttagcttggaacgagaaatacgaggcattgcatcccgtaacaagcaaaacaaacctcgataattatattgaaaagcgagacaagatatataaagcaataaaaagcttttcgctttttgaacttcaaagcctcggtaacgaaaacggcaacgaaataacagattggtatatttcctcaagcaaagaatgtaacagcaaaatcaaagaagcttatttgcaggcacgggaattgctgaaatccgattatgaaaaaagctacaataaaagactttctaaaaacggaaaagcaacacagtcaattaaaaacatccttgacgcaataaaggattttcaccatctggtaaagtcgttaaactgtaccggtaaggaagaaaacaaggatgaacttttttacggcaaactcacttcgtattatgactcaataacagatattgacaggctttacgataaagttagaaactacattacccaaaagccttattccaaagataaaattaaattaaattttgacaatcctcaacttctcggtggatgggataaaaacaaagaaagcgattacagaaccgttcttcttcgcaaagatgatttttactatcttgctgttatggacaaattgcacagcaaagcttttgttgatgctcctaatataacctctaaagacgaggattattacgaaaaaatggaatataagcttttacccggtcccaataaaatgttgccaaaggttttctttgccgctaaaaacattgacacattccaaccgtcagacagaatacttgacattcgcaaaagagagagtttcaaaaaaggggcaacatttaataaatccgaatgtcatgagtttatagattattttaagaactccattgagaagcactatgattggtcgcaattcggctttgagtttactcctaccgaaaactataacgatatcagcgagttttatcgagaaatttcggatcagggttattctgtaagctttaataaaatatcaaaaagctatgttgatgaacttgtagacaacggatatatctatcttttccaaatctacaataaagacttttcaaagtacagcaaaggaactccgaatttacatactctgtatttcaaaatgctttttgatgagagaaacttatcaaatgtagtatacaagctcaacggtgaagccgagatgttttaccgtgaagcaagtataaatgacaaggaaaaaataactcatcaagccaatcaaccgatagaaaacaaaaatcctgataacgagaaaaaagaaagcacttttgagtatgacattattaaagataaaagatttaccaaaaggcaattttcgcttcacgtgcctattacaatcaactttaaggcacacggtcaggaatttttgaattatgatgttcgcaaggcggttaaatataaagatgataattatgtcatcggcattgaccgaggcgaaagaaatctgatttatatcagcgttattgattcaaacggtaaaatcgttgagcaaatgtcgcttaatgaaataatcagtgataacggacacagagttgattatcaaaagcttttggacacaaaagaaaaggaaagagataaagcaagaaaaaattggacttctgttgaaaatataaaggaactcaaagaaggctatatcagtcaagttgttcacaaaatttgtgaattagtcgtcaaatatgacgctgttattgccatggaggatttgaactttggctttaagcgtggcagattccctgttgaaaagcaagtttatcaaaaattcgaaaatatgcttatttcaaaactcaatttgcttattgataaaaaggcagacccaacagaagacggcgggcttttaagagcatatcagcttacgaataaatttgacggcgtaaataaagccaagcaaaacggcatcatcttttatgttccggcttgggacacaagcaaaatagacccggtaacaggttttgttaatcttttgaagccaaaatacacaagcgtatcggaagcaaaaaagttatttgaaacaattgatgacattaaatataatgcaaataccgatatgtttgaattttgtattgattacggtaagttcccaagatgcaattcagactacaaaaatacttggactgtttgcactaattcaagcaggattttaacttgcagaaacaaagaaaagaataatatgtgggacaataagcaaattgttcttaccgatgaattcaaatcgttgttcggcgaattcggcattgattataaaggtaatcttaaaacttcaattttaagcatttccaatgctgacttttacaggcgattgataaagcttctttcattaacgcttcaaatgagaaacagcattaccggcagcacattgccggaggatgactacctcatttcccctgttgcaaatgacagaggcgaattctatgacagccgtaattataaaggaatgaatgccgcattaccttgcgatgccgatgcaaacggcgcatataatattgcgagaaaagcactttgggcaataaatgttttaaaaagcactccggatgatatgcttaataaagcaaatctcagtataactaatgccgaatggcttgaatacacgcaaaaatga

SEQ ID NO: 76 - protein, 1325 aa, synthetic construct
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYFNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITEISQSLFKDYGVIKDAIKFQFIQSLTIGKSGLSKKQEEAVEKHLKQKYFSIAEIENALFTYQNETDALKELKENSHPVVDYFINHFKAKKKEETDKDFDLIANIEAKYSCIKGLLNTPYPEDKKLYQRSKEDNDIDNIKAFLDALMELLHFVKPLALSNDSTLEKDQNFYSHFEPYYEQLELLIPLYNKVRNFAAKKPYSTEKFKLNFENSHFLSGWATEYSTKGGLIIKKENDFYLLIVDKKLQKEDVDLLKRNVSSNIAYRVVYDFQKPDNKNVPRLFIRSKGTNFAPAVEKYNLPIHNVIEIYDNGFFKTEYRKVDPVKFKKSLVKLIDYFKEGFTKHDSYKHYDFGWKESNQYEDISEFYNDVVNSCYQLVDEEINYDNLLKLVDEGKLYLFQIYNKDFSPYSKGKPNMHTLYWKALFDPENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFESFSKIGKQSGFLFYVPAWNTSKIDPTTGFVNLFNTKYESVPKAQEFFKKFKSIKFNSAENYFEFAFDYNDFTTRAEGTKTEWTVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKADNTLPKDADANGAYHIAKKGLVLLNRLKENEVEEFEKSKKVKDGKSQWLPNKDWLDFVQRNVEDMVVV

SEQ ID NO: 77 - protein, 1275 aa, synthetic construct
MTMKNFSNLYQVSKTIRFELKPIGSTLENIENKSLLKNDSIRAESYQKMKETIDEFHKYFIDLALNNKKLSYLNEYIALYTQSAEAKKEDKFKAEFKKVQDNLRKEIVSSFTEGEAKAIFSVLDKKELITIELEKWKNENNLAVYLDESFKSFTTYFTGFHQNRKNMYSAEANSTAIAYRLIHENLPKFIENSKAFEKSSQIAELQPKIEKLYKEFEAYLNVNSISELFEIDYFNEVLTQKGITVYNNIIGGRTATEGKQKIQGLNEIINLYNQTKPKNERLPKLKQLYKQILSDRISLSFLPDAFTEGKQVLKAVFEFYKINLLSYKQDGVEESQNLLELIQQVVKNLGNQDVNKIYLKNDTSLTTIAQQLFGDFSVFSAALQYRYETVVNPKYTAEYQKANEAKQEKLDKEKNKFVKQDYFSIAFLQEVVADYVKTLDENLDWKQKYTPSCIADYFTTHFIAKKENEADKTFNFIANIKAKYQCIQGILEQADDYEDELKQDQKLIDNIKFFLDAILEVVHFVKPLHLKSESITEKDNAFYDVFENYYEALNVVTSLYNMVRNYVTQKPYSTEKIKLNFENAQLLNGWDANKEKDYLTTILKRDGSYFLAIMDKKHNKTFQQLTEDDENYEKMVYKLLPGVNKMLPKVFFSNKNIAFFNPSREILDNYKNNTHKKGATFNLKDCHALIDFFKDSLNKHEDWKYFDFQFSETKTYQDLSGFYREVEHQGYKINFKKVSVSQIDTLIEEGKMYLFQIYNKDFSPYAKGKPNMHTLYWKALFETQNLENVIYKLNGQAEIFFRKASIKKKNIITHKAHQPIAAKNPLTPTAKNTFAYDLIKDKRYTVDKFQFHVPITMNFKATGNSYINQDVLAYLKDNPEVNIIGLDRGERHLVYLTLIDQKGTILLQESLNVIQDEKKATPYHTLLDNKEIARDKARKNWGSIESIKELKEGYISQVVHKITKMMIEHNAIVVMEDLNFGFKRGRFKVEKQIYQKLEKMLIDKLNYLVLKDKQPHELGGLYNALQLTNKFESFQKMGKQSGFLFYVPAWNTSKIDPTTGFVNYFYTKYENVEKAKTFFSKFESILYNKTKGYFEFVVKNYSDFNPKAADTRQEWTICTHGERIETKRQKEQNNNFVSTTIQLTEQFVTFFEKVGLDLSKELKTQLIAQNEKSFFEELYHLLKLTLQMRNSESHTEIDYLISPVANEKGIFYDSRKATASLPIDADANGAYHIAKKGLWIMEQINKTNSADDLKKVKLAISNREWLQYVQQVQKK

SEQ ID NO: 78 - protein, 1285 aa, synthetic construct
LIIILNLFKMTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 79 - protein, 1274 aa, synthetic construct
MNTTYTNLFALSKTLRFELIPQGKTLHFIQEKGLITNDNKRAESYQKMKKTIDEFHKYFIDLALKNVRLSFLEDYLDLYNQSADYKKEPKFKEELKKVQDNLRKEIVLSFSKDEAKTIFSILDKKELITEELEKWFENQEKKDLHFDDKFKTFTTYFTGFHQNRKNMYSSEPNSTAIAYRLIHENLPKFLENAKAFERIKQVPELQLKIEKIYKDFELYLNVNSIEELFELNYFNDVLTQMGIDVYNNIIGGRTETDGKPKIQGLNEIINLYNQTKSKNERLPKLKQLYKQILSDRVSLSFLPDAFTDGKQVLQAIFAFYKVNILSYTIDGQAESKNLLELIQQLLANISSFETERIHLKNDTNLTTISQQLFGDFSVFSTALNYWYETKVYPKFEAEYTKATEKKRETLEKTKAVFTKQDYFSIAFLQEIITEYSLSLDKDSELITKITPTCVADYFKNHFVAKKENETDKTFGFLANITAKYQCIQGTLENATNYNEELKQDQKLIDDIKLFLDTLLELLHFIKPLHLKSDSITEKDNAFYDLFENYYEALSLLTPLYNMVRNYVTQKPYSTEKIKLNFENAQLLNGWDVNKEADYLTTILKKEGNYFLAIMDKKHNKAFQKFPEGENNYEKMTYKLLPGVNKMLPKVFFSNKNIAYFNPSKELVENYKNETHKKGEKFNLLHCRQLIDFFKDSINKHEDWKHFDFQFSETKSYQDLSGFYREVEHQGYKINFKNIDSAYIDSLVNEGKLFLFQIYNKDFSPFSKGKPNMHTLYWKALFEDQNLKNVKYKLNGQAEIFFRKASIKPENIITHKANQSIKAKNPLTPDAKNTFDYDLIKDKRYTVDKFQFHVPITLNFKATGGSFINQNVLEYLKENPEVKIIGLDRGERHLVYLTLIDQQGNILKQESLNTITDAKIATPYHQLLDIKEKERDFARKNWGTVENIKELKEGYISQVVHKIATMMVEENAIVVMEDLNFGFKRGRFKVEKQIYQKLEKMLIDKLNYLVLKDKQPTELGGLYNALQLTNKFESFQKMGKQSGFLFYVPAWNTSKIDPTTGFVNYFFTKYENVDKAKVFFDKFQSIRYNTKANYFEFEVKKYSDFNPKAEGTLQEWTVCSYGERIETKRLKDQNNNFVSTPINLTEKIEDFLGRNNIVYGDGTCIKSQIAEKNAKEFFEGLLYWFKMTLQMRNSATGTDEDYLISPVMNAQGEFYDSRKADETLPKDADANGAYHIAKKGLMWLEQIKSFDGNDWKKLELDKSNRGWLQYIQQRK

SEQ ID NO: 80 - DNA, 3978 bp, synthetic construct
  source 1..3978: mol_type = other DNA
atgaagaacaacaacatgctcaacttcactaacaagtaccagttatcaaaaaccttacgattcgagctgaagccaatcggaaagactaaggagaatatcattgcgaagaatatccttaagaaggatgaggaaagggctgagtcctatcaactcatgaagaaaaccattgatggctttcataaacatttcattgagctggctatgcaagaggtacaaaaaactaaactgtctgagctggaagagttcgctgaactgtacaacaagtcagcagaggaaaagaaaaaggatgacaagtttgacgataagtttaagaaagttcaggaagccctgcgaaaggagattgttaaaggcttcaattcagagaaggtcaagtattactacagcaacatcgataaaaagatcctttttaccgaactccttaaaaactggatcccaaacgagaaaatgatcactgagctctctgaatggaacgctaaaactaaagaagagaaagagcacctcgtctaccttgacaaggaattcgagaactttactacatactttggagggtttcataagaatcgtgaaaacatgtataccgataaagaacagtccaccgctattgcctaccgcctgatacacgagaatttgccaaagttcctcgacaatatcaacatttacaagaaggtcaaagagatcccggtcctgagggaagagtgtaaagttctttacaaagagattgaggagtacttaaacgtgaattccatcgacgaggtcttcgagttgtcatatttcaataaaacactcactcagaaggacatcgatgtgtacaacttaattattggcggcagaacactggaagaaggcaagaaaaagatacaagggctcaacgagtatattaatctatacaaccagaagcaggagaaaaagaacagaatacctaagctgaagatcctttacaagcagatactgagcgatcgagatagtataagttggctgcctgagagcttcgaggatgataatgagaagactgccagccagaaagtgcttgaggccatcaatctctattacagagataacctcttatgttttcagcctaaggacaaaaaggacaccgagaacgtcctcgaggaaacaaaaaaactgctggctgggttgagcacgagtgatctgtctaagatttacatccgcaacgacagagctatcactgagatttcgcagagtctgtttaaagactatggcgtaatcaaggatgcaatcaagttccagtttatacagagtctgacaattgggaagtcagggctatccaaaaaacaggaggaggctgtggaaaaacatctgaaacagaaatacttctccattgcggaaatcgagaacgcactttttacctaccagaacgaaacagatgcactcaaagagttgaaagaaaattctcacccagtggtggactatttcatcaaccactttaaagctaagaagaaggaggagacagacaaggattttgaccttatagcgaatattgaggcaaagtattcctgcattaagggacttttaaataccccctatcccgaggacaagaaactgtatcaaaggtctaaagaggacaacgatatcgacaatatcaaagcctttctggacgccttgatggagctgctgcactttgtgaagcctctagccctcagcaatgacagtacgttggaaaaagaccagaatttctactctcacttcgagccatattacgaacagctggagttgttgatccccttgtataataaggtccggaactttgctgcaaaaaagccctactctacggagaaattcaagctgaacttcgaaaattcccactttctatcgggttgggccacagaatactccaccaaaggaggcctcatcattaaaaaggagaacgatttctacctgcttattgtggacaagaagcttcaaaaagaagatgtcgatctgctgaaacggaatgtttcttcgaacattgcttatagagtcgtctacgattttcaaaagccagacaataagaacgtgccacgcttattcatccgctcaaaaggaaccaatttcgctcccgcagtagaaaagtataacctgcccatacataacgtgatcgaaatttatgacaacggattctttaagacagagtaccgcaaagtagatccggtgaaattcaagaaatcactggttaaactgatcgactattttaaggaggggttcacaaaacatgactcctacaaacattatgactttggatggaaagaatcaaaccagtacgaggacatcagtgaattttacaacgatgttgtgaacagctgctaccagctagtagatgaagagatcaactatgacaatctgctgaaactagttgatgaaggcaaactttacctctttcagatctacaacaaggatttttccccgtatagtaagggtaaacctaatatgcacaccctgtattggaaagcactttttgaccccgagaacctcaaagatgtagtctataaactgaacgggcaggcggaggtcttctatcgaaagaagtcaatcgagcaaaagaacatcgtgacacataaggccaacgaacctattgacaataagaatcctaaggccaaaaagaagcagtccaccttcgagtatgacctgattaaggataaacggtatactgtggacaagtttcagttccacgtccctattaccttaaacttcaaagcgaccggtaacgactatataaatcaagacgtccttacctacctgaagaataatcccgaggtgaatatcattggcctggacagaggcgaacgtcacctcatatatctcaccctgataaaccagaagggggagatactcctgcaggagagcttgaacaccatagtgaataagaaatacgacatcgaaaccccctaccacacactgctacagaacaaggaggatgaacgtgccaaagccagggaaaattggggcgtcattgaaaatattaaggaactgaaggagggatatattagccaagtggtgcataaaattgccaaacttatggtggaatacaacgccatagtagtgatggaagacctgaacacagggttcaagagggggcggtttaaagtggagaagcaggtctatcagaaactcgagaagatgctgattgacaagttgaattacttagtgttcaaggacaaagacccatctgaggttggcggtctatatcacgcgctccaattgactaacaaatttgagtctttcagcaagatcggcaagcagtctggattcctcttctacgtgccagcatggaataccagcaagatcgaccctactacagggttcgttaatctgttcaacacgaagtacgaatccgtcccaaaggcacaggagttcttcaagaagttcaagtccatcaagtttaacagcgccgaaaattatttcgaattcgccttcgattacaatgactttactacgagggccgaaggaacgaaaacagaatggaccgtgtgcacctatggcgataggattaagacttttcggaatcccgataaggtaaatcaatgggataatcaagaggttaatctgaccgaacagtttgaggacttctttggtaaaaacaacctgatttacggtgatggtaactgtatcaaaaaccagatcatcttgcacgataagaaggaattttttgaaggactcctacacctgttgaaactgacactccagatgagaaacagtatcacaaattctgaggtggattacctcataagccctgtgaaaaataataaaggcgaattctacgactcccggaaagctgataatactttgcccaaggatgccgatgccaatggcgcatatcatatcgccaaaaagggactggtgttgcttaatcgcctgaaagagaatgaagttgaagagttcgagaagagcaagaaggttaaggacgggaagagccagtggctgccgaataaggactggttagactttgtgcagcggaatgtggaagatatggtggtggtgtga

SEQ ID NO: 81 - DNA, 3828 bp, synthetic construct
  source 1..3828: mol_type = other DNA
atgacaatgaagaactttagcaacctgtaccaggtgagcaaaaccattaggtttgagctgaagccaatcggaagcacactggagaacatcgaaaacaagtcactgctgaaaaatgatagcattagagccgagagctaccagaagatgaaagagacaattgacgagttccacaagtatttcatcgatctggctctgaacaataagaagctgagctacctgaacgagtatatcgctctctacacccagagcgccgaagccaagaaggaggacaaatttaaggccgaatttaagaaggtgcaggataacctgcggaaagaaattgtgagctccttcaccgagggtgaggctaaggccatcttcagcgtgctggacaaaaaggagctgattacaattgaactggaaaaatggaagaacgagaacaacctggccgtgtacctcgacgagagcttcaagtccttcactacatacttcacaggcttccaccagaatagaaagaacatgtacagcgcagaggccaactctacagccatcgcctaccggctgatccatgagaacctgcccaagtttatcgagaactccaaggcctttgagaagtccagccagatcgccgagctgcagccaaagatcgaaaagctgtacaaggagttcgaggcctatctgaacgtgaatagcatcagcgagctgttcgaaattgactacttcaacgaggtgctgacccagaagggcattacagtgtacaacaacatcatcgggggcaggactgccaccgaggggaaacagaagattcagggcctgaatgagattatcaatctgtataatcagacaaaacccaagaacgaaagactgccaaagctgaagcagctgtataagcagatcctgtccgacagaatcagcctgtctttcctgcctgacgccttcaccgaagggaagcaggtgttgaaagccgtgtttgagttctacaagatcaaccttctgtcttacaaacaggatggcgtggaggaaagccagaacctgctggagctgatccagcaggtggtgaagaacctgggcaaccaggacgtgaataagatctacctgaaaaacgacacctccctgactaccattgcccagcagctctttggggactttagtgtgtttagcgccgccctgcaatacaggtatgagaccgtggtgaaccccaagtacactgccgaatatcagaaggccaacgaggccaagcaggagaagctcgacaaggagaagaacaagttcgtgaaacaggactacttctccatcgccttcctgcaggaggtggtggcagattacgtgaagaccctggacgaaaacctggattggaaacagaagtacaccccatcctgcatcgccgactactttaccacccacttcatcgccaagaaagagaacgaggccgataaaacctttaactttattgccaatattaaggccaagtatcagtgcatccagggcattctggagcaggccgatgattacgaggatgagctgaagcaggaccagaagctgatcgataacatcaagtttttcctggacgctatactggaggtggtgcacttcgtgaagcctctgcacctgaagtctgagtctatcactgagaaggataatgccttttacgacgtgtttgagaattactacgaggcactgaatgtggtgacctcactgtacaatatggtgagaaattacgtgactcagaagccttacagcacagagaagattaagctgaactttgaaaacgcccagctgctgaacggctgggacgctaataaggagaaggattacttgaccactattctgaagcgggatggaagttatttcctggctattatggataaaaagcacaataagaccttccagcagctgacagaggacgacgagaactacgagaagatggtctataagctgctgcccggcgtgaacaagatgctgcccaaggtgtttttctctaataaaaacatcgccttctttaaccccagcagagagatcctggacaattataagaacaacacccacaagaagggcgccacatttaacctgaaagactgtcatgccctgattgacttcttcaaggactccctgaacaagcacgaggactggaagtacttcgacttccagttctctgagacaaagacctaccaggacctgtccggcttttaccgcgaagtggaacaccagggctacaaaatcaattttaaaaaggtgagcgtgtcccagatcgacaccttgatcgaagagggaaaaatgtatctgttccagatctacaacaaggacttcagtccttacgcaaagggcaaaccaaacatgcacacactgtactggaaggcactgtttgaaacccagaacctggagaacgtgatctacaagctgaacggccaggccgagatcttttttcgcaaggcctccatcaagaagaagaacatcattacccacaaagcacatcagcccatcgccgccaagaatccactgaccccaaccgccaagaacaccttcgcctacgacctgatcaaggacaagagatatacagtggacaagtttcagtttcatgtgcccatcaccatgaacttcaaggccactggcaatagctacattaaccaggacgtgctcgcctatctgaaggataatcctgaagtgaatatcattggcctggataggggcgagcgccaccttgtgtatctgaccctgatcgaccagaaaggaaccatcctgctgcaggaaagcctgaacgtgattcaggacgagaaaaaagccacaccctaccacaccctgctggacaacaaggagattgccagggacaaggcccgcaagaactgggggtccatcgagtccattaaggaactcaaggaggggtacatctcacaggtggtgcataaaattaccaaaatgatgattgagcacaacgccatcgtggtgatggaggacctgaatttcggcttcaaacgcggaaggtttaaggtggagaagcagatttatcagaagctggagaaaatgctgatcgacaagctgaactacctggtgctgaaggacaagcagccccacgagctgggagggctctataacgctctgcagctgaccaacaagttcgagtcattccagaaaatgggaaaacagagcggcttcctgttctatgtgcccgcctggaacaccagcaagatcgaccctaccaccggtttcgtgaactatttttacactaaatacgagaatgttgagaaggctaagacgtttttctctaaattcgagagcattctgtataataagacaaagggatattttgagtttgtggtgaagaattattccgacttcaaccccaaggcagctgacaccagacaggagtggaccatttgcacccacggggaaagaatcgaaaccaaaagacagaaggaacagaacaataatttcgtgagcactacaatccagctgaccgagcagttcgtcacttttttcgagaaggtgggactggacctcagcaaagagctgaagacccagctgattgcccaaaatgagaagagcttttttgaggagctgtatcacctgctgaaactgaccctgcagatgagaaacagcgagtctcacactgagattgattacctgatctcccccgtggctaacgagaaaggaattttttacgactcccggaaggccaccgcctcgctgcccatcgacgctgacgccaacggggcttaccacatcgctaagaagggcctgtggatcatggagcaaattaacaaaaccaactccgctgacgatctgaaaaaggtcaagctggcaatctccaacagagagtggctgcagtacgtgcaacaggtgcagaaaaagtga

SEQ ID NO: 82 - DNA, 3858 bp, synthetic construct
  source 1..3858: mol_type = other DNA
ctgattattatcttgaacctgttcaagatgacagccctgctgcagaacttcaccaaccagtatcagctctccaagaccctgaggttcgagctgatcccccagggcaagacttttgattttatccaggagaagggcctgctgaaccaggacaaacgcagagccgagagctaccaggagatgaaaaagaccatcgacaaatttcacaaatacttcatcgacctggctctctccaacgtgaaactgacccacctggatgcttacctggagctctacaatacctccgccgagaccaaaaaggagagcaagttcaaggacgacctgaagaaagtgcaggataacctgaggaaggaaatcgtgaaaagtttcagcgagggggaggccaagtctatctttgccatcctggacaaaaaggagctgatcactgtggagctggagaagtggtttgagagcaatgagcaggaggaaatctattttgacgataaattcaaaacgtttaccacctactttaccggctttcaccagaacagaaagaacatgtattctgtggaagccaactccaccgccatagcctacagactgatccacgagaatctgcctaaattcctggaaaatgctaaggcattcgagaaaattaaacaggtcccagagctgcagcctaagatagctaagatttacaaggagtttgaatcctacctgaatgtgaattctatcgacgagctgtttgagctggactacttcaatgacgtgctgacacagatgggcatcgacgtgtacaacaatatcatcggcggcagaaccgagagcgacggcaagagcaagatccaaggcctgaatgagatcatcaatctgtataatcagacaaaagagaagaatcagagactgccaaaactgaagcagctgtacaaacagattctgtctgaccgtatctctctgtccttcctgccagatgccttcactgacggcaagcaggtgctgaaggccatcttcgacttttacaagatcaacctgctgagttacacaattgaaggacaggaagagagccagaatctgctgctgctgatctctcagattgtggagaatctgagcggattcgataaccagaaaatgtacctgagaaacgacacccatctgacaaccatctcccagcagctgttcggcgacttcagcgttttcagcaccgcactgaattattggtatgagaccaaagtgaatccaaaatttgaagccgagtactcaaaggccaacgagaagaaacgcgaggccctggacaagaccaaggccaactttacaaagcaggactatttcagtatcgccttcctgcaggaagtgctggcaaactacgtgctgacactggataaaaccagcgacgtggtgcagaagttcacccccacctgtgtggccgactacttcaataatcacttcgtggccaaaaaggagaatgagaccgacaagacattcgacctgatcgccaatattacagccaagtaccagtgcatccagggcattctggagaatgccgacaggtacgaagacgagctcaaacaggatcagaagctgatcgacgatctgaagtttttcctggatgctatcatggagctgctccacttcattaagccactccacctgaaatctgaatccattaccgagaaggacaccgccttctatgacgtgtttgagaactattacgaagcactgagcctcctgacacctctgtacaacatggtcagaaactatgtgacccagaagccctactccaccgagaaaatcaagctgaactttgagaacgcccagctgctcaacggatgggacgctaataaggaggccgactacctgacaaccattctgaagaaggatggcaattacttcctggctatcatggataagaagcacaataaggccttccagaaattccctgaaggaaccgacaactacgagaagatggtgtataagctgctgcctggcgtcaacaaaatgctgcccaaggtgtttttctccaacaaaaacatcgcatacttcaacccatcaaaggagctgctggagaactacaagaaggagacccacaaaaagggcgacacctttaatctggagcactgccacgccctgattgactttttcaaagattctctgaataagcacgaggactggaaacacttcgattttcagttcagcgaaactaagagctaccaggatctgtctggattttaccgggaagtggagcaccagggctacaagattaacttcaagaatatcgacagtgagtatatcgatggcctggtgaatgagggcaagctgtacctgtttcagatctataacaaagacttttctccctatagtaaagggaagccaaacatgcacaccctctactggaaggctctgtttgaggaacagaatctgcagaacgtgatctacaaactgaacgggcaggccgagatcttctttcgcaaggccagcatcaagccaaagaatatcatcacccacaaggccaaccagcccatcaaggccaagaatcccctgacccccgaggccaagaacaccttcgagtacgatctgattaaggacaagcggttcaccgtggacaagttccagttccacgtgcctatcactatgaactttaaggccaccggcggaagctacatcaaccagactgtgctggagtacctgcagaataacccagaggtgaagatcatcggactggaccgcggagagaggcacctggtgtacctgacactcatagaccagcagggaaatatcctgaagcaggagtctctgaacaccatctccgacacaaagattgccacaccataccacaagctgctggacaacaaggaaaaagagcgcgatctggccaggaagaactggggcacagtggagaatatcaaagagctgaaggaaggatacatcagccaggtggtgcacaagattgccacaatgatggtggaggagaacgcaatcgtggtgatggaagatctgaactttggattcaagcgcggcagattcaaggtggaaaaacagatttaccagaagctggaaaagatgttgatcgacaagctgaactacctggtgctcaaaaacaagcagccccacgaactgggcggcttgtataacgccctgcagctgacaaacaaattcgagtctttccagaaaatgggcaagcagagcggctttctgttttacgtgcctgcctggaatacctcaaagatcgatcccacaacaggcttcgtgaactatttttacaccaaatatgagaatgtggagaaagccaaagcctttttcgataagttccagagcatccgcttcaacacccgggcaaactacttcgagttcgaggtgaaaaagtactctgatttcaaccctaaagccgaagacacaaagcaagagtggatgatctgcaccttcggcgagcggatcgagaccaagagacagaaggaccagaacaacaatttcgtgagtacaaccatcaacctgaccgagaaaacagaggattttttcggaaagaacaacatcgtgtacggcgacgggaactgtatcaaaaagcagatcgccgccaaggaagacaaggacttcttcgagaccctgctgtattggtttaagatgacactgcagatgagaaactcagtgacaggaaccgatgaggactacctgatcagccccgtgatgaacgccgatggcatcttctacgacagcaggaaagccgacaacaacctgccaaaggatgccgacgccaacggcgcttatcacatcgctaaaaagggactctggatactggaacagatcaataagcccaagaccacagaagaactgaaaaagatcaagctggccatttccaataaggagtggctgcagtacgtccaggaatga

SEQ ID NO: 83 - DNA, 3825 bp, synthetic construct
  source 1..3825: mol_type = other DNA
atgaataccacatacaccaacctgtttgctctgagcaagacactgcggttcgaactgatccctcagggcaagaccctgcactttatccaggagaagggcctgatcacaaacgacaacaagcgcgccgagtcctaccagaagatgaagaagaccattgacgagttccacaagtatttcattgacctggccctgaaaaatgtgcgcctgtcctttctcgaggactatctggacctgtacaatcagagcgccgattacaaaaaggagcccaagttcaaggaggaactgaagaaagtccaggacaacctgagaaaggagattgtgctgagcttcagtaaggatgaggcaaagacaatcttctccattctggataagaaagagctgataaccgaggaactggagaagtggttcgaaaaccaggagaaaaaggacctgcacttcgacgacaagttcaaaacattcactacctacttcaccgggttccaccagaatcggaagaacatgtattcttcagaacccaattccaccgccatcgcctaccggttgatccacgaaaacctgccaaaatttctggaaaacgctaaggccttcgaacgcattaagcaggtgcctgagctgcagctgaaaatcgaaaagatctacaaggatttcgagctgtatctgaatgtcaactctatcgaggaactgttcgagctgaattacttcaatgacgtgctgacccagatgggaatcgacgtgtataacaatatcatcggcgggcggacagaaacagatggcaagccaaaaatccagggactgaacgagatcatcaacctgtacaaccagaccaagtccaaaaacgagagactgcccaagctgaagcagctgtataaacagatcctgagcgaccgggtgtccctgtcatttctgcctgacgccttcacagacggaaaacaggtgctgcaggccatcttcgccttctataaagtgaacattctgtcctatacgatcgacggccaggccgagagcaagaatctgctggagctgattcagcagctcctggccaacatctcttccttcgagacagagcggatccacctgaagaacgacaccaatctgacaaccatctcccagcagctgttcggagacttttctgtgttcagcacagccctgaactactggtacgaaaccaaagtgtaccccaagttcgaagcagagtataccaaggccaccgagaagaagagggaaacgctggagaagaccaaagccgtgtttaccaagcaggattacttttctattgcctttctgcaggaaatcattactgagtatagtctgtcactggataaggactcagagctgatcactaaaatcacccccacatgtgtggccgactacttcaaaaatcacttcgtggccaagaaggagaacgagaccgataaaaccttcgggttcctggctaacatcacagccaagtaccagtgcatccagggtactctggaaaatgccacaaactataacgaggagctgaagcaggatcagaagctgattgatgacatcaagctgttcctggataccctgctggaactgctgcacttcatcaagccactgcacctcaagagcgactccatcactgaaaaagacaacgcattttacgacctgttcgagaattactacgaggcactgtctctgctgacccccctgtacaacatggtcagaaattacgtgacacagaagccatatagcaccgagaaaattaagctgaatttcgaaaacgcccagctgctgaacggatgggacgttaacaaggaggccgattacctcaccaccatcctgaagaaggagggaaactactttctggccattatggataagaaacacaacaaggcttttcagaagtttcccgagggcgagaacaactacgagaagatgacctataagctgctgccaggcgtgaacaagatgctgcccaaggtgtttttcagcaacaagaatatcgcatacttcaatccttccaaggagctggtggagaattataagaacgagacccataagaaaggcgagaaatttaacctgctgcattgcaggcagctgatcgatttctttaaggactcaatcaacaagcatgaggattggaaacactttgatttccagttcagcgagaccaaaagctaccaggatctgagcggcttttaccgggaggtggagcatcagggctataaaattaacttcaaaaacatcgacagtgcctatatcgacagcctggtgaatgaggggaagctgtttctgttccagatctataacaaggacttttctccattctctaaggggaagccaaatatgcacaccctgtactggaaagccctgtttgaggaccagaatctgaagaacgtgaagtacaagctgaacgggcaggctgagatctttttcagaaaggccagcatcaaaccggagaacatcatcactcacaaggcaaaccagtctatcaaagcaaagaatcccctgacccctgacgccaaaaatactttcgattacgacctgatcaaggataagaggtacacagtggacaaattccagttccacgtgcctatcaccctgaactttaaggccaccgggggatcttttatcaaccagaatgtgctggaatacctgaaagagaaccctgaggtcaagattatcggactggacaggggcgagcgccacctcgtgtatctgaccctgatcgaccagcagggtaatattctgaagcaggagtccctgaacactatcactgatgcaaagatcgccaccccttatcaccagctcctggacatcaaggagaaggagcgggactttgccaggaagaattggggcaccgtggagaacatcaaggagctgaaagagggatatatctcacaggtggtgcataaaatcgctaccatgatggtggaggagaacgcaatcgtggtcatggaggacctgaactttggcttcaagcgcggaagattcaaggtggaaaagcagatctaccagaagctcgaaaagatgctgatcgacaaactgaattacctggttctgaaagacaagcagcccaccgagctcggcgggctgtacaacgccctgcagctgacaaacaagtttgagagcttccagaagatgggaaagcagagtggcttcctgttctacgtgcctgcttggaacaccagcaaaattgatcccacaaccggcttcgtgaactactttttcacaaaatatgagaatgtggacaaggccaaggtgttcttcgacaagtttcagtctatcagatacaatacaaaggccaactacttcgagtttgaggtgaagaaatattccgacttcaaccctaaggccgaagggaccctgcaggagtggaccgtctgtagctacggcgaacgcattgagaccaaacggctgaaggaccagaataacaacttcgtgtccacacctatcaacctgaccgagaaaatcgaggacttcctgggcaggaacaacatcgtgtacggcgacggcacatgcatcaaaagccagattgcagagaagaatgcaaaggagttctttgaaggactgctgtactggttcaaaatgactctgcagatgagaaacagcgccaccggaacagacgaggattacctgatttctccggtgatgaatgcccagggcgagttctacgactccaggaaggccgacgaaaccctgcctaaggatgccgacgctaatggcgcttaccacatcgccaagaaaggactgatgtggctggaacagatcaagagcttcgacggaaatgactggaagaagctggagctggacaaaagcaataggggatggctgcagtacatccagcagaggaagtga

SEQ ID NO: 84 - DNA, 36 bp, synthetic construct
  source 1..36: mol_type = other DNA
ggctacaaaaccttttaaatttctactattgtagat

SEQ ID NO: 85 - DNA, 35 bp, synthetic construct
  source 1..35: mol_type = other DNA
gctacaaaaccttttaaatttctactattgtagat

SEQ ID NO: 86 - DNA, 36 bp, synthetic construct
  source 1..36: mol_type = other DNA
atctacaatagtagaaatttagtttgtctttaaaac

SEQ ID NO: 87 - DNA, 36 bp, synthetic construct; identical to SEQ ID NO: 86
  source 1..36: mol_type = other DNA

SEQ ID NO: 88 - DNA, 36 bp, synthetic construct
  source 1..36: mol_type = other DNA
gtttttaagaccaattaaatttctactattgtagat

SEQ ID NO: 89 - DNA, 36 bp, synthetic construct; identical to SEQ ID NO: 88
  source 1..36: mol_type = other DNA

SEQ ID NO: 90 - DNA, 36 bp, synthetic construct
  source 1..36: mol_type = other DNA
atctacaatagtagaaatttaaaaggtcttgaaaac

SEQ ID NO: 91 - DNA, 36 bp, synthetic construct; identical to SEQ ID NO: 90
  source 1..36: mol_type = other DNA

SEQ ID NO: 92 - RNA, 36 nt, synthetic construct
  source 1..36: mol_type = other RNA
ggctacaaaaccttttaaatttctactattgtagat

SEQ ID NO: 93 - RNA, 36 nt, synthetic construct
  source 1..36: mol_type = other RNA
gttttaaagacaaactaaatttctactattgtagat

SEQ ID NO: 94 - RNA, 36 nt, synthetic construct
  source 1..36: mol_type = other RNA
gtttttaagaccaattaaatttctactattgtagat

SEQ ID NO: 95 - RNA, 36 nt, synthetic construct
  source 1..36: mol_type = other RNA
gttttcaagaccttttaaatttctactattgtagat

SEQ ID NO: 96-99 - skipped (4 entries)

SEQ ID NO: 100 - protein, 1262 aa, synthetic construct
MKEIKELTGLYSLTKTIGVELKPVGKTQELIEARKLIEQDDQRAEDYKIVKDIIDRYHKDFIDKCLNCVKIKKDDLEKYVSLAENSNRDAEDFDNIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNTISEIGVNEYFSGIEAEFTDTLDGKHLVDFFQVDYFNNTLTQKKIDNYNYVVGAVNKAVNLYKQQHKNVRIPLLKTLHKMILSDRVTPSWLPERFECDEEMLTAIKAAYESLKEVLVGDDDDSLRNLLLNIDNFDLEHIYIAKDSGLTSISQQIFGYYDTYTLAIKDQLQRENPNLYDERIDKLYKKEGSFSIAYLNRLVDTKEHITINEYYRLLGSYCREEGKRKDDFFKQIDGAYCAISHLFWGKHGEIAQSDSDIELIQKLFDDYKGLQRFIKPLLGHGDEADKDNEFDAKLRKVWDELDIITPLYDKVRNWLSRKIYNPEKIKLCFENNGKLLSGWSDNQTKSDNGTQYGGYIFRKKNEIGEYDFYLGISADAKLFRRDENICYEDGMYERFDYYHLTPNTLLGKSYIGNYGEDSKAVLSAFNAAITKLQLEKKLVPKDNEKVPTYLKRLKQNYANFYQILMNDDNVVDAYKSMKQHIFATLTSLIRVPAAIELATQTDLDIDELIDEILNLSSESFGYFPVATAAIEEANKREKKPLFLFKMSNKDLSYAAKSSEGLRKSRGTENLHTMYLKALLGMTQNVFSIGSGMVFFRHKTKGLAETTARHKANEFVANKNKLNDKKKSIFAYEIVKNKRYTVDKYLFKLSVKLNYSQPNNNKIDVNSEVREIISNGGIKHIIGIDRGERNLLYLSLIDLKGNIVMQKSLNILKNEHNVKGTDYKGLLTEREGERQDARRNWKKIANIKDLKRGYLSQVVHIISKMMVEYNAIVVLEDLNPGFIRGRQKIERNVYEQFERMLIDKLNFYVDKHKDANETGGLLHALQLTSEFENFKKSEHQNGCLFYIPAWNTSKIDPATGFANLFDTRYTNAVEAQKFFSKFDEIRYNEEKDWFEFEFDYDKFTQKAHGTRTKWTLCTYGMRLRSFKNPAKQYNWDSEVVALTDEFKRILGKAGIDIHENLKDAICNLEGKKDLEPLMQFMKLLLQLRNSRKNPEEDYILSPVADENGIFYDSRSCGDTLPKNADANGAYNIARKGLMLIEQIKNTEDLDTIKFDISSKAWLNFAQQKPYKNG

SEQ ID NO: 101 - protein, 1276 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNQITESFKKNPLFVGLFKKELITNYLPNFVSEEERVVVNKFSKFTTYFDAFNDNRKNLYSGDAKSGTIAYRLIHENLPMFLDNIASFNKISETGVNKYFSDIENEFTAILYEMHLSDLFQIDYFNNTLTQKKIDNYNYIVGAVNKAVNLYKQQHKTVRVPLLKTLHKMILSERVTPSWLPERFESDEEMLTAIKETYESLKDVLVGGNDDSLRNLLLNIDNFDLEHIYIANDSGLTSISQQIFGYYDTYTLAIKDQLQRENPATKKQRENPATKKQRENPNLNDDCIDKLYKKEGSFSIAYLNRLVDTKEHITINEYYRLLGSYWREEGKRKDDFFKQIDGAYSDMLYLFSTEHGEIAQSDSDTAVVQQLLEAYKGLQRFIKPLLGHGDEADKDNEFDAKLRKVWDELNIITPLYDKVRNWLSRKIYNPEKIKLYFENNGKLLSGWSDSQTEKDNGTQYGGYIFRKKNEIGEYDFYLGISTDAKLFRRDETICYEDGMYERFDYYHLKPTTLLGKSYIGNYGEDSNAVLSAFKNAVTKLHLEKKLVPKDNEKVPTYLKRLKQKYANFYQILMNDVNVVDAYKSMKQHILATLASLIRVPAAIELAAQTDLDIDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFVANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMLVEYNAIVVLEDLNPGFIRGRQKIERNVYEQFERMLIDKLNFYVDKHKDINEVGGLLHAFQLTSEFKKFKKSEYQNGCLFYIPAWKTSKIDPATGFANLLDTRYTNADKALEFFRKFDAIRYNEEKDWFEFEFDYDKFTQKAHGTRTKWILCTHGKRLRFKRNSTRVQEVVVLTDEFKKILGEAGIDIHVNLKEAICNLEGKKNLEPLMQFMKLLLQLRNSKAGTDEDYILSPVADENGIFYDSRSCGEQLPENADANGAYNIARKGLMLIRQIKEAKELDKVKFDISNKAWLNFAQQKPYKNG

SEQ ID NO: 102 - protein, 1271 aa, synthetic construct
MKEIKELTGLYSLTKTIGVELKPVGKTQELIEARKLIEQDDQRAEDYKIVKDIIDRYHKDFIDKCLNCVKIEKDDLEKYVSLTENSNREAVDFDNIKTKMRNQITESFKKNPLFVGLFKKELITNYLPNFVSEEERVVVNKFSKFTTYFDAFNNNRKNLYSGDAKSGTIAYRLIHENLPMFLDNIASFNKISETRVNEYFSSIEAEFTDTLNGKHLADLFQIDYFNNTLTQKKIDNYNYIVGAVNKAVNLYKQQHKNIRIPLLKKIHKMILSDRVTPSWLPERFESDEEMLTAIKAAYESLKEVLVGDDDDSLRNLLLNIDNFDLEHIYIAKDSGLTSISQQIFGYYDTYTLAIKDQLQRKNPATKKQRENPNLYDERIDKLYKKEGSFSIAYLNRLVDTKEHITINEYYRLLGSYCREGGKSNDDFFKQIDGAYSAISYLFSAEHGEIAQSDSDTAVVQKLLEAYKGLQRFIKPLLGHGDEADKDNEFDVKLRKVWDELNIITPLYDKVRNWLSRKIYNPEKIKLYFENNGKLLSGWSDSQTEYDNGTQYGGYIFRKKNEIGEYDFYLGISADAKLFRRDETICYEDGMYERLDYYNLKPNTLLGNSYIGNYGEDSNAVLSAFNDAVTKLHLEKKLVPKDNEKVPTYLKRLKQDYANFYQILMNDNNVVDAYKSMKQHILATLASLIRVPAAIELTTQTNLDIDKLIDEIINLPSESFGYFPVATAAIEEANNREKKPLFLFKMSNKDLSYAEKFSKGDRKSRGTENLHTMYLKALLGMTQNVFSIGSGMVFFRHNTEGLAETTARHKANEFIANKNKLNDKKKSIFDYEIVKNKRFTVDKYLFHLSLKLNYTQPNKFDINSKVREIIRNGGIKHIIGIDRGERNLIYLSLIDMEGNIVMQKSLNILKDDHNAKGTDYKGLLTEREGENKEARRNWKKIANIKDLKRGYLSQVVHIISKMMVEYNAIVVLEDLNPGFIRGRQKIERNVYEQFERMLIDKLNFYVDKHKDANETGGLLHALQLTSEFKNFKKSEHQNGCLFYIPAWNTSKIDPATGFVNLFDTRYTNAEKALEFFRKFDAIRYNEEKDWFEFEFDYDEFTQKAHGTRTRWTLCTHGKRLRSFRNPAKQYNWDSEVVALTDEFKRILGEAGIDIHENLKDAIRNLEGKRRKYLEPLMQFMKLLLQLRNSRKNPEEDYILSPVADENGVFYDSRSCGDTLPKNADANGAYNIARKGLMLIRQIKEAKELGKVKYDISNKAWLNFAQQKPYKNE

SEQ ID NO: 103 - DNA, 3789 bp, synthetic construct
  source 1..3789: mol_type = other DNA
atgaaggagataaaagagctcactggcctttattcccttaccaagacaatcggcgtcgagctaaaacctgtagggaagacacaggagctgattgaggcccgaaaactcatagagcaggatgaccaaagagcagaggattacaagatagtaaaggacatcatcgatcgctatcataaggactttattgacaagtgcttaaactgtgtcaagataaaaaaggacgatttagagaagtacgtctcgctggcggaaaactccaaccgtgatgccgaggattttgacaacataaagaccaaaatgcggaatcagatcacggaggcttttcgaaagaactcactgtttacaaacctcttcaagaaaaacctcattaaggagtatctccccgctttcgtttctgaggaggagaaatcagtggtgaataagttttcgaagttcacaacctatttcgatgctttcaacgataaccgtaaaaacctgtacagcggcgacgccaaatctgggaccatagcttatcgtctcatccatgaaaaccttccaatgtttctcgacaatatcgccagttttaacactattagcgagatcggtgtgaacgaatatttcagcggcattgaagcagagtttacagataccctggatggcaagcatctggtcgattttttccaggtcgattacttcaacaatacacttacgcagaaaaagatcgataactacaattacgtggttggggccgtcaacaaagctgtgaatctgtataagcagcaacacaagaacgttcgtattcccttgttaaagacgctccataaaatgattcttagtgacagagtgactccgtcatggctgcccgagcggtttgaatgcgatgaggagatgctgaccgccattaaagccgcatacgagagtctaaaagaagtgctcgtgggcgacgatgatgacagtctgcgcaatctgctgctcaatatcgacaactttgaccttgaacatatctatattgcgaaagatagcgggttaacctctatcagccagcagattttcggttattatgacacctacacactggccatcaaagatcagcttcaacgagagaaccccaatttatacgacgaaaggattgacaaactctacaaaaaggagggctctttttctattgcctatttgaacaggctggtggataccaaggagcatataacaatcaacgagtactataggctgttaggatcatattgtagggaagaggggaagagaaaagatgactttttcaagcaaatcgacggggcttactgtgcaatttcccatttgttttggggtaagcatggtgagatcgcacaatcagactcagacatagaactcatccagaaactatttgatgactacaaaggactgcagagatttatcaagcctctgctcggccacggagatgaggctgacaaggataacgaatttgatgctaaattgcgaaaagtctgggacgaattggatattatcaccccattgtatgacaaagtcagaaattggctttccagaaaaatctacaacccggaaaagatcaaattgtgcttcgagaataacggcaagttactgtctggctggtctgataatcaaactaaaagcgataacgggactcagtatggaggctatatttttcggaagaaaaacgaaatcggggagtacgacttctatctgggcatctccgcggacgcaaaactcttccggcgcgatgagaacatctgctatgaagatggcatgtacgaaagattcgattactatcacctgactccaaacaccctgcttggtaaatcatacatcggaaattatggggaggatagcaaagcagtactatcagccttcaatgcagccataactaaactacaactggagaagaaactggtacccaaagataatgagaaagtacctacataccttaagcggctgaagcagaattacgcaaatttctaccaaatcctgatgaatgacgacaatgtggtggatgcttataaaagcatgaaacagcacatcttcgccacgctcacctcccttatccgcgtccctgcagctattgaactcgccacccagactgacctggacattgacgagctgatcgacgaaatcttgaatttgagcagtgagtctttcgggtacttcccagtggccaccgccgctattgaggaagccaacaaaagagaaaaaaagccgctgttcctcttcaagatgagtaataaagacctatcatacgccgcaaagtcctctgaaggattgagaaagagtaggggaaccgagaacctgcatactatgtatctgaaagcgctactggggatgacacaaaacgtgttcagcattgggagcggtatggtcttcttcaggcacaaaacaaaaggcctggcggaaactacggctaggcacaaagccaatgagttcgtggccaacaagaataagctcaatgataagaagaagagcatcttcgcttacgaaattgtcaagaataaacggtatactgtagataagtacctcttcaaactgtcagtcaagctgaattactcccagcccaacaataataagatcgatgtgaattccgaggtgcgggaaataatctctaatggaggtattaagcacattatcggaatcgataggggagagaggaatcttctctatcttagcctgatcgacctaaaaggaaatattgtgatgcagaagtccctcaacattttaaagaacgaacataacgtgaagggcacagactacaaaggccttttaacagaacgcgaaggcgaacgccaggatgccagacgcaattggaagaaaattgcgaacatcaaggatctgaagaggggctacttgagtcaggttgtgcacattatcagcaagatgatggtggagtacaatgcaatagttgtgttagaagacttgaaccccggattcatacgaggacgccagaagatagaaaggaacgtttacgagcagtttgagcggatgctcattgacaagcttaacttttacgttgacaagcacaaggacgccaacgaaacaggtggcctgttgcacgctctgcagttgacgtctgagtttgagaattttaagaagtctgaacaccagaacggctgcctattctatatccctgcctggaacacttccaagatcgaccccgccaccggatttgctaatctgttcgacactcggtacaccaatgccgttgaggcgcagaagtttttttccaaattcgacgaaattcgttacaacgaagagaaggattggttcgaatttgagttcgattacgacaaattcacacagaaggcacacggtacccgaacaaagtggaccctctgcacttatgggatgaggctgcggagctttaagaaccctgccaaacaatataattgggatagtgaggttgtggctttgacagacgaattcaagagaatactggggaaggctggaatcgatattcacgaaaacctgaaagacgccatttgtaacctcgagggtaaaaaggacctggaacctctgatgcagtttatgaagctgctgctgcagcttcgcaattctcggaagaacccagaagaggattacattctgtcgcctgtggcagacgagaatggcattttttacgactcccgcagttgtggcgacaccttgccaaagaatgccgacgccaatggggcatataacatcgcaagaaaagggctgatgctgattgagcagatcaaaaataccgaggacctcgacactatcaaattcgatataagctccaaggcttggctgaactttgctcaacagaagccatataagaatggatga

SEQ ID NO: 104 - DNA, 3831 bp, synthetic construct
  source 1..3831: mol_type = other DNA
atgaaggagattaaggaactgaccgggctgtacagcctcaccaagacaatcggggtggagctgaagcccgtggggaagacacaggagctgatcgaggccaaaaagctgatcgaacaggacgaccagcgtgccgaggactacaaaatagtgaaagatatcatcgaccggtaccacaaggacttcattgataagtgcctgaattgtgtgaagatcaagaaggatgacctggagaagtacgtcagtctggctgagaattctaacagagacgccgaggatttcgataatattaaaaccaagatgcggaatcagatcacagaaagcttcaagaagaacccactcttcgtggggctgtttaagaaggagctgatcacgaattacctgccaaacttcgtgagcgaggaggaaagagtcgtggtgaataaattcagcaagttcaccacctatttcgatgcctttaatgacaatcggaagaacctgtactccggcgatgccaagtccggcaccatcgcatatcggctgatccacgagaacctgcccatgtttctggacaatatcgccagcttcaacaaaatcagcgaaaccggcgtgaacaaatacttctcagacatcgagaacgagttcacagccatcctgtacgagatgcacctgtccgatctgttccagatcgactactttaataataccctgacccagaagaagattgacaactacaactacatcgtgggtgctgtgaacaaggccgtgaacctctataagcagcagcacaagaccgtgagggtacctctgctcaagaccctgcacaagatgatcctgtccgagcgggtgacacccagctggctgccagagcgcttcgaaagcgatgaggagatgctgaccgccatcaaagagacctacgagtccctgaaggatgtgctggtgggcgggaacgacgatagtctgcgcaacctgctgctcaacatcgacaacttcgacctggagcacatttacatcgccaacgatagcggcctgaccagcatcagccagcagatcttcgggtactacgacacttacacactggccatcaaggaccagctgcagagagagaatcctgccaccaagaaacagagagagaatcctgctaccaaaaagcagagagaaaatccaaacctgaatgatgactgcatcgacaagctgtataagaaggagggctctttcagcattgcctacctgaataggctggtggacaccaaggagcacatcaccattaacgaatattatcgactgctggggagctattggagggaggagggaaaaagaaaggacgacttcttcaagcagattgatggcgcctacagcgacatgctgtatcttttttccacagaacacggggagatcgcacagtctgacagcgacacagccgtggtgcagcagctgctggaggcctacaaggggctgcagagatttatcaaacctctgctgggccacggggacgaggctgacaaggataacgaatttgacgccaaactgaggaaggtgtgggatgaactgaatattatcacccccctgtacgacaaggtgaggaattggctgagcagaaaaatttataatccagagaagatcaagctgtactttgagaacaatgggaagctgctgagcgggtggtcagatagccagaccgagaaggacaacggcactcagtacggcggctacatctttcggaaaaaaaatgaaataggagaatacgatttctacctgggaatcagtaccgacgccaagctcttccgcagagacgagacaatctgctacgaggacggcatgtacgagaggtttgattattatcacctgaagccaaccacactgctcggcaagagctacattggcaattacggcgaggacagtaacgccgttctgagcgccttcaaaaacgcagtgaccaagctgcacctggagaagaagctggtccctaaggacaacgaaaaagtccctacctacctgaagaggctcaagcagaaatacgctaacttctaccagatcctgatgaatgatgtgaatgtggtggacgcctacaagtctatgaagcagcacatcctggctaccctggcttccctgatcagagtccctgccgccattgaactggcagcccagaccgacctggacatcgatgagctgatcgacgagatcatgaacctgccttctgagagcttcggatactttcccgtggcaaccgccgccatcgaggaagctaacaaaagagaaaagaagcccctgtttctgttcaagatgtccaataaagacctgagctacgccgctaagtcttccgagggccttagaaagagcagagggacagagaacctgcacacaatgtaccttaaggccctgctgggcatgacacagaacgtctttagcatcggctctggcatggtgttctttagacacaagaccaagggactggccgaaaccacagcccggcacaaggccaacgagtttgtggccaataaaaataagctgaacgacaagaaaaagagtatcttcgcttacgagattgtgaagaacaagagatttacagtcgacaagtacctgtttaagctgagcgtgaagctcaactactcccagcccaataacaacaaaatcgacgtgaacagcgaggtgagagaaatcatctctaacggcgggatcaagcacatcatcggcatcgaccggggggagcgcaacctcctgtacctgagcctgatcgacctgaagggcaatatcgtgatgcagaagagcctgaatatcctgaaagatgatcataacgcaaaaggaaccgactacaaggggctgctcactgagcgggagggcgagaggcaggacgccagacgcaactggaagaagatcgccaacatcaaggatctgaaaagaggatacctgtcccaggtggtgcatattatctccaagatgctcgtggagtacaacgctatcgtggtgctggaggacctgaatccaggctttattcggggacggcagaagatcgagagaaatgtgtacgagcagttcgagagaatgctgattgacaaactgaacttttatgtggataagcacaaggatatcaatgaggtgggcggactgctgcacgcttttcagctcaccagtgagttcaagaagttcaaaaaatcagaatatcagaatggctgcctcttctacatccctgcatggaagacaagcaagattgatccagctaccggcttcgctaacctgctggacacccgctacacaaacgccgataaggccctggagttttttcgcaagttcgacgccatcagatacaacgaggagaaagattggtttgagtttgagtttgactatgacaaatttacacagaaagctcacggcacacggaccaagtggattctgtgcacccatggaaagagactgcggttcaagagaaatagcaccagagtgcaggaagtggtggtgctgacagacgagtttaagaaaatcctgggggaggcaggaattgatatccacgtgaacctcaaagaagccatctgcaacctggagggcaaaaagaacctggagcccctgatgcagtttatgaagctgctgctgcagctgaggaatagcaaggccggcacagacgaggactacattctgtcccctgtggctgacgaaaacggcatcttttacgattccaggtcctgcggcgaacagctgccagagaacgctgacgctaatggcgcctataatatcgccaggaaggggctgatgctgattcggcagatcaaggaggccaaagagctggacaaagtgaagttcgacatcagcaacaaggcctggctgaactttgcccagcagaagccttacaagaatggctag

SEQ ID NO: 105 - DNA, 3816 bp, synthetic construct
  source 1..3816: mol_type = other DNA
atgaaagaaattaaagagctgaccggactgtactccctgaccaagaccatcggggtggaactgaagcctgtgggaaagacccaggagctgatcgaggcccgtaaactgattgagcaggacgatcagagagccgaggattacaagatcgtgaaagacatcatcgatagataccacaaggactttatcgataagtgtctgaactgtgtgaaaattgaaaaagacgacctggagaagtatgtgtccctgaccgaaaattccaacagagaggctgtggacttcgacaatatcaaaacaaaaatgaggaaccaaatcaccgagagctttaagaagaaccctctgttcgttgggctgttcaagaaggagctgatcacaaactatctgccaaacttcgtgtccgaagaggagcgggtggtggtgaacaagttcagtaagtttaccacatacttcgacgccttcaataacaaccggaagaatctgtactcaggcgacgccaagagcgggaccatcgcctataggctgatccacgaaaacctgcctatgtttctggacaacatcgccagcttcaacaaaatcagcgagacccgggtgaacgagtatttcagcagcattgaggctgagttcaccgacaccctgaatggcaagcacctggccgatctgttccagatcgattacttcaacaataccctgacacagaagaaaatcgataattacaattatatcgtcggcgccgtgaacaaggcagtgaacctgtataagcagcagcataagaacatcaggatcccactgctgaaaaaaatccacaaaatgatcctctccgacagggtgaccccttcatggctgcctgagcggttcgagtccgatgaggagatgctgaccgccatcaaagcagcctacgagagcctgaaggaggtgctggtgggcgacgacgatgactctctgaggaacttgctgcttaacattgataatttcgacctggagcatatctacatcgctaaggactccggcctgacctctatttcccagcagatttttgggtactatgacacatacactctggccatcaaagatcagctgcagagaaaaaatcctgccaccaagaagcagcgggaaaaccccaacctgtatgacgaaagaattgacaagctgtataagaaagagggaagcttttccatcgcctatctgaaccggctggtggataccaaggaacacattaccattaacgagtactataggctgctgggaagctactgcagggaaggaggcaagtccaatgatgatttctttaagcagatcgacggagcctattcagccatcagctacctgttctctgccgagcacggcgagatcgcacagagcgacagcgataccgccgtggtgcagaagctgctggaggcctacaaaggcctgcagcgcttcatcaagccactgctgggacacggggacgaagccgataaggacaacgagtttgacgtgaagctgcggaaggtgtgggatgagctgaacatcatcacgccactgtatgacaaggtgcgaaattggctgtctcgcaaaatttataatcccgaaaagatcaagctgtacttcgagaacaacggcaagctgctgtctggatggtccgatagtcagaccgagtacgacaacgggacacagtacggcggctatatctttaggaagaagaacgagatcggggagtacgacttctacctgggcatttccgccgacgccaagctgttcagaagggatgaaacaatctgttacgaagacggaatgtacgaacgcctggactattataatctgaaaccgaacaccctgctgggcaatagctacatcgggaactacggcgaggattcgaacgctgtgctgagcgcctttaacgatgccgtgaccaagctacacctggagaagaaactggtgcccaaagacaacgagaaggtgccaacttatctgaagaggctgaagcaggattatgctaacttctaccaaatcctgatgaacgataataacgtggtggatgcctataagagcatgaagcagcatatcctggccacactggcctcactgattagagtgcccgccgctatcgagctgactacacagaccaatctggatattgacaagctcatcgacgaaattatcaatctgcctagcgagagcttcgggtacttcccagtggccaccgcagcgatcgaggaggccaacaatcgggagaaaaagcctctcttcctgtttaaaatgtccaataaagatctgtcctatgccgaaaagttttccaagggcgaccggaaatcccgcggcaccgaaaacctgcacacaatgtacctgaaggccctgctgggaatgacacagaacgtgttctccatcggatccggcatggtgtttttccggcacaacactgagggtctggcagagaccacagcacggcacaaggccaatgagttcattgctaacaagaataagctgaacgacaagaagaagtccatctttgactatgagatcgttaagaacaaaaggttcactgtggacaaatacctgttccacctgtcactgaaactgaactacacccagcccaataagtttgacattaacagcaaggtgcgggagatcatccggaacgggggaatcaagcacatcattggaatcgatagaggcgagagaaacctgatctatctgtccctgatcgacatggaggggaatatcgtgatgcagaaatccctgaatatcctgaaagacgaccacaatgccaagggaaccgactacaagggactgctgaccgagagggagggggagaataaggaggctcggagaaactggaaaaagatcgccaacatcaaggatctgaaaagaggctacctgtcccaggtggtgcatattatcagcaagatgatggtcgagtataatgccattgtggtgctggaggacctgaacccaggcttcatcaggggacggcagaaaattgaaagaaacgtgtacgagcagtttgagcgtatgctgatcgataagctgaatttctacgtggacaagcacaaggacgccaatgagacaggagggctgctgcatgccctgcagctgacaagcgaattcaaaaacttcaagaagtctgaacaccaaaacggctgcctgttctacatccctgcctggaacacatccaagatcgacccagccacaggcttcgtgaatctgttcgataccaggtacactaacgccgagaaggccctggagttcttcagaaaattcgacgcaatccgatacaacgaggaaaaagattggttcgagttcgaatttgactatgacgagtttactcagaaggctcacggcacacgcaccaggtggaccctgtgcacccacggaaaacgcctgaggtccttccggaacccagccaagcagtacaactgggacagcgaagtggtggccctgactgacgagtttaagaggatcctgggcgaggcaggaattgatatccacgagaatctgaaggacgccatccggaatctggaagggaagcgccgcaagtacctggaacctctgatgcagtttatgaaactgctgctgcagctgaggaattcacgcaagaatcctgaggaagactatattctgagccccgtggccgacgaaaatggggtgttttacgatagcaggagctgcggggataccctgcccaaaaacgccgacgccaacggagcttataatatcgctaggaagggcctgatgctgatcaggcagatcaaggaagctaaggagctgggcaaggtgaaatatgatatctccaacaaggcctggctgaactttgcccagcagaagccatacaagaacgagtga

SEQ ID NO: 106 - DNA, 36 bp, synthetic construct
  source 1..36: mol_type = other DNA
atctacaatagtagaaattattagagcttactagcc

SEQ ID NO: 107 - DNA, 36 bp, synthetic construct; identical to SEQ ID NO: 106
  source 1..36: mol_type = other DNA

SEQ ID NO: 108 - DNA, 36 bp, synthetic construct
  source 1..36: mol_type = other DNA
ggctagtatgcttcaataatttctactattgtagat

SEQ ID NO: 109 - DNA, 36 bp, synthetic construct; identical to SEQ ID NO: 108
  source 1..36: mol_type = other DNA

SEQ ID NO: 110 - DNA, 36 bp, synthetic construct
  source 1..36: mol_type = other DNA
atctacgatagtagaaattatcaagtccgtatagac

SEQ ID NO: 111 - DNA, 28 bp, synthetic construct
  source 1..28: mol_type = other DNA
atctacgatagtagaaattatcaagtcc

SEQ ID NO: 112 - RNA, 36 nt, synthetic construct
  source 1..36: mol_type = other RNA
ggctagtaagctctaataatttctactattgtagat

SEQ ID NO: 113 - RNA, 36 nt, synthetic construct
  source 1..36: mol_type = other RNA
ggctagtatgcttcaataatttctactattgtagat

SEQ ID NO: 114 - RNA, 36 nt, synthetic construct
  source 1..36: mol_type = other RNA
gtctatacggacttgataatttctactatcgtagat

SEQ ID NO: 115-117 - skipped (3 entries)

SEQ ID NO: 118 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 119 - protein, 1323 aa, synthetic construct
MNDLSQFTNLYSLSKTLRFELKPIGKTLENIEKNGILERDNRRSIGYKSIKKVIDEYHKAFIDRVLNDYERKLDETGRIVWRDSLNELYRLYHLSSTEAKRNEEIRKTQEILRKQISECFKKDRQYSRLFGKELIREDLTEFVNTPLFEQYILSQKGNEDLSIDDVRHIQEDVIEDIAQFRDFTTYFSGFYENRRNMYVADDKATSIANRLIMENLPKFIDNIDVFERIAQSEVSGNLETLCKEMEAYLNVNSIAEIFCLDYFSMVLTQKQIDVYNAIIGGMSLEDGTKIKGLNVYVNLYNKKQKEKTCRLPKLKPLFKQILSERNAISWLPDEFTSDKELLESIEKCYQDLKNSVFEGKDSLMVLLKELGEYDLEHIYLHNDSQLTNIAQKQYGDWATIKRAFEESVKAATPAKRNETTEKYAARIEKILKATDSLSLSQINRMLKAYMGDDFKTIESYFTAMGAEDTVDGQKPNLFIRIENAYADVQPLLNTPYPEDKKLSQDKANVAKIKNLLDTIKDLLHFVKPLLGNGTKGEKDNRFYGEFIPLWELLDQITPLYNMVRNRLTKKECSDEKIKLFFENNNGRFLSGWTDNQTESDNGTQYGGYLFRKRNGIGEYDYYLGVSDAKKLFRSFKSVPDSDKSDYERLDYYQLKGKTFYGALYKGDYESESANIKRSIDYFISHNGNSEIKGKINTERRKQQPRISTAIGYLKFIRQHDFGLYKLLLQDAEFEKSNQEMIASIRETLLSLVRIPSAHEYADKTYTLFSNMMDDVEILLKSKVFSYFTVSQSELDEVLVREEKPLYLFKITNKDLSYAETHEKGLRKTRGTDNLHTLYFKALMSGNQSVFDIGSGAIFFREKKINYTDEQMRKGHHHEMLKDKFNYPIISNKRYAFDKFQFHLSISINYNADKNKDINPMVNAYLKESNSTHIIGIDRGERHLLYLSLIDLQGDIVEQYTLNEIGNTNYHDLLGIKEKQRKEARPNWMEIENIRELKEGYMSQVIHIIAQLMVKYNAIVVLEDLNMGFMRGRQKVEKQVYQKFEKMLIDKLNYLVDKQCNATELGGVLNAYQLTNTHKKFLEQYGNQKNALGKQCGFIFYIPAWNTSKMDPTTGFVNLLDTHYENMEKAKAFFGKFKSIRNNAAKGWFEFEFDYDNFTTKAADTRTPWTLYTHGTRIETKRDPKQKNNFVSEEFDLTSKFKELFVKYKIDLNDNLMEQICLQNDASFFKELLHLLQLTLQMRNSKIGTDVDYLISPVMNDKGKFYDSRNCGKNLPENADANGAYNIARKGLWIIDQIKRTDDLSRLRLAISNKEWLQYAQKMV

SEQ ID NO: 120 - DNA, 3972 bp, synthetic construct
  source 1..3972: mol_type = other DNA
atgaactcgatcgaacaatttaccggtctatattctctctcaaaaacgctgcgatttgaactgaaacccattggaaagacccaagaaaacatcgagaagaacggaatcctggagcgcgacaatgagcgggccgtagcgtacaaatcagtgaaaaagtacattgacgaataccataaggcgttcatcgaaagggttatgaatagcttccctcacaatttaagcgacgaagaacaggacatctgggaggaagctctaaataactattacacaagctaccacctgcccgcgacaaaccctcagcggaaagagacgttgaccgaagctcaagatacattgcgtaccctgatatcaaattctttccttcgcgatagacagtacaaacggctcttcgggaaagagctgttccaggaggaccttgctgagttcgtgaatacagccctgttcgaaacctacatcaggtcacagaaagggaataacaatctcaccgaggaggaagtgcggcagatccaggagaatactatacgggagatatccctgtttaggaacttcaccgtttacttttctgggtataatgagaacagaaagaatatgtacgtggccgacgataaggctacaagcattgccaatagaatgataaccgagaacttaccaaaattcgtggacaacatggaagttttcggcaaaatcgccgccagcgaagtggctaatcacttcgagactttgtacaagagcatggaggcttatctgaacgtgatttccattgacgagatgtttaaactggactattacccaatccttctaacgcagaagcaaattgacgtgtataacaccatcatcggaggtaaggtgttggaggacggttcaaaaatccagggcctgaatgaatacgtgaacctgtataatcagcaacagaaggacaaggctaatagactccctaagcttaaaccactgtttaagcagattcttagcgaacataatgcaatcagttggctgcctgacacattttctacagataatgagatgctagagagcatagaaaagtgctaccagaacttaaggactcaggtgttcgagggggaaatctctctcaaaaaacttctagacaacctcggggattacgacctggagcatatttacattccaaatgacttacagctgacgaacattgtgcagaaggtctacggagactggtccatggtgaagaaggcgatggaggaagatgtaaaggctaagaacccacaacgaaagaatgaaactggggaaaaatacgaggagagaattgtcaagattctgaaaagcgatgaatctttctccattgcacaaattaacaacctgctaaagccctatctgggggaaaagtatgtgccgctcgagaagtattttattacaaagggcgcagaggacaacaacaacgtgcagaagccgaacctgttcatccggatcgaaaatgcctatatcgaagctaagagcttactgaatactcaatatcccaaagaccgcacaatgagtcaggacaagcaaaatgttgaacgtatcaaaatcctcctggatgcaatcaaggatctgcagcattttgttaaacccctgctcgggaagggaagcgagggacagaaagataataccttttatggggagtttatccccctgtgggaggccctggatcagataacgcccctttacaatatggtccgcaataggatgacccagaagccatacagtgacgataaaataaagctcttcttcgagaataacggctcgtttcttaacggctgggtggactcgaaaactgagtccgataacgctactcagtacggcggatacttgtttcggcgcaagaactccataggcgagtacgattattatctcggcatcagctcagccacaaaattattccgatccttcaaccatgttagcgaaagtgacaagagtatttttgaacggctggactactatcaattaaaagggaagaccttctatggcgcactgtacaaaggtgactacgaaaaagaatcatcggcaatcaaactcgccatagacaagttcatcacaaataacggcaataccatcatcagggaaaagataaacacagagaagcgaaaaagacagcctaaggtcagtaccgccattgggtatttgaagtttctgcggcaacagggtgttgagctatttgacagtctactgaaagatggctgttttgaagagagtaaccaggcaatgatcacttctatcaaggccactcttgcctctatggccagaattcctaacgcccaggattacgctcacaaagattactcattattctcagacgctatggacgatgtggaggagctgctgcaggatgttatcttctcctacttccccatctcccaaaaggaaatggacaaagtgttggaaagggaagagaagcctatgtacctttttaagatcaccaacaaggatctgtccttcgccgagacgcatgagaaaggattaaggaaaagtcggggtactgacaacctccatacaatgtatttcaaagcactcatgtccggaacccaaaacgtctttgatataggctccggcaccgtgtttttcagagagcggaagattgtctatagcgaggagcaactgggtaagggacatcatcacgagatgctcaaggacaaattcgactaccctattatctctaacaagcgctatgcatacgataagtttcagttccacctctccattaacatcaactataaggcagacaaacacaaggatattaacctccttgtaaacgaatatctcaaggagagtaaagtcactcacatcatcgggattgacagaggggagaggcaccttttgtatttgtccgtcattgatctccagggtaatattgttgaacaatactctctcaacgagatcgtgaatgagtacaacgactgcaattatagaaccaattaccatgatctgctggatatccgcgaaaaacagagggacgaggcacgacgctcttggttgaccatagagtcaattaaagagctcaaggagggctatatgagccaggtagttcaccttatcgcgcagcttattgtgaaatataatgctatcgtcgtgctggaagatctcaacactggttttattcgtggaagacagaaggtggaaaagcaggtgtaccagaagtttgagaaaatgctgatagataagctgaattatctggtcgataagaagaaagatatctacgatctcgggggtgcactgaatgccttgcagttgaccaacaagttcgaaagcttccagaaaataggcaagcagtgtggcttcctgttttacgtaccagcctggaatacctctaaaatggacccgacaaccggatttgtaaacatgttggatacacggtacgaaaatatggataaggccaaagcgttctttgccaagtttagatcaattaggcagaacgtatctaaaggctggttcgaatttgccattgactacaacgattttactagcaaagccgcaggcactaaaacacagtggacgctttgtacatatggaactcgtattgagacaaagcgtgataccaagcagaataataatttcgtgtctgacgagtttgacttgaccgataagttcaaagtgctgttcaacaagtacaatatcgatgtcaacggaaacttgatggaacaaatctgcagccagaacgacgcaacgttttttaaggagctgctgcacatgctgcacctgacattacaaatgcgcaactccattaccgggactgaggtcgattatctcataagcccagtcatgaacgcttcaggcaaattctatgacagtcgaacctgcgaaaataatttgcccaagaacgctgacgccaatggagcgtacaatatcgccaggaaaggcctgtggatcgtggagcagattaaacactccgacaatatctccaaactgaagattgctatatctaataaggagtggcttcgctatactcagggactcgtcgattga

SEQ ID NO: 121 - DNA, 3972 bp, synthetic construct
  source 1..3972: mol_type = other DNA
atgaacgacctgtcccagtttacaaacctgtattcactgagcaagacactgaggtttgaactgaagcccatcgggaagaccctggagaacattgaaaagaacggcatactggagagggacaatagacgatctatcggctataagagcatcaagaaggtgatcgacgagtaccacaaagccttcatcgacagagtgctgaacgattacgaaaggaagctggacgaaaccggtaggattgtgtggagggatagcctgaacgagctctacagactgtatcacctgagcagcaccgaggccaaacgcaatgaggagattcggaagactcaggagattctgaggaaacagatcagcgagtgctttaagaaggacaggcagtattctagactgttcggcaaggagctgatcagagaggacttgaccgagtttgtgaacacaccactgtttgagcagtacattctgagccagaagggcaacgaggatctgtcaattgacgacgtgagacatatccaggaggacgtgattgaggacattgcccagtttcgcgactttaccacgtatttttccggcttctatgagaacagacgcaacatgtacgtggccgatgataaggctacctccatcgccaatcggttgattatggagaacctgcctaagttcattgataacatcgacgtgttcgaaagaatcgcccagtctgaagtgtctggcaacctggagacactgtgcaaggagatggaggcctacctgaatgtgaatagcatcgccgagattttctgtctggactacttcagtatggtgctgacacagaaacagatcgacgtgtacaatgcaattatcggaggaatgtcactggaggacgggaccaaaatcaaaggcctgaacgtgtatgtgaatttgtacaacaagaagcagaaggagaagacatgcagactgcccaaacttaagccactgtttaaacagatcctgtcagagaggaacgccatcagctggctgcccgacgaatttacaagtgacaaagagctgctggagtcaatcgagaagtgctaccaggatctgaagaacagtgtgtttgaaggcaaagacagcctgatggtcctgctcaaggagctgggggagtatgacctggagcatatctacctgcataatgacagccagctgactaacattgcccagaagcagtacggcgactgggccaccatcaagagggctttcgaggagagtgtgaaggccgcaacccctgccaaacggaacgagaccaccgaaaagtacgctgccaggattgagaagattctgaaagccaccgattccctgagcctgagccagatcaacaggatgctgaaggcctacatgggcgacgacttcaagaccattgagagctacttcaccgccatgggagccgaggataccgtggatggccagaaaccaaacctgtttatccggatcgagaacgcctacgccgacgtccagcctctgcttaataccccttacccagaggacaaaaagctgtcccaggataaggccaatgtggccaaaatcaagaatctcctggacactatcaaggacctgctgcacttcgtgaaacccctgctgggcaatggcacaaagggggagaaagacaaccgcttctacggagagttcattcccctgtgggagctgctggaccagatcacccccctgtacaacatggtgcgcaatagactgacaaagaaggagtgctccgacgagaaaatcaagctgttctttgagaacaataatggcaggttcctgagcggctggaccgacaaccagaccgagagcgacaatgggacacagtatggcggctacctgtttagaaagaggaatggaatcggtgagtacgactactatctgggcgtgagcgatgccaagaagctgttcagatcctttaagtctgtgccagattccgataagtccgattatgagaggctggactactaccagctgaaaggcaaaactttttacggcgccctgtataagggggactatgaaagcgagtcagccaatatcaagcggagcatcgattatttcatcagtcacaacgggaatagcgagatcaaaggcaagattaataccgagcggcgtaaacagcagcctaggatctccaccgccatcggatacctgaagtttattaggcagcacgactttggcctgtataagctgctgctgcaggacgccgagtttgagaagagtaaccaggaaatgatcgcttccatcagggagaccctgctctccctggtgaggatcccctctgctcacgagtatgccgacaagacctataccctgtttagcaacatgatggacgatgtggagatcctgctgaaaagtaaagtgttcagctatttcacagtgtctcagagcgagctggacgaggtgctggtgagagaggagaagcctttgtacctgttcaagatcaccaataaggacctgagctacgccgagactcatgaaaaaggccttaggaagactcgcgggacagataacctgcacaccctgtactttaaggccctcatgagcgggaaccaatccgtcttcgatattggcagcggagccattttcttcagggagaagaagattaattacaccgacgaacagatgcggaaagggcaccaccacgagatgctcaaagacaagttcaattaccctatcattagtaacaaaaggtacgccttcgacaaattccagtttcacctgtcaatcagcattaactacaacgccgataagaacaaggatattaaccccatggtgaatgcttacctgaaggagtcaaactccacacacatcattgggattgataggggcgagaggcatctgctgtacctgagcctgattgatctccagggggatatcgtcgagcagtacactctgaacgagatcggcaacacaaactaccacgacctgctgggcatcaaggagaagcagaggaaggaggccaggcccaattggatggagatcgagaacatccgcgagctgaaggaggggtacatgagccaggtgatccacattatcgctcagctgatggtcaaatacaacgctattgtggtgctcgaagacctgaatatgggcttcatgcggggccggcagaaggtggaaaaacaggtgtatcagaaattcgaaaagatgctgatcgacaagctgaattacctggtggataagcagtgtaatgccaccgagctgggtggggtgctgaatgcttaccagctgaccaatacacacaagaagttcctggagcagtatggcaatcagaaaaatgcgctgggtaagcaatgcggcttcatcttctacatccccgcttggaacactagcaagatggaccccaccacaggcttcgtgaatctgctggatacccattatgagaacatggagaaagccaaagccttcttcgggaaattcaagagcatcagaaataacgccgccaagggatggtttgagttcgagttcgactacgataacttcaccaccaaggccgccgatacaagaactccttggaccctgtatacccatgggaccagaattgagactaagagggaccctaagcagaagaataacttcgtgagcgaggagttcgacctgaccagcaaattcaaggagctgtttgtgaaatacaagatcgatctgaatgataatctgatggagcagatctgcctgcagaacgacgcctcattctttaaagagctgctgcacctgctgcagctgaccctgcagatgagaaacagcaagattggcaccgatgtggattacctgatcagtccagtgatgaacgataaggggaaattctatgactcccgcaattgtgggaagaatctgccagagaatgctgatgccaatggcgcctataatatcgccagaaagggactgtggattattgatcagattaaacgcaccgatgacctgtcaaggctgagactggccatctctaacaaagagtggctgcagtacgcccagaaaatggtgtga

SEQ ID NO: 122 - DNA, 36 bp, synthetic construct
  source 1..36: mol_type = other DNA
ggctataggccaaacataatttctactattgtagat

SEQ ID NO: 123 - DNA, 36 bp, synthetic construct; identical to SEQ ID NO: 122
  source 1..36: mol_type = other DNA

SEQ ID NO: 124 - DNA, 36 bp, synthetic construct
  source 1..36: mol_type = other DNA
atctacaatagtagaaattatgtgtggttttacacc

SEQ ID NO: 125 - DNA, 36 bp, synthetic construct; identical to SEQ ID NO: 124
  source 1..36: mol_type = other DNA

SEQ ID NO: 126 - RNA, 36 nt, synthetic construct
  source 1..36: mol_type = other RNA
ggctataggccaaacataatttctactattgtagat

SEQ ID NO: 127 - RNA, 36 nt, synthetic construct
  source 1..36: mol_type = other RNA
ggtgtaaaaccacacataatttctactattgtagat

SEQ ID NO: 128 - protein, 1332 aa, synthetic construct
MNXJXQFTXLYSLSKTLRFELKPIGKTXENIEKNGILERDNXRXXXYKSXKKXIDEYHKAFIXRVXNXXXXXLXXXXXXXWXXXLNXXYXXYHLXXTXXXRXEXJXXXQXXLRXXISXXFXXDRQYXRLFGKELXXEDLXEFVNTXLFEXYIXSQKGNXBLXXXXVRXIQEBXIXXIXXFRBFTXYFSGXXENRXNMYVADDKATSIANRXIXENLPKFXDNXXVFXXIAXSEVXXXXETLXKXMEAYLNVXSIXEXFXLDYXXXXLTQKQIDVYNXIIGGXXLEDGXKIXGLNXYVNLYNXXQKXKXXRLPKLKPLFKQILSEXNAISWLPDXFXXDXEXLESIEKCYQBLXXXVFEGXXSLXXLLXXLGXYDLEHIYJXNDXQLTNIXQKXYGDWXXXKXAXEEXVKAXXPXXXNETXEKYXXRIXKILKXXXSXSJXQINXXLKXYXGXXXXXJEXYFXXXGAEDXXBXQKPNLFIRIENAYXXXXXLLNTXYPXDXXXSQDKXNVXXIKXLLDXIKDLXHFVKPLLGXGXXGZKDNXFYGEFIPLWEXLDQITPLYNMVRNRXTXKXXSDXKIKLFFEXNNGXFLXGWXDXXTESDNXTQYGGYLFRXXNXIGEYDYYLGXSXAXKLFRSFXXVXXSDKSXXERLDYYQLKGKTFYGALYKGDYEXESXXIKXXIDXFIXXNGNXXIXXKINTEXRKXQPXXSTAIGYLKFJRQXXXXLXXXLLXDXXFEXSNQXMIXSIXXTLXSXXRIPXAXXYAXKXYXLFSBXMDDVEXLLXXXXFSYFXXSQXEXDXVLXREEKPXYLFKITNKDLSXAETHEKGLRKXRGTDNLHTXYFKALMSGXQXVFDIGSGXXFFREXKIXYXXEQXXKGHHHEMLKDKFBYPIISNKRYAXDKFQFHLSIXINYXADKXKDINXXVNXYLKESXXTHIIGIDRGERHLLYLSXIDLQGBIVEQYXLNEIXNXXXXXXXXTNYHDLLXIXEKQRXEARXXWXXIEXIXELKEGYMSQVXHJIAQLXVKYNAIVVLEDLNXGFXRGRQKVEKQVYQKFEKMLIDKLNYLVDKXXBXXXLGGXLNAXQLTNXXXXFXXXXXXXXXXJGKQCGFJFYXPAWNTSKMDPTTGFVNXLDTXYENMXKAKAFFXKFXSIRXNXXKGWFEFXXDYBBFTXKAAXTXTXWTLXTXGTRIETKRDXKQXNNFVSXEFDLTXKFKXLFXKYXIDXNXNLMEQICXQNDAXFFKELLHXLXLTLQMRNSXXGTXVDYLISPVMNXXGKFYDSRXCXXNLPXNADANGAYNIARKGLWIXXQIKXXDBJSXLXJAISNKEWLXYXQXXVD

SEQ ID NO: 129 - DNA, 3972 bp, synthetic construct
  source 1..3972: mol_type = other DNA
atgaattccattgaacaattcaccggattatactccttatcaaagaccttgcgctttgagttgaaacctataggaaaaacgcaagaaaacatagaaaaaaacggtattcttgaaagagacaacgagagagctgttgcgtacaaaagtgtaaagaaatacatcgacgagtatcacaaggcatttattgaaagggttatgaattcttttccccacaatttaagcgatgaggagcaagatatttgggaagaagcgttgaataactattatacatcataccatttacctgcaactaatcctcaaagaaaggaaacgttaacagaagcccaggatactttacgaactcttatttctaatagttttcttagggatagacagtacaaaagactatttggaaaagaactgtttcaagaggatttggcggaatttgtaaatactgccctttttgaaacttatatccgttctcaaaaaggtaataataacttgaccgaggaagaagtccgtcagatacaagagaatacaatcagggagatctcgctcttcagaaactttaccgtctatttttcgggttataacgagaataggaaaaatatgtatgttgcagatgacaaggcaacttctattgccaaccgcatgattacagagaatcttcctaagtttgtcgacaacatggaggtgtttgggaaaattgccgctagtgaagtcgcaaatcatttcgaaactctttacaagtcaatggaagcttatttaaatgtcatatctattgacgaaatgttcaagttggattattatccaatattgctgacgcaaaaacaaatagatgtatacaatacaataattggaggaaaggtgttggaggatgggagtaaaatacaaggcttgaatgaatatgtgaatctttacaaccaacagcaaaaagacaaggcgaatagactccctaaactaaaaccactttttaagcagatacttagtgaacacaatgctatttcgtggttgcccgatacgttttcaactgacaacgagatgctggaaagcattgaaaagtgttatcagaaccttaggacgcaagttttcgaaggggaaatttcattaaagaaactcttggataatttgggagattatgatttggaacatatctatattcccaatgacctccaattgaccaatattgtccaaaaggtatatggagattggtcaatggtcaagaaggcaatggaagaggatgtgaaagcaaagaatccccaaaggaaaaatgagacaggcgaaaagtatgaggagaggattgtaaagatactgaaatctgatgaaagtttttctatagcacaaatcaataacttgctgaaaccttatcttggagaaaaatacgtgccgcttgaaaagtattttattactaaaggtgccgaggataataataatgtgcaaaaacctaatctctttattcgtatagagaatgcatacatagaggcaaaatctctgttgaacacccagtatccaaaagacagaacaatgtcgcaggacaagcaaaatgttgagagaattaagattttattggatgcaatcaaagacttgcaacactttgtaaaacctttgttggggaaggggtctgagggacaaaaagacaacaccttctatggcgagttcattccactttgggaagcacttgatcaaattacgccgttgtacaatatggtgcgtaaccgaatgacacagaagccttattctgatgataaaattaaactttttttcgagaacaatggctcatttctaaatggatgggtcgacagcaaaacagaatcggataatgctactcagtatggcggatatttgttcagaaggaaaaatagtatcggcgaatatgattactatctaggaatctcgtctgccacaaaacttttcagaagttttaatcatgtgtcggaatcggataaaagcatttttgaaagattggattattaccaattgaaaggaaagactttttatggcgctttgtacaaaggagactatgaaaaagaatcttctgctatcaagctggcaattgataaattcattactaataatggaaataccattattagagaaaagataaatactgagaaaagaaaacgacagcccaaggtgtcaactgccattggttatttgaaatttctcagacagcagggagttgaattgtttgattctttattaaaagatggttgctttgaggagagtaatcaagctatgatcacttccattaaagctacattggcgtctatggcgcgcattcctaatgcacaggactatgcacataaggattattcattgttctcagacgctatggatgatgtagaagaattgttgcaagatgttattttttcatatttcccaattagtcagaaagagatggacaaagttcttgagagagaagaaaagcccatgtatttgttcaagataacgaataaggatctttcttttgctgaaactcacgaaaaggggttgaggaaatcaagaggaacagataatttgcacaccatgtacttcaaagcattgatgagtggcactcaaaatgttttcgatattggttctggcaccgttttctttagagaacgcaagatagtgtattctgaagagcaattgggaaagggacaccaccacgaaatgctgaaggataagtttgattatcctatcatatcaaacaagagatatgcatacgataagttccaatttcatttgtcaataaatattaactataaagcagataaacataaagacatcaatcttttggtcaatgaatatctgaaagaatcaaaagtcacgcatatcattggtattgaccgtggagaaagacacctattatatttgtctgtaatagatttgcagggtaatatcgttgagcaatattcattaaacgagattgtgaatgaatataacgactgtaattatcgtactaactatcatgatttattagatatcagagaaaagcaaagggatgaggccaggcgcagttggctaaccattgaaagtatcaaggaattaaaggagggctatatgagccaggtggttcatttaattgcacaactaattgtaaaatacaacgcaatagtcgtgcttgaagacttgaatactggctttattagagggaggcaaaaggttgagaaacaggtttatcagaagtttgaaaaaatgctgattgacaagttgaattatctggtagacaagaaaaaagatatttacgacctgggtggtgcgttgaatgcattgcagttgacaaataaatttgagagttttcagaagataggtaaacaatgtggtttcctgttctatgtccctgcttggaataccagtaaaatggatcctacaacaggatttgtcaatatgcttgatacacgttacgagaatatggataaagctaaagccttttttgcaaaatttaggagtattcgacaaaatgtcagtaagggatggttcgaatttgctattgattataatgattttacctcgaaagcagctggaaccaaaacacaatggacactttgtacctatggcacacgtattgaaaccaaacgcgatacgaagcaaaataacaattttgttagcgatgagtttgacttgacagacaagttcaaggtcttgtttaataaatacaacatagatgtaaacggcaatctaatggagcagatttgctcacaaaatgacgctacattcttcaaagaattactacacatgctacatttgaccttgcagatgcgaaatagtattactggaacagaagtggattatttaatttcacctgttatgaatgcttctggtaagttctacgatagtcgtacttgtgaaaataatctacctaagaatgctgatgccaacggggcctacaacattgctagaaaaggattgtggattgtcgaacagataaaacattcggacaatatatcgaaattaaaaatagcaatcagcaacaaggaatggctacgatatacacaagggttggtagactaa

SEQ ID NO: 130 - DNA, 3972 bp, synthetic construct
  source 1..3972: mol_type = other DNA
atgaacgacctttcgcaattcaccaatttatattctttatcaaaaactttgcgttttgagttgaagcccatcggcaagactttggagaatattgaaaagaatggtattcttgaaagagacaaccgtcgttctataggatacaaatccattaagaaggtaatagatgaatatcacaaggcgtttatcgaccgcgttctgaatgactatgaacgcaaattggatgaaacaggaagaatcgtttggagagattcattaaatgaactgtatcgtctgtatcatctttcttctaccgaagcaaagagaaatgaagaaatccgcaaaacacaagaaatattacggaaacaaatttcagaatgctttaagaaagacagacaatatagccgtttgttcgggaaagaattaattcgagaggacctaacagaatttgtaaacactcctttatttgagcaatatatcctcagtcagaaaggcaacgaagacttaagtatagatgatgtacgccatattcaagaagatgttattgaggatattgcccaattcagagacttcacaacatatttctctggcttttatgaaaacagacggaatatgtacgttgccgacgacaaagcgacctctatagcaaatcgtctgattatggagaacctcccaaaattcattgacaacatagatgtgttcgaaagaattgcacagagcgaggtgtccggcaatcttgaaactttatgtaaggaaatggaagcttatctaaatgtcaattccattgcagaaatattttgtcttgattatttttcgatggtattgacgcaaaaacagatagacgtatataatgcaattattggcgggatgtcgttggaagacggtacaaaaatcaagggactaaacgtgtatgtgaatctttataataaaaaacaaaaagagaagacctgccgcttgcccaaactgaagcctcttttcaaacaaattctaagcgaacgcaacgccatctcgtggctgcctgatgaatttacaagtgacaaggagttgcttgaaagtattgaaaaatgctatcaagaccttaagaattctgttttcgagggtaaagattctctaatggtgttattgaaagaactcggcgagtatgatttagagcatatctatctacataatgactctcagctaacaaacattgcccagaaacaatatggcgattgggcgacaataaaaagggcttttgaggaatcggtcaaggctgcgactcccgcaaagcgcaacgaaaccaccgaaaagtatgcggctcgaatagagaaaatcttaaaagctaccgacagcttgtctttgtcgcagattaaccgaatgctgaaggcttatatgggtgatgacttcaaaacaattgagtcatacttcacagcaatgggtgcagaagatactgtggacggacaaaagcctaatcttttcatacgtattgaaaacgcctacgcagatgtacagcctttactaaatacaccttatccagaagacaaaaagctgtcgcaagacaaagccaatgttgcaaagataaagaacctattagataccatcaaagacttgctgcactttgtaaaaccattactagggaatgggacaaaaggcgaaaaagacaatcgcttctatggtgaattcattcctttatgggaactgcttgaccaaattacgccattgtataacatggtgagaaacaggctaacaaagaaggagtgttctgacgagaaaatcaaactgtttttcgaaaacaataatggtagatttttaagtgggtggacggacaatcagacagaatccgataacggcactcaatatggtggctatttgttcagaaagaggaatggcatcggagaatacgattattatctgggagtgtctgatgccaaaaaactctttcgtagtttcaaatcagtgccagatagcgataaaagtgactacgaaagactggattactatcagttgaaaggtaaaaccttttatggtgctttgtataaaggcgactatgaatcagaatccgcaaatatcaagcgatctatcgattattttatctcgcataacggtaactccgaaatcaaagggaaaatcaatacagaaaggagaaaacagcaaccaagaatatcaacagccattggatatcttaagtttatcagacaacacgatttcggattgtataaattgcttttacaagatgcggaatttgagaaaagcaatcaggagatgattgcttctattagggagacactattatctcttgtccgtattccatcggcacatgagtatgcagataagacatacaccttgttctctaatatgatggatgatgtcgagattttacttaaaagtaaggtgttttcatacttcacagtaagccaaagtgaactcgacgaagtcctcgttagagaagaaaaaccattgtatctgttcaagattacgaataaagacttgtcttatgccgagactcacgagaaaggattaagaaagactcgcggtaccgacaatttgcatactctttatttcaaagcattgatgagtggaaaccagagtgtctttgacataggatctggggcgattttcttcagagaaaaaaagatcaactacacggatgaacagatgaggaagggacatcaccatgaaatgctaaaagacaaattcaattatccaattatttcaaacaaaaggtacgctttcgacaagtttcagtttcatttgtcaatatcgataaactataatgcggataagaataaagacataaaccccatggtgaatgcctatctgaaagaatccaactccactcatatcattggtattgaccgaggagaaaggcacctgctgtacttgtcgcttattgaccttcagggagatatcgtcgaacaatacactctgaatgagattggaaacaccaattatcacgacctgctgggcataaaagaaaaacagcgcaaagaagctcgccccaattggatggagatagaaaacattagggagctgaaagagggctatatgagccaggtgattcacataattgcccaactgatggtgaaatacaatgctattgtggtacttgaggatttgaacatgggatttatgcgtggtcgtcagaaagtggaaaagcaggtgtatcagaagttcgagaagatgctgatcgacaaattgaactatttagtggataaacaatgcaatgcaactgaactagggggagttttgaacgcctaccaattaacaaatacccataagaaattcttagaacaatatgggaatcagaaaaatgcattaggcaaacagtgtggtttcatattttacattccagcatggaacacaagcaaaatggaccctactaccggctttgtcaacctattggatactcactatgagaatatggaaaaagcaaaagctttctttggcaagttcaagagcattcgcaataatgctgccaaaggctggttcgagttcgagtttgattacgataacttcaccacaaaggccgcagacacaagaacaccttggacgctctacacccatggtactcgcatagagacaaaacgtgaccctaagcagaaaaacaacttcgttagtgaagagtttgatttgacaagcaaattcaaggaactgtttgttaaatacaagattgatttgaacgacaacctgatggagcaaatatgcttacaaaatgatgcttcgttttttaaagaattgcttcacctgctacaactaacacttcaaatgcgaaacagcaagattggaactgatgttgattatcttatatcgcctgtaatgaacgacaaaggaaagttttacgatagtcgtaattgtggcaagaatctaccggaaaatgctgatgcaaatggtgcctacaacattgccagaaagggattgtggattatcgaccagattaagcgcacggatgacttgtcgagattgaggttggccatcagcaacaaggaatggctgcaatatgcgcagaaaatggtgtga

SEQ ID NO: 131 - protein, 1249 aa, synthetic construct
MDMKSLNSFQNQYSLSKTLRFQLIPQGKTLDNINESRILEEDQHRSESYKLVKKIIDDYHKAYIEQALGSFELKIASDSKNDSLEEFYSQYIAERKEDKAKKLFEKTQDNLRKQISKKLKQGEAYKRLFGKELIQEDLLEFVATDPEADSKKRLIEEFKDFTTYFIGFHENRKNMYAEEAQSTAIAYRIIHENLPKFIDNIRTFEELAKSSIADVLPQVYEDFKAYLKVESVKELFSLDYFNTVLTQKQLDIYNAVIGGKSLDENSRIQGLNEYINLYNQQHKDKKLPFLKPLFKQILSDRNSLSWLPEAFDNDKQVLQAVHDCYTSLLESVFHKDGLQQLLQSLPTYNLKGIYLRNDLSMTNVSQKLLGDWGAITRAVKEKLQKENPAKKRESDEAYQERINKIFKQAGSYSLDYINQALEATDQTNIKVEDYFINMGVDNEQKEPLFQRVAQAYNQASDLLEKEYPANKNLMQDKESIEHIKFLLDNLKAVQHFIKPLLGDGNEADKDNRFYGELTALWNELDQVTRLYNKVRNYMTRKPYSVDKIKINFKNSTLLNGWDRNKERDNTAVILRKDGKFYLAIMHKEHNKVFEKFPVGTKDSDFEKMEYKLLPGANKMLPKVFFSKSRIDEFKPSAELLQKYQMGTHKKGELFSLNDCHSLIDFFKASIEKHDDWKQFNFHFSPTSSYEDLSGFYREVEQQGYKLTFKSVDADYINKMVDEGKIFLFQIYNKDFSEHSKGTPNLHTLYWKMLFDERNLQNVVYKLNGEAEVFFRKKSLTYTRPTHPKKEPIKNKNVQNAKKESIFDYDLIKNKRFTVDSFQFHVPITMNFKSEGRSNLNERVNEFLRQNNDAHIIGIDRGERHLLYLVVIDRHGNIVEQFSLNSIINEYQGNTYATNYHDLLDKREKEREEARESWQSIENIKELKEGYLSQVVHKIADLMVKYHAIVVLEDLNMGFMRGRQKVEKQVYQKFEKMLIDKLNYLVDKKQDAETDGGLLKAYQLTNQFESFQKLGKQSGFLFYVPAWNTSKIDPCTGFTNLLDTRYESIEKAKKFFQTFNAIRYNAAQGYFEFELDYNKFNKRADGTQTLWTLCTYGPRIETLRSTEDNNKWTSKEVDLTDELKKHFYHYGIKLDADLKEAIGQQTDKPFFTNLLHLLKLTLQMRNSKIGTEVDYLISPIRNEDGTFYDSRQGNKSLPANADANGAYNIARKGLWVINQIKQTPQDQKPKLAITNKEWLQFAQEKPYLKD

SEQ ID NO: 132 - protein, 1233 aa, synthetic construct
MDHFTNLYPVSKTLRFELIPDKRTKAILERTDLIAQDEHRAESYKLVKKIIDRYHKKFIDSVLGTLKLPLDELDSLHELYSKSQKSDADKKALEKIQDKLRKLIADALTKDSRYKRIDKKELIREDILSVIEPEEQALIDEFRDFTTYFTGFHENRRNMYSAEAQSTAIAYRLIHENLPKFIDNMATFEKIAASPVAEHFPQLYQEMAEYLNVREIGDLFKLDYYTELLTQSQIEAYNAVIGGRTVEESGKKIQGINEYVNLYNQQQPSRDTRLPKLKPLFKQILSDREAVSWLPEEFESDKDMLTAVKECYHSLNDHVFDPLRELLTNLSSYNLDGIYIPNDLSLTDISQAMFKDWSVIKKAIAEDVKRNCPLKRNEKADNYEERISKLIKRENSFSIGYMNHCIQEKDICDHFATLGASDNGEEQTVNLFLQIQNAYTDAQSLIENDYPEDRNLAQDKENVARLKALLDAVKALQRFVKPLRGNGDEPDKDERFYGELAVLWEELDHITPLYNKVRNRMTRKPYSIEKFKLNFQNSTLLDGWDLNKERDNTGVIMRKDGKYFLAIMNKQFNRIFVDAPQAGHDEDTFEKMEYKLLPGANKMLPKVFFSKSRIEEFKPSPELLEHYEKGTHKKGDNFSLKDCHELIDFFKASIAKHEDWSKFDFHFSPTDTYEDLSGFYREVEQMGYKISYKQIPVSYIDKMVEEGKLFLFQIYNKDFSPYSKGTPNLHTLYWKMVFDERNLANVVYKLNGQAEVFYRKKSLDYDRPTHPANQAIKNKNPETTKKESTFDYDIIKDKRFTMDKFQFHVPITINFKATGSGSINPLVNQYIHDHDDLHFIGIDRGERHLLYVTVIDSKGCIKEQFSLNEIVNEYQGNTYKTNYRSLLDKRDDERQRERQSWNTIEGIKELKQGYLSQVIHKIVSLMVKYHAVVVLEDLNMGFKRGRQKVESSVYQQFEKALIDKLNLLIDKKIDADQPGGLLHAYQLTNKFTSFRDMGRQNGFLFYIPAWNTSKIDPVTGFVDLLHPRYESVDKSRSFFCKFKSIRYNQDKGWYEFTMDYNDFTTKAEGTRTEWTLCTHGTRVETFRNAEKNSSWDSREVNLTDEFNALFATYGVEPQGNLKQAIAERSQKEFFDKLTHLLALTLQMRNNITGTEVDYMISPVADENGKFFDSRTCGKELPENADANGAYNIARKGLWVARQIQAAHVDEKVNMAISNKEWLSFAQSKPYLND

SEQ ID NO: 133 - protein, 1239 aa, synthetic construct
MKQLNDLTGLYSLSKTLRFELKPIGKTLEHIESKGFITQDEKRAEEYKRVKDIIDRYHKSFITMCLCGFKFNQEDLDTYAALAEDFNRDEKAFEESKKTLRKQIVGAFKKGGGYSDLFKKELIQKHLPEIVTDDEEKKMVENFSKFTTYFTGFNENRKNMYSDEEKSTAIAYRLIHDNLPMFLDNTRSFSRIADSDVRQSFCKIESSFSEYLNVEHLAEMFQLDYFSETLTQEQIAVYNHVVGGRTLEDGTKIQGINEYVNLYNQQHKDNRLPLLKPLYKMILSDRVALSWLPDEFANDKEMIDAIKETYDSLKENLTGDGDGSLRNLLLNINNYDIEHIYIANDLGLTDISQQMFGQYDVYTSAIKQELRNSVTPTAKERREPELYAERINKLFKSTKSFSVAYLNSLVDAEHTIQNYYQQLGAYDRDGEQRINLFTQLEMAYVAAKDILSGKHGNISQTDAEIAIIKNLLDAYKSLQHFIKPLLGNGDEADKDNEFDAKLREVWDALDIVTPLYNKVRNWLTRKPYSTEKIKLNFENAQLLNGWDKNKETDCTSVLLRKDGKYFLAIMDKKANRAFDVEDLPCDGICFEKMNYKQIALPMGLGAFVRKCTGSAKKLGWTCPSSLLNKDMKIIIKDDEATNVLPSLIECYKDFLNIYEKDGFKYKDFNFKFKPTHEYKKLSHFFAEVPTQGYKITFRKVSESFINQLVDEGKLYLFQIWNKDFSEFSKGSPNMHTLYWKMLFDERNLADVVYKLNGQAEVFYRKSSLDVANTTIHKAHQPILNKNQENKKQQSTFDYDIIKNRRYTVDKFQFHVPISINFKATGRDNVNSQVLDIIRNGGIKHIIGIDRGERHLLYLSLIDLKGNIVKQMTLNDIVNEYNGNTYATNYRDLLAEREGNRTEARKNWKKIENIKDIKQGYLSQVVHIISKMMVEYDAIVVLEDLNMGFMRGRQKIERSVYEQFEKMLIDKLNYYVDKQKDVNEAGGLLHALQLTSRFESFKKLGKQSGCLFYIPAWNTSKIDPVTGFVNLFDTRYTNADQARKFFSLFDSIRYNAEKNWFEFAFDYDKFTTKAKGTRTRWTLCTYGTRIRTFRNPAKLNQWDNKEVVLTDEFKKAFADAGIDIHGNLKEAICSLEDKKYLEPLMHLMKLLLQMRNSITNTEVDYLLSPVADKNGSFYDSRVCSYALPKDADANGAYNIARKGLWAIRQIQETPVGERPNLAIKNNEWLKFAQQKPYRDE

SEQ ID NO: 134 - protein, 1254 aa, synthetic construct
LLNYKYYIVMKTYDELTGLYSLSKTLRFELKPVGKTLEYIENKGIIAQDEKRAEEYKLVKGIIDRYHKSFIRLCLYNFKLKLESDNGLDSLEEYVEYASIQRRTDTQDAEFKKVKENLRKQIVSAFKNGATYGDLFKKELIQQILPDFADNDEERQLVDNFSKFTTYFTGFHENRKNMYSEDDKATAIAFRLIHENLPLFIDNMKSFAKIAETVVAEHFADIETAFEDCLNALIPDMFALPYFTKTLTQEQIEVYNNIIGGRVLEDGTKIQGINEYVNLYNQQQKDKSARLPLLKPLYKMILSDHVAISWLPEEFASDEEMLSAINGAYDMLKDVLSEKNEDSLFNLLKNINEYDTEHIFIANDLGLTDISQQIFGQYDVYSSVIKAELRNQASMTAKEKKNPELYEDRIAKLYKSAKSFSIDYLNSFVDSEKSIQNYYAQLGAYDRDGEQRINLFAQIEMKHIAVADILAGKVANLNQSEQGIKLIKDFLDAFKALQHFIKPLLGNGDETDKDNAFDARLRVAWDTLDIITPLYNKVRNWLTRKPYSEEKIKLNFENAQLMNGWDLNKEPDCTSIILRKDDKFYLAIMDKKANHSFDTDELPNEGDCYEKVDYKLLPGANKMLPKVFFSKSRIDEFAPSQSLLDAYEKGSHKKGTNFSLNDCHNLIDFFKQSIAKHEDWKKFPFDFSDTSSYEDISGFYREVEQQGYMLSYRNVSAAYIDKLVDEGKLFLFQIWNKDFSEYSKGTPNMHTLYWKMLFDEKNLANVVYKLNGQAEVFYRKKSLDIANTTVHTANRPIANKNKDNKKKESTFEYDIIKNRRYTVDKFQFHVPITMNFKSIGNDNINESVLNVIRNNGIKHIIGIDRGERHLLYLSLIDLKGNIVKQMTLNDIVNEYNGNTYSTNYKDLLATREGDRTDARRNWQKIENIKDLKEGYLSQVVHVIAKMMVEYKAIVVLEDLNMGFMQGRQKIERNVYEQFERKLIEKLNFYVDKQKKADEVGGLLNAYQLTSKFDSFKKLGKQSGCLFYIPAWNTSKIDPVTGFVNMLDTRYENTEKARCFFSKFDSIRYNTQKDWFEFAFDYGNFTTKADGTQTKWTLCSFGTRVKTFRNPEKVNQWDNVEVVLTEEFKSLFADAGININGNLKEQICNLSDKKYLEPLMGLMKLLLQLRNSITNSEVDYLLSPVCDNKGNFYDSRTCSNKLPKDADANGAYNIARKGLWALARIVDSAEGERPNLAISNKDWLCFAQQKPYLND

SEQ ID NO: 135 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 136 - protein, 1245 aa, synthetic construct
MNTFNELSGLYSLRKTLQFELKPIGKTLENIEKKGIIEQDTQRDVEYKKVKGIIDNYHKAFIKMCLWNLELKLESDGHSDSLEDYVRLASIIRRGELDEIEFSKVKDNLRKQIVSAFKNGNSYGDLFKEELIQEHLPNFVTDEAEKQMVDNFSKFTTYFSEFHKNRKNMYSDEKKSTAIAYRLIHENLPIFIDNIKTFKKIANTEIVNHFADIKQAFQECLNVENIDEMFQLNYFTKTLPQEHIETYNNIIGGKTNEDGSKIQGLNEYINLYNQQQKDHSNRLPLFKPLYKMILSDREALSWLPEEFASDEEMINAINEVYDSLKNVLANDNNGLKHLLLNINQYDTEQIYIANDLGLTDISQQMFGKYDVFTSGIKNELRGQISPSAKEKREPELYEEKINKIFKSARSFTINYLNSFVQDGKTIQSYFAQLGATNTDSAQCIDIFTKIEMAHIAATDILEGKHNSIDQSDSDIKLIKDLLDAYKELQHFIKPLLGSGDEAMKDNEFDAQLHYAWDSLNIITPLYNKVRNWLTRKPYSTEKIKLNFENAQLLGGWDMNKETDCTSVLLRKDNMYYLAIMDKKSNHAFDIDVLPNEGDCYEKVDYKLLPDAYKMLPKVFFSKSRINEFAPSKDIQNAYQKGTHKKGPNFSISDCHRLIDFFKQSIAKHEDWQKFPFSFSDTDSYDDISGFYREVKQQGYMLGYRKVSVSFINQLIDDGKLYLFQIWNKDFSEHSKGMPNIHTLYWKMLFDERNLSNIIYRLNGKAEVFYRQNSLKLENTTIHKANQPIKNKNIQNSKECSTFDYDIIKNRRYTADKFQFHVPITLNFRSTGSDNINNKVNDVIRNNDIEHIIGIDRGERHLLYLSLIDLKGNIVKQMTLNDIVNEYNGNTYKTNYKDLLVQREGDRTEARRNWQKIENIKEIKEGYLSQVIHIITKMMVEYKAIVVLEDLNMGFMRGRQKIERNVYEQFEKKLIDKLNYYVDKQKDITDAGGLMHALQLANKFESFKKLGKQSGCLFYIPAWNTSKIDPVTGFVNLLDTHYENIDKARCFFSKFDSIRYNASNDWFEFELDYDKFTDKARGTKTHWTLCSYGTRIRTFRNPLKLNQWDNEEVVLTEEFKKVFNNANIDIYGNLKNSICSLNDKTTLESLMQLMKLMVQMRNSITGTETDYLLSPVTDANGNFYDSRNNIPTLPIDADANGAYNIARKGLWIIQKIQQSQPGEKLNLAISNREWLQFAQQRPYLNE

SEQ ID NO: 137 - protein, 1243 aa, synthetic construct
MKTFNDLTGLYSLSKTLRFELKPVGKTKDNIETKGIIAQDEKRAEEYKKVKDIIDRYHKKFIEMCLANLKLKTISDGNNDSLKEYVTLASKANKDEKEDNDFKDVKTALRKQIVDAFKKGGSYSDLFKKELIQVHLPDFVTDEQEKQMVENFGKFTTYFTGFNENRQNMYSDEEKSTSIAYRLIHENLPMFIDNIKSFAKIAEHEDIDFLPDIENGFKEELKRLKAQSISEVFDLANFTNTLTQSQIDSYNAIIGARHDENGDKVQGINQYVNLYNQKNKDARLPLLKPLYKMILSDRGALSWLPEEFATDEEMLAAINETHGNLKNVMTDVRKLLQNIDSYDTEHIYIANDKGLTDISQQIFGQYDVYTSAIKAELRDSITPSAKERKDPELLEKRINDIFKASKSFSIEYLNSHVDSDKTIQSYYKELGAYDRNGEQRINLFSQIELAYVDAHDVLLGKHTNLNQSEDSIKKIKALLDAYKALLHFIKPLLGNGDEADKDNEFDAKLRAIWDELDIVTPLYDKVRNRLTRKPYSTEKIKLNFDNAQLLNGWDMNKEPDCTSVLLRKDGQYYLAIMDKKSNHAFDIDELPCNGECYDKMDYKLLPGANKMLPKVFFSKSRIKEFAPSKEICDAYQKGTHKKGANFSIKDCRRLIDFFKDSIAKHEDWSKFPFTFSDTSTYEDISGFYREVEQQGYMLGYRKVSVSFINQLVDEGKLYLFQIWNKDFSEYSMGTPNMHTLYWKMLFDERNLANVVYKLNGQAEVFYRKKSLDLNKTTIHRANQPIANKNMQNEKRESTFCYDIVKNRRYTVDKFQFHVPITINFKATGSDNINASVLDVIRNNGIEHIIGIDRGERHLLYLSLIDMKGNIVKQMTLNDIINEYKGNTYTTNYKELLQAREGDRKEARQNWQKIENIKELKEGYLSQVVHVITKMMVEYKAIVVLEDLNGGFMRGRQKIERQVYEKFEKMLIDKLNYYVDKQRDANENGGLLHAYQLASKFDTFKKLGKQSGCLFYIPAWNTSKIDPVTGFVNMLDTRYENADKARNFFSKFKSINYNADKNWFEFVIDDYSKFTDKAKDTRTDWVLCTYGTRIKTFRNPEKLNQWDNKEIVLTDEFKKVFMEAGIDINGNLKEAICTLTEKKHLESLMQLMKLLVQMRNSETNSEVDYLLSPVADTEGHFYDSRNCGDNLPKDADANGAYNIARKGLWAVMKIKASKPQENLKLGISNKEWLQFAQEKPYLND

SEQ ID NO: 138 - protein, 1254 aa, synthetic construct
MKNILEQFVGLYPLSKTLRFELKPLGKTLEHIEKKGLIAQDEQRAEEYKLVKDIIDRYHKAFIHMCLKHFKLKMYSEQGYDSLEEYRKLASISKRNEKEEQQFDKVKENLRKQIVDAFKNGGSYDDLFKKELIQKHLPRFIEGEGEEEKRIVDNFNKFTTYFTGFHENRKNMYSDEKESTAIAYRLIHENLPLFLDNMKSFAKIAESEVAARFTEIETAYRTYLNVEHISELFTLDYFSTVLTQEQIEVYNNVIGGRVDDDNVKIQGLNEYVNLYNQQQKDRSKRLPLLKSLYKMILSDRIAISWLPEEFKSDEEMIEAINNMHDDLKDILAGDNEDSLKSLLQHIGQYDLSKIYIANNPGLTDISQQMFGCYDVFTNGIKQELRNSITPTKKEKADNEIYEERINKMFKSEKSFSIAYLNSLPHPKTDAPQKNVEDYFALLGTCNQNDEQQINLFAQIEMARLVASDILAGRHVNLNQSENDIKLIKDLLDAYKALQHFVKPLLGSGDEAEKDNEFDARLRAAWNALDIVTPLYNKVRNWLTRKPYSTEKIKLNFENAQLLGGWDQNKEPDCTSVLLRKDGMYYLAIMDKKANHAFDCDCLPSDGACFEKIDYKLLPGANKMLPKVFFSKSRIKEFSPSESIIAAYKKGTHKKGPNFSLSDCHRLIDFFKASIDKHEDWSKFRFRFSDTKTYEDISGFYREVEQQGYMLGFRKVSETFVNKLVDEGKLYLFHIWNKDFSKHSKGTPNLHTIYWKMLFDEKNLTDVVYKLNGQAEVFYRKKSLDLNKTTTHKAHAPITNKNTQNAKKGSVFDYDIIKNRRYTVDKFQFHVPITLNFKATGRNYINEHTQEAIRNNGIEHIIGIDRGERHLLYLSLIDLKGNIVKQMTLNDIVNEYNGRTYATNYKDLLATREGERTDARRNWQKIENIKEIKEGYLSQVVHILSKMMVDYKAIVVLEDLNTGFMRSRQKIERQVYEKFEKMLIDKLNCYVDKQKDADETGGALHPLQLTNKFESFRKLGKQSGWLFYIPAWNTSKIDPVTGFVNMLDTRYENADKARCFFSKFDSIRYNADKDWFEFAMDYSKFTDKAKDTHTWWTLCSYGTRIKTFRNPAKNNLWDNEEVVLTDEFKKVFAAAGIDVHENLKEAICALTDKKYLEPLMRLMTLLVQMRNSATNSETDYLLSPVADESGMFYDSREGKETLPKDADANGAYNIARKGLWTIRRIQATNSEEKVNLVLSNREWLQFAQQKPYLND

SEQ ID NO: 139 - protein, 714 aa, synthetic construct
LTRKPYKTEKIKLNFENSQLLGGWDVNKEPDCTSVLLRKDGMYYLGIMDKKANKSFYCDCLPSEGSSYEKVDYKLLPGANKMLPKVFFSKSRKSEFAPSEVITKAYENGTHKKGANFSLSDCHRLIDFFKASINKHEDWSRFGFIFSETNTYEDMVGFYREVEQQGYMLGFRNVSEEYIDRLVDDGKLYLFQIWNKDFSEHSKGTPNLHTIYWKMLFDERNLENIVYKLNGQAELFYRKKSLDLCKTTVHKAHQSVANKNPQNDKRESIFEYDIIKNRRYTVDKFQFHVPITINFKATGDDRLNSATLEAIRDGGIEHIIGIDRGERHLLYLSLIDLKGNIVKQFTLNEIASEYNGAPCPPTNYKDLLVAREGDRNEARRNWQKIENIKEIKEGYLSQVVHIIAKMMVEYKAIVVLEDLNMGFMRGRQKIERQVYEKFEKMLIDKLNCYVDKQKEATDIGGVLHPLQLTSRFESFRKLGKQSGWLFYIPAWNTSKIDPVTGFVNMLDTRYENVDKTRCFFSKFDVIRYNGDKDLFEFTFDYDKFTDKAKGTRTKWTLCTYGSRIKTFRNPKKNNQWDNEEIVLTDEFKKAFADAGIDIEGNLKDAICSLTEKKHLEPLMNLMKLLLQMRNSKTGTEIDYLLSPVADADGNFYDSRNEISTLPKDADANGAYNIARKGLWAIRKIQSAPSGEKPNLAISNKEWLQFAQQKPYLDD

SEQ ID NO: 140 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHENRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLDGWDENKETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 141 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 142 - protein, 1284 aa, synthetic construct
MNTSNLSRFTNLYSISKTLRFELQPLGKTKDYIEKNGILMRDEKRAEDYKTVKGIIDEYHKKYIKSRLWDFKLPLASEGKRDSLEEYKALYEVSKRSEADEAAFKEVKDNLRSIIAKRLTSGKAYETIFKKELIREDLINSLEDEVEREIVSQFADFTTYFGGFHENRKNMYDAGEKSTAIAYRLIHQNLPKFMDNMKAFAKIAETSIAEHFADIYEGSKEMLNVGSIEEIFRLDYFSEILTQPHIEVYNSIIGKRVLEDGTEIKGINEYVNLYNQQQKDKRLPLLVPLYKQILSDREKLSWLAEEFDCDEKMLAAINETYAHLHDLLMGNENESLRSLLLHLRDYDLEQINISNDLSLTDISQHLFGRYDVFTNGIKEELRVITPRKRKETDEQLEDRISKIFKTQKSFCIAFLNSLPQPAMEDGKARCIEDYFMALGAVNNETTQKENLFAQIENAYENAKSVLQMKETGDMLSQNKPAVAKIKALLDALKDLQHFIKPLLGSGEENEKDELFYGSFQMMWDELDAVTSLYNKVRNWLTRKPYSTEKIKLNFDNAQLLDGWDENKETTNASILLYKDGNYYLGIIKKEDRKILGSPMPTDGECYDKVVYKFFKDITTMVPKCTTQKKDVIAHFMHSDDDYILYDKKTFDAPVTITKEIYNLNNVLYNGVKKFQIEYLRSTGDKRGYEHAVFIWKSFCMHFLKAYKSTSIYNLVLVEQQINSYYDLSSFYNAVNLLLYNLSYRKVSVNYIHSLVDEGKLYLFRIWNKDFSEYSKGTPNLHTLYWKMLFDERNLADVVYKLNGQAEVFYRKSSIQPEHRIVHPAGKPIANKNEHSKEPTSTFKYDIVKDRRYTVDKFQFHVPITINFKAAGQENINPVVLDAIRRGGFTHIIGIDRGERHLLYLSLIDLQGNIVEQMTLNEIINEYKGLKHKTNYHDLLAKREGERTEARRSWDTIENIKEMKEGYLSQVVHIISKMMVEYNAIVVLEDLNTGFMRSRQKIERQVYEKFEKMLIDKLNCYIDKQVGASDIAGLLHPLQLACEAKKWKRSHQCGCLFYIPAWNTSKIDPVTGFVNLFDTRYENAAKAKAFFGKFGSIRYNAEKDWFEFAFDYNDFTTKAEGTRTEWTLCTYRERIRTFRNPQKNHQWDDEEIVLTDAFKQLFDKYDIDMKGNLKEAICAQNDVQFFKDMMELMKLLLQMRNSITNSETDYLLSPVADEKGQFFDSRRGITTLPDNADANGAYNIARKGLWVIRKIQETAENEKPSLAITNKEWLQFAQTKPYLNE

SEQ ID NO: 143 - protein, 1246 aa, synthetic construct
MKQFTNLYPVSKTLRFELQPIGKTKENIEKNGILTRDEKRAKDYQVVKGFIDEYHKQYIKDRLWNFKLPLASEGNLDSLEEYQMLYEMPRRDDTHEEDFSEVKDNLRAIITKRLTENGSAYDRIFKKELIREDLIEFLNNEEDKALVRQFADFTTYFSGFHENRRNMYSAEEKSTAIAYRLIHQNLPKFMDNMKAFAKIAETSVAEHFSNIYEGWEEYLNVGSIEEIFRLDYFSETLTQPHIEVYNYIIGKKVLEDGTEIKGINEYVNLYNQQQKDKSKRLPFLVPLYKQILSDREKLSWLAEEFDSDEKMLGAINESYTHLHELLMGEENESLRSLLLHLKEYDLSQINITNDLSLTNISQHLFGRYDVYSNAIKEQLKIIIPRKKKETDEEFEDRISKIFKTQKSFSISFLNNLPHPETENGKPRSVEEYFISIGTINTKTTQKENLFAQIENAYENVRVILQMKDTGNALSQNKPAVTKIKALLDAFKDLQHFIKPLLGSGEELEKDELFYGSFQMIWDELNTVTPLYNKVRNWLTRKPYSTEKIKLNFDNSQLLGGWDVNKEPDCTGILLRKDSFYYLGIMDKKANRVFETDITPSEGDCYEKMVYKQLGQISQQLPRIAFSKTWQQKLSIPEDVIKIKKNESFKKNSGDLQKLISYYKSFISQHDEWNSYFDINFTDRNDYKNLPDFYSEVDSQFYSLSFSRVPSSYINQLVDEGKLYLFRIWNKDFSEYSKGTPNLHTLYWKMLFDERNLSNVVYKLNGQAEVFYRKASIQPENRIIHKANLSIVNKNELNKKRTSTFEYDIIKDRRYTVDKFQFHVPITINFKGTGQLNINPIVQETIRQGGFTHIIGIDRGERHLLYLSLIDLNGNIVKQMTLNDIFNEYKGQTYKTNYHDLLVKREGDRTDARRSWDTIETIKELKEGYLSQVVHVISKMMVEYKAIVVLEDLNTGFMRGRQKIERQVYEKFEKMLIEKLNCYIDKQADATEVTGLLHPLQLTCEAKKWKRSHQCGCLFYIPAWNTSKIDPVTGFVNLLDTRYDTREKARLFFSKFQRISFNTEKGWFEFTFDYNDFTTKAEGTRTQWTLCTHGERIRTFRNPQKNNQWDNERIVLTDEFKKLFDQKEIDISGNMKEAICNQKDAQFYRDLLGLMKLLLQMRNSIANSEEDYLLSPIADKNGHFFDSRERISSLPVDADANGAYNIARKGLWIVRKIRNTSEGEKLSLAITNKEWLLFAQSKPYLND

SEQ ID NO: 144 - protein, 1249 aa, synthetic construct
MKKLTNLYPVSKTLRFELQAIGKTKENIEKNGILQRDEKRAEDYKIVKSLIDEYHKQFIKDRLWNFKLPLHNEGHLDSLEEYQALYEISKRNDTQEAEFTEIKDNLRSIISKRLTECGSAYERIFKKELIREDLIDFLESNEDKDIVRQFADFTTYFSGFHENRRNMYVAEEKSTAIAYRLIHQNLPKFMDNMKAFAKIAETSVAEHFTDIYEGWKEFLNVGSLEEIFRLDYFSETLTQPHIEVYNYIIGKKILEDGAEIKGINEYVNLYNQQQKDKSKRLPFLVPLYKQILSDRDKLSWLADEFDSDEKMLAAINESYNHLHDLLMGLENESLRSLLLNIKDFNLSQINISNDLSLTDISQHLFGRYDVFTSGIKDELRIITPRKKKESDEEFEDRISKIFKTQKSFSVDFLDKLPQPVMEDEKPRTIEDYFMTLGAVNTEATQKENFFAQIENAYEDARTILQIKDTGDTLSQNKSAVAKIKALLDALKDLQHFIKPLLGSGEENEKDELFYGSFQMMWDELDTVTSLYNKVRNWLTRKPFSTEKIKLNFDNSQLLGGWDVNKEPDCKGILLRKDDFYYLGIMDKKSNRIFEADVTPTDGECYDKIDYKLLPGANKMLPKVFFSKSRIDEFAPSEAIVSSYKRGTHKKGAVFNLADCHRLIDFFKQSINKHEDWSKFGFHFSDTKSYEDISGFYREVEQQGYMLSSHPVSSSYIDTLVSEGKLYLFRIWNKDFSESSKGTPNLHTLYWKMLFDERNLVDVVYKLNGQAEVFYRKASIKPENCIIHKANQPIANKNELNTKRASTFKYDIIKDKRYTVDKFQFHVPITINFKAAGQNNINPIVQEAIKQDEFSHIIGIDRGERHLLYLSLIDLKGNIVKQMTLNEIINEYKGQTYKTNYHDLLAKREGDRTEARRSWETIETIKELKEGYLSQVVHIISKMMVEYNAIVVLEDLNTGFMRGRQKIERQVYEKFEKMLIDKLNCYIDKQLSPTDEGGLLHPLQLTCDAQKWKRSHQCGCLFYIPAWNTSKIDPVTGFVNLLDTHYDTREKARVFFSKFQRISYNAPKGWFEFAFDYNDFTTKAKGTRTQWTLCTQGERIRTFRNPQKNHQWDDERIMLTDAYKQLFDKYDIDINGNIKEAISSQTDAQFFKDLMGLMKLLLQMRNSITNSEEDYLLSPVANGTGHFFDSREGISSLPKDADANGAYNIARKGLWVVQKIQETPEGEKPSLTITNKEWLQFAQTKPYLND

SEQ ID NO: 145 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 146 - protein, 787 aa, synthetic construct
LQLTDTEDKLSQNKPAVGKIKALLDAFKDLQHFIKPLLGSGEENEKDELFYGAFQLIWDELDTVTPLYNKVRNWLTRKPYSTEKIKLNFDNAQLLGGWDVNKEPDCTGVLLRKDGFYYLGIMNKKSNRIFDADVTPADGICYEKIDYKLLPGANKMLPKVFFSKSRIDEFAPSEAILSSYKRGTHKKGADFSLSDCHRLIDFFKASINKHEDWSKFGFQFSDTKTYEDISGFYREVEQQGYMLSSHQVSEAYINQMVEEGKLFLFRIWNKDFSEYSKGTPNMHTLYWRMLFDERNLADVVYKLNGQAEVFYRKASIKAENQIMHPAHHPIENKNTLNEKRSSTFDYDLVKDRRYTVDKFQFHVPITINFKAIGQTNVNPIVHETIRRGGFTHVIGIDRGERHLLYLSLIDLKGHIVKQMTLNEIINEYNGLAHKTNYYDLLVKREGERTTARRSWDTIENIKELKEGYLSQVIHIISKMMVEYNAIVVLEDLNMGFMRGRQKIERQVYEKFEKMLIDKLNCYIDKQADSQSEGGLLHPIQLANKFESFRKLGKQSGCLFYIPAWNTSKIDPVTGFVNLFDTRYETREKAKLFFSHFQRICFNAEKDWFEFSFDYNDFTTKAEGTRTQWTLCSYGTRIRNFRNPLQNHQWDDEEIVLTEAFKALFDKYDIDIHANLKEAINAQTDAQFFKDLMGLMKLLLQMRNSKTNSEVDYLLSPVADEHGRFFDSRAGAGSLPDNADANGAYNIARKGLWVIRKIQETPEGEKLSLAITNKEWLEFAQTKPYLND

SEQ ID NO: 147 - protein, 1264 aa, synthetic construct
LGLFLRLRPKLFVILCKSNSNVMRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 148 - protein, 1248 aa, synthetic construct
MKQFTNLYPVSKTLRFELQPIGSTKENIEKNGILSRDEQRAEDYKKVKNLIDKYHKQFIKDRLWNFQLPLENKGNLDSLEEYRILYETPKRDEAVFTEVKDNLRALIVNQLKAKGSAYERIFKKELIREDLIEFLDMEEDKKTVRQFADFTTYFTGFNENRANMYSAEEKSTAIAYRLIHQNLPKFMDNMKAFAQIVQSPVAEHFTDLYSYWEEYLNVASIEEMFQLDFFSQTLTQTGIEVYNYIIGKKILEDGTEIKGINEYVNYYNQHQKDKKQRLPLLVPLYKQILSDRERLSWLAEEFDSDEKMLKAINELYVHLHDLLMGKENESLRSLLLKLKEYDLSQINIANNFSLTAICHQMFGRYDVFINGMKDILRAITPHKKKETEEEFEERISKILKTQKSISIAELNKLPQPVCEDCCKPKLVEDYFMSLGAVDDGVTQKLNLFAQIENAHTDALSVLQLTGTGDTLSQNKPAVAKIKNLLDTFKNLQHFIQPLLGSGEENEKDELFYGSFQLFWDELDAVTPLYNKVRNWLTRKPYSTEKIKLNFDNAQLLGGWDVNKESDCTGVLLRKGAYYYLGIMNKKANRIFDACITPSNGDCYEKIDYKLLPGANKMLPKVFFSKSHIDEYAPSDVIIENYKKGTHKKGADFSLQDCHRLIDFFKQSISKHEDWSKFGFQFSPTCSYEDISGFYREVEQQGYMLSTHPVSSAYIDEMVAEGKLFLFRIWNKDFSEYSKGTPNLHTLYWKMLFDKRNLADVVYKLNGQAEVFYRKASIKPDNRIIHPANQDIKNKNALNENKTSRFEYDIIKDHRYTVDKFQFHVPITINFKAIGQANINPIVNDAIRKGVFTHIIGIDRGERHLLYLSLIDLKGRIIKQMTLNEIVNEYNGHSHATNYRDLLANREGERTTARRSWDTIENIKELKEGYLSQVIHVITKMMVEYKAIVVLEDLNTGFMRGRQKIERQVYEKFERMLIEKLNCYIDKQTTPTAEGGLLHALQLTNKFESFKKLGKQSGCLFYIPAWNTSKIDPTTGFVNLFDTRYETREKSRLFFSRFDRIAYNRDKDWFEFSFDYNNFTTKAEECRTRWTLCTQGTRIINFRTPQKNNQWEDEEVNLTVLFKQLFDRYDINIHGNLMETIQQQTEAKFYQELMHLLKLTLQMRNSRTNSEVDYLLSPVADEHGHFFDSREDIETLPNNADANGAYNIARKGLWVIRKIQETPEGERPSLAITNKEWLQFAQTKPYLND

SEQ ID NO: 149 - protein, 1273 aa, synthetic construct
MTQKFDDFIHLYSLSKTLRFEARPIGDTLRNFIKNGLLKRDEHRAESYVKVKKLIDEYHKAFIDRVLSNGGLNYEDKGEYDSLTEYYVLYSTTRRDETTQKHFKATQQNLRDQIVKKLTDDDAYKHLFGKELIESYKDKEDKKKLHEADLVQFINTANPKQRLNFSKKEAIDLVKEFCGFTSYFGDFHKNRKNMYSAEEKSTGIAYRLINENLPKFIDNMESFKKIAAIPEMEDNLKEIHDNFAEHLNVENIQNMFQLNYYNQLLTQKQIDVYNAIIGGKTDEEHKEKIKGINEYVNLYNQAHKDAKLPKLKTLFKQILSDRNAISWLPEEFDNDQEALNAILDCYARLSENVLGKENLKRLLCSLSEYDTKGIFLRNDLQLTSISKKMSGSWTDIPSAIKNDMKDGAPAKKRKESEEDYEKRIDNLFKKLDSFSIGYIDDCLNKFDNNNTFTIEGYFKELGAKDTQSEDIFKQIANAYTDVKPLLNSPYPKSKNLSQDKENVKKIKRFLDALMSLVHFVKPLLGNGDESNKDEKFYGELSLLWTELETIVPLYNMVRNYMTRKPYSNSKIKLNFENSQLLGGWDVNKEKERASILLRRNGLYYLAIMDKDSSKLLGKSMPSDGECYEKMVYKQISFNSGFGGFIRKCFNSATELGWKCSPTCLNKDGKIIILDEEATDIRPELIDNYKSFLDIYEKDGYKYKNFGFHFKKSSEYENINDFFKEVEQQGYKITFTNVSVAFIDKLVKEGKMYLFQIYSKDFSEYSKGTPNMHTLYWKALFDDRNLKDVVYKLDGQAEMFFRKKSINCNHPTHPANQPIQNKNKDNKKKESVFKYDLTKDRRYAVDKFMFHVPIKMNFKSTGTENINLPVREYLKTSNDTHIIGIDRGERHLLYLVVIDLHGNIVEQYSLNDIVNEYNGNTYRTNYHDLLDAREEDRLKQRQSWQTIENIKELKEGYLSQVIHKITQLMIKYHAIIVLEDLNMGFMRGRQKVEKQVYQKFEKMLIDKLNYLVDKKADIESTGGLLNAYQLTNKFPGFKNLGKQSGFLFYIPAWNTSKIDPVTGFVNLLDIRNVDKAKAFFAKFDSIWYNKEKDWFEFALDYDKFGSKAEGTRTKWTLCTQGKRIKTFRNADENSNWDYQIIDLTKDLKQLFAQYNIDINGNLKEAISNQTEKTFFVELLGLLKLTLQMRNSITGTETDYLVSPVADENGNFYDSRTCGHSLPENADANGAFNIARKGLMIIEQIKASDNLSKLKFDISNKSWLNFAQQKPYKHE

SEQ ID NO: 150 - protein, 1270 aa, synthetic construct
MKRKFDDFIHLYSLSKTLRFEASPIGDTLRNFKKNGLLERDKHRAESYVKVKKLIDEYHKVFIDRVLNGSVLNYVNKGKYDSLTEYYDLYSVPKKDETSQKHFKAIQQHLRQQIVKKFTDDKNYKRLFGKELLESYKDKEDKKKLNEADLVQFINAANPEQLLSLSKKEAIDLVQEFSGFTTYFNEFHKNRKNMYSAEEKSTGIAYRLINENLPKFIDNMKSFKKIVDIPEMKDNLKQIHEYFVDYLNVENIHEMFQLDYYNQLLTQKQIDVYNAIIGGKTDNEHKEKIKGINEYVNLYNQTHKDAKLPKLKVLFKQILSDRNAISWLPEEFKDDQEVLNAIKDCYARLSKNVLGDNILKELLCSLAEYDTKGIFLRNDLQLTDISQKMFGNWSVIPSAIKKDVAPAKKRKELEEDYEKRIDNLFKKRESFSIDYIDSCLDKFDENNTHTIEGYFATLGAVDTPTTQRENIFAQIANTYTDLEPLLKSPYSKNKNLSQDKDNVAKIKLFLDALMSLMHFVKPLLGKGDESNKDEKFYGDFTLLWTELETVVPLYNMVRNYMTRKPYSKSKIKLNFDNSQLLGGWDANKESDYASILLRRDGKYYLAIMDKDSKKLLGKSMPSDGECYEKMVYKLLPGANKMLPKVFFATSRIKDFKPSEQLLENYNKGTHKKGVNFSISDCHALIDYFKQSINKHEDWKNFNFNFSETSTYEDLSAFYREVEQQGYKITFTNVSVSFIDKLVEEGKMYLFQIYNKDFSEYSKGTPNMHTLYWKALFDERNLKDVVYKLNGQAEMFFREKSIKVSTIHPANRPIQNKNKDNKKKESIFEYDLIKDRRYTVDKFMFHVPITMNFKSADTENINLPVREYLQTSDDTHIIGIDRGERHLLYLVVIDLQGNIVEQYTLNDIVNEYNGNTYRTNYHDLLNAREAERLKARQSWQTIENIKELKEGYLSQVIHKITQLMIKYHAIVVLEDLNKGFIRGRQKVEKQVYQKFEKMLIDKLNYLVDKKADIETTGGLLNAYQLTSKFESFQKLGKQSGFLFYIPAWNTSKIDPVTGFVNRLDTRYHNVDKSKAFFAKFDSIRYNKEKDWFEFALDYKNFGNKAEGTRTKWTLCTQGKRIKTFRNAEKNSNWDYQIIDLTKELKQLFAHYDIDINGNLKKAISNQTEKTFFVELMQFLKLTLQMRNSITNTETDYLVSPVADENGNFYDSRKCGSSLPENADANGAFNIARKGLMIIEQIKASDDLSKLKFDISNKSWLNFAQQKPYKHE

SEQ ID NO: 151 - protein, 1121 aa, synthetic construct
LVQFINTANLKQRLNLSKEEAKDLVQEFCGFTTYFGDFYQNRENMYSAEEKSTGIAYRLINENLPKFIDNMETFKKIAAIPEMEDNLKEIHDNLSEHLNVENIQDMFQLNYYNQLLTQKQIDVYNAIIGGKTDDEHKEKIKGINEYVNLYNQAHKDAKLPKLKTLFKQILSDRNAISWLPEEFDNDQETLNAIKDCYAHLSGNILKDENLKRLLCSLSEYDTKGIFLRNDSQLTSISKKMSGSWTDIPSAIKNDMKDGVPAKKRKESEEDYEKRIDNLFKKQDSFSIDYMDACLNKFVENNPYTIEGYFKELGAKDTQSEDIFKQIENAYTDVKPLLNSTYPKNKNLSQDKENVAKIKRFLDTLMSLVHFVKPLLGKGDERNKDEKFYGELSLLWTELETIVPLYNMVRNYMTRKPYSNSKIKLNFDNSQLLGGWDANKESDYSSILLYRDGKYYLAIFDKDSKKLLGKSMPSDGECYEKMVYKLLPGANKMLPKVFFAKSRIKDFKPSEQLLEKYNKGTHKKGKNFSISDCHALIDFFKQSINKHEDWKNFDFNFSETSTYEDLNSFYREVELQGYKITFTKVSASFIDKLVEEGKVYLFQIYNKDFSEYSKGTPNMHTLYWKALFDDRNLKDVVYKLNGQAEMFFRKKSINCNHPTHPANQPIQNKNKDNKKKESVFEYDLIKDHRYTVDKFMFHVPITMNFKSTNEKDINLHVREYLQTSNDTHIIGIDRGERHLLYLVVIDLHGNIVEQYTLNDIVNEYNGNTYRTNYHDLLDAREEDRLKQRQSWQTIENIKELKEGYLSQVIHKITQLMIKYHAIIVLEDLNIGFMRGRQKVEKQEYQKFEKMLIDKLNYLVDKKADIESTGGLLNAYQLTNKFASFKKLGKQSGFLFYIPAWNTSKIDPVTGFVNLLDTRYQNVDKAKAFFAKFDSIRYNKDKDWFEFALDYNNFGSKAEGTRTKWTLCTQGKRIKTSFNKMSSKWNNQEIDLTKDLKQLFVQYDIDINGNLKEAISKQTKYTFFVELMGLLKLTLQMRNSITGTETDYLVSPVADENGNFYDSRTCGPSLPENADANGAFNIARKGLMIIEQIKASDDLSKLKFDISNKSWLNFAQKKPYKHE

SEQ ID NO: 152 - protein, 1307 aa, synthetic construct
MAKKFEDFTKLYPLSKTLCFEARPIGATKSNIIKNGLLDEDKHRAESYVKVKKLIDEYHKAFIDRVLADGCLCYKNEGNEDSLEEYYEFYSLSSKDKSDDTRKHFATIQQNLRSKIAETLTKDKAYANLFGNKLIESHKDKEDKNNIIDSDLIQFVSTATPDQLDSQSKDDATKLIKEFWGFTTYFTGFFENRKNMYTSEEKSTGIAYRLINENLPKFIDNMESFKKIMEKPEMSANMEELRANLEEYLNVESISEMFELNYYNMLLTQKQIDVYNAVIGGKTDEEQDIKTKGINEYVNLYNQQHKDAKLPKLKTLFKQILSDRNAISWLPEEFDKDQNVLNAIKDCYVRLTANVLGNNVLNSLLSTLSEYNTESIFIRNDIQLTNISQKMAGSWNYIQDAIKQDIKNVAPARKRKESEEDYEERISKNFKKADSYSIKYIDDCLNRAYKNNTYTVEGYFATLGATNTPSLQRENLFAQIANAYTNISSLLSSDYSAEKNLAQDKENVAKIKTLLDCIKSLQHFVKPLLGKGDESDKDERFYGELSMLWKELDTVTPLYNMVRNYMTRKPYSQKKIKLNFENPQLLGGWDANKEKDYASILLRRDGKYYLGIMDKESKKLLGKPMPSDGDYYEKMVYKFFKDITTMIPKCSTQLKAVKEHFSKSNADFVLSGKNFNTPLIISKEVFELNNVKYGQFKKFQKDYVATTNDIEGYAHAVKIWIKFCMDFLGTYDSTISYDLSSLASNEYTSLDTFYQDVNRLLYAVSFIKVSVSHIDSLVEEGKMYLFQIYNKDFSEYSKGTPNMHTLYWKALFDERNLADVVYKLNGQAELFYREKSIDCTHPTHPANHPILNKNKDNEKKESIFEYDLIKDRRYTVDKFMFHVPITMNFKSTGADNINQLVREHLKDADAPHIIGIDRGERHLLYLVVIDMHGNIKEQFTLNDIVNEYNGNTYRTNYHDLLDAREDARLKARQSWQTIENIKELKEGYLSQVIHKITQLMVKYHAIVVLEDLSMGFMRGRQKVEKQVYQKFEKMLIDKLNYYVDKKANAEQAGGLLNAYQLTSKFDSFQKLGKQSGFLLYIPAWNTSKIDPVTGFVNLLDTRYQNVEKAKAFFCKFEAIRYNSNKNWFEFTIDYNNFGQKAEGTRTKWTLCTQGKRIRTFRNPEKNSEWDNQEIDLTSALKNLFAHYHIDINGNIKEAISAQSDKTFFTELLHLLKLTLQMRNSITGTETDYLISPVADDNGYFYDSRTCNDTLPKNADANGAYNIARKGLMLIEQIKKAKDIANIKFDISNKSWLNFAQQKPYKDE

SEQ ID NO: 153 - protein, 1274 aa, synthetic construct
MIKEFEDFKRLYPIQKTLRFEAKPIGSTLEHLVKSGILDEDEHRAASYVRVKKLIDEYHKAFIDRVLNDGCLPFKNKGEKNSIEEYYESYTSKDKEEDSKKRFKEIQQNLRSIIVNKLTKDKAYANLFGNYLIESHKDKEDKKTMIDSDLIQFIKDADSLELGSMSKDEAIELVKEFWSFTTYFVGFYDNRKNMYSAEEKSTAIAYRLINENLPKFIDNMEAFKKIISRPEIQANTEQLYSDFAEYLNVESIQEMFQLDYYDILLTQKQIDVYNAIIGGKTDEKHDIKTKGINEYINLYNQQHKEDKLPKLKVLFKQILSDRNAISWLPEEFNSDQEMLISIKDCYEKLCVNVLGDKVLKSLLSSLDDYELEGIFLQNDQQLTNISQKIFGSWSVIQEAIIRNIKNTAPARKHKETEEDYEKRIFSIFKQAGSFSIKYIDDCLYDLDKNNINTIENYFATLGAENTPEIQRENLFALIKNAYTDVAGLLCSEYPTEKNLSQDENHVAKIKALLDAIKSLQHFVKPLLGNGDEHDKDERFYGELVSLWTELDTVTPLYNMVRNRITQKPYSQKKIKLNFENPQLLGGWDANKEKDYSCIILRREGMYYLAIMDKDSRKLLGKEMPSDGECYEKMVYKLLPGANKMLPKVFFAKSRIEEFMPSEQIIEKYNNGTHKKGKDFNITDCHNLIDYFKQSINKHEDWSKFGFTFSETSTYEDLSGFYREVEQQGYKLSFTNVSASYINSLVDEGKMYLFQIYNKDFSEYSKGTPNMHTLYWKALFDEQNLADVVYKLNGQAEIFYRKKSIDATHPTHPANRPVQNKNKDNKKKESLFEYDLIKDRRYSVDKFMFHVPITMNFKSNGSENINQQVKEYLQLANDTHIIGIDRGERHLLYLVVIDMHGNIKEQFSLNEIVNTYKGNIYHTNYHDLLEAREEERLKARQSWQTIENIKELKEGYLSQVVHKITQLMVKYHAIVVLEDLNMGFMRGRQKVEKQVYQKFEKMLIDKLNYLVNKQANITEAGGLLNAYQLTSKFDSFQKLGKQSGFLFYIPAWNTSKIDPVTGFVNLLDTRYQNVEKAKAFFSKFDAIRFNQDKDWFEFNLDYNKFGEKAEGTRTRWTLCTQGKRIYTFRNEDKNSQWDNIEIDLTSEMKSLLELYHIDIQGNLKEAINSQTDKSFFTKLIHLLKLTLQMRNSITRTETDYLISPVADEDGEFYDSRSCGPELPKNADANGAYNIARKGLMLIRQIKEAKELDKIKFDISNKAWLNFAQQKPYKND

SEQ ID NO: 154 - protein, 1319 aa, synthetic construct
MAKIFEDFKRLYPLSKTLRFDAKPVGATLDNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLIQFINTADSTQLDSMTQVEAKELVKEFWGFVTYFYGFFDNRKNMYTAEKKSTGIAYRLINENLPKFIDNMEAFKKVIARPEIQANMEELYSDFSEYLNVESIQEMFQLDYYDMLLTQKQIDVYNAIIGGKTDDEHDVKIKGINEYINLYNQQHKDTRLPKLKALFKQILSDRNAISWLPEEFNSDQEVLNAIKDCYERLSENVLGDKVLKSLLGSLADYSLEGIFIRNDLQLTDISQKMFGNWGVIQNAIMQNIKHVAPARKHKESEEEYEKRIAGIFKKADSFSISYLNDCLNEADPNNAYFVENYFATFGAVNTPTMQRENLFALVQNKYTEVAALLHSDYPTAKHLAQDKANVAKIKALLDAIKSLQHFVKPLLGKGDESDKDERFYGELASLWAELETVTPLYNMIRNYMTRKPYSQKKIKLNFENPQLLDGWDANKEKDYATIILRRNGLYYLAIMGKDSKNLLGKAMPSDGECYEKMVYKQFDISKQLPKCTTELKHVRKALVEDAKRSCLLSDFNNWNKPLNVTRKLWELNNFVWDKKKEDWVLRKKDNETRPKKFHKKYLELTSDKKGYNQAKNDWIKFTKEFLSSYKKVEAYDIHYKKRYNSVDELYKQLNGDLYAISFTYVSASFIEQLVSEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKMGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEIDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLNNLKFDISNKAWLNFAQQKPYKNG

SEQ ID NO: 155 - protein, 1319 aa, synthetic construct
MEFNDFKRLYPLSKTLRFEAKPIGDTLKNIIKNGLLEEDEHRAQSYVKVKKLIDEYHKVFIDRVLNDGCLTIENKGKKDSLEEYYESYMSKSNDENVSKTFKDIQENLRSVIANKLTKDKGYANLFGNKLIESYKDKDDTKKIIDSDLIQFINTAEPSNLDSMSQDEAKELVKEFWGFTTYFEGFHKNRKNMYTSEEKSTGIAYRLVNENLPKFIDNMEAFKKAIAKPEIQANMEELYSNFAEYLNVESIQEMFQLDYYNMLLTQKQIDVYNAIIGGKTDEDHDVKIKGINEYINLYNQQHKDEKLPKLKALFKQILSDRNAISWLPEEFNSDQEVLNAIKDCYERLSENVLGDKVLKSLLCSLSDYNLDGIFVRNDTQLTDISQKMFGNWSVIQNAIMQNIKKKKLARKRKESEEDYEKRIPDIFKKADSFSIQYINDSLNKMDDNNLHAVDEYFATLGAVNTPTMQHENLFALIQNAYTDISDLLDTPYPENKNLAQDKTNVAKVKALLDAIKSLQHFVKPLLGKGDESDKDERFYGELASLWTELDTVTLLFNMVHNYMTRKPYSQKKIKLNYKNTQLLAGWDANKEKEHAAIILRRNGMYYIAIMDKDSKNLLDKAMPSDGECYEKMVYKQFDISKQLPKCTTELKRVRKALIEDAKRSCLLSDSKDWNKPLNVTRKLWELNNYVWDKKKADWVLRKKENETRPKKFHKKYLELTSDKKGYNQAKNDWIKFTKEFLSSYKKVKDYDIHYKKRYNSVDELYKQLNSDFYTISFTYVSVSFIDKLVNEGKMYLFQIYNKDFSNYSKGTPNMHTLYWKALFDERNLADVVYKLNGEAEMFYRKKSINNTHPTHPANHPIQNKNKDNKKKESVFEYDLVKDYRYTEDKFLFHVPITMNFKSVGSENINQQVKEYLQQADDTHIIGIDRGERHLLYLVVIDMEGNIKEQFSLNEIVNEYNGNTYRTNYHDLLDVCADKRLKASQSWQTIENIKELKEGYLSQAIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLFDTRYTNADKALKFFSKFDAIRYNEEKDWFEFEFDYDEFTQKAHGTRTKWTLCTYGMRLCSFKNPAKQYNWDSEVVALTDEFKRILGEAGIDIHENLKDAICNLEGKSQKYLEPLMQFMKLLLQLRNSRKNPEEDYILSPVADENGVFYDSRSCGDKLPENADANGAYNIARKGLMLIRQIKKAKELDKVKFDISNKAWLNFAQQKPYKNE

SEQ ID NO: 156 - protein, 1303 aa, synthetic construct
MEFNDFKRLYPLSKTLRFEAKPIGSTLNNIIKSGLLEEDEHRAQSYVKVKKLIDEYHKVFIDRVLDDGCLTIENKDKKDSLEEYYESYMSKSNDENVSKTFKEIQENLRSVIAKKLTDDKAYANLFGKNLIESYKDKDDKNKIIDSDLIQFINTAEPSQLDSMSQDEAKELVKEFWGFTTYFVGFFDNRKNMYTSEEKSTGIAYRLVNENLPKFIDNMEAFKKAIAKPEIQANMGELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDKEVLNAIKDCYERLSENVLGDKVLKSLLCSLSDYNLNGIFVRNDLQLTDISQKMFGNWSVIQNAIMQNIKNVAPARKRKESEEDYEKRISDIFKKADSFSIQYINDCLNEMDDNNLHAVDGYFATLGAVNTPTMQRENLFALIQNAYTDISNLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMNKDSKKLLGKTMPSDGECYEKMVYKFFKDVTTMIPKCSTQLKDVQAYFKVNTDDFVLNSKAFNKPLTITKEVFDLNNVLYGKFKKFQKGYLSATGDTAGYTHAVNVWINFCMDFLNSYESTCMYDFTSLKSESYLSLDAFYQDANLLLYKLSFTNVSVSFIDKLVDEGKMYLFQIYNKDFSDYSKGTPNMHTLYWKALFDERNLVDVVYKLNGQAEMFYRKKSIDYTHPTHPANHPIQNKNKDNKKKESVFEYDLVKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVIHKITQLMVKYHAVVVLEDLNKGFMRGRQKVEKQVYQKFEKMLIDKLNYLVDKKADATQSGGLLNAYQLKSKFDSFQKLGKQSGFLFYIPAWNTSKIDPVTGFVNLLDTRYQNTEKAKAFFSKFDAIRYNADKDWFEFNLDYDKFGTKAEGTRTTWTLCTQGNRICTFRNAEKNSQWDNQEIDLTREMKSLFEHYHINICGNLKEEICSQTDKAFFTGLLHILKLTLQMRNSITGTETDYLVSPVADENGVFYDSRSCGDMLPKNADANGAYNIARKGLMLIGQIKETKDLANFKYDISNKAWLNFAQQKPYKNE

SEQ ID NO: 157 - protein, 1274 aa, synthetic construct
MDKKFEDFKRLYPLSKTLRFEAKPIGSTLDNIIKSGLLDEDEHRAVSYVKVKKLIDEYHKSFIDRVLDEGCLPFENNGEKDSLEEYYESYKLKSNDENANKTFKEIQQNLRSVIANKLTDDKAYANLFGNKLIESYKDKEDKKKTIDSDLIQFINTAEPSQLDSMSQDEAKELVKEFWGFTTYFVGFFDNRKNMYTSEEKSTGIAYRLVNENLPKFIDNMEAFKKVIAKSEIQANIEELYSNFAEYLNVESIQEMFQLDYYNMLLTQKQIDVYNAIIGGKTDEKHDVKIKGINEYINLYNQQHKDEKLPKLKALFKQILSDRNAISWLPEEFNDDQEVLNAIKDCYERLSENVLGNKVLKSLLCSLADYNLDDIFIRNDLQLTDISQKMFGNWSVIQDAIIQNIKNVAPARKRKESEEDYEKRISGIFKKADSFSILYINSCLNEMDDNSLHAVDGYFATLGAVNTPTMQRENLFALIQNAYTDISDLLNTKYPANKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYSTIILRRNGMYYLAIMNKDSRRLLGKAMPSDGECYEKMVYKLLPGANKMLPKVFFAKSRIDDFKPNIQIVENYNNGTHKKRKNFNIQDCHDLIDFFKQSIKKHEDWSKFSFNFSDTSTYEDLSGFYREVEQQGYKLSFMNVSVSFIDKLVDEGKMYLFQIYNKDFSEYSKGTPNMHTLYWKALFDERNLADVVYKLNGQAEMFYRKKSIDYTHPTHPANHPILNKNKDNKKKESLFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDIREEERLAARQSWQTIENIKELKEGYLSQVIHKITQLMVKYHAIVVLEDLNMGFMRGRQKVEKQVYQKFEKMLIDKLNYLVDKKADATQPGGILNAYQLTSKFDSFQKLGKQSGFLFYIPAWNTSKIDSVTGFVNLLDTRYQNTEKAKVFFSKFDAIRYNEEKDWFEFYLDYDKFGSKAEGTRTKWTLCTQGKRIRTFRNPDKNSQWDNQEVDLTREMKSLFEHYHINICGNLKEEICSQTDKAFFTGLLHVLKLTLQMRNSITGTETDYLVSPVADEEGNFYDSRYCNITLPKNADANGAYNIARKGLMLVKQIKAATDLANFKYDISNKAWLNFAQQKPYKNE

SEQ ID NO: 158 - protein, 1251 aa, synthetic construct
MKKSSLQDFTNQYSLSKTLRFELIPQGETLEHIEKNGLLSQDEHRAESYIIVKKIIDEYHKAFITKALDGVKLNSLEDYFLYYQLPKRDEEQKKKFEEIQTKLRKQIADRFAKQESFKNLFAKELIKDDLINFVKSNDDKLLVAEFQNFTTYFTGFHENRKNMYSAEDKSTAIAFRLIHQNLPKFIDNMRAFDKIKISKVKDSFKTILADDELGAIIQVIAVEDVFTLNYFNDTLTQLGIDKYNQLIGGFTSEDGKIKIKGLNEYINLYNQTAKKEERLPKLKPLYKQILSDRSTASFIPEAFSNDNEVLESIEKLYQEINDLVLNKRVKGEHSLKELLQSLNEYDVSKVYLRNDLSLTDISQKMFGDWGVFQKGMQTWYAVNYKGKNKAGTEKYEDEQKKYFSNQDSYSIGFINECLLLLDTVYQKRIEDYFKLLGERNTEEEKSENLFVLIEKNYNGIKDLLNNPYPHDKNLAQDQANVDKIKNFLDVVKTLQWFIKPLLGKGNEAEKDERFYGEFTSLWTTLDQVTPLYNKVRNYMTQKPYSTEKIKLNFENSTLLDGWDVNKEVDNTAMIFRKNGLYYLGIMNKKHNKIFKTDIANTGGECYEKMEYKLLPGANKMLPKVFFSNSRIDEFKPGTELLENYKNETHKKGDNFNLNDCHHLIDFFKTSINKHEDWKHFGFQFSDTKTYNDLSGFYREVEQQGYKITYKAISENYIAQMIAEGKLYLFQIYNKDFSPYSKGMPNMHTLYWKMLFDAVNLKNVVYKLNGQAEVFYRKLSIKAENIITHKANVPIHNKNEENEKKQQSRFDYDIIKDKRYTMDKFQFHVPITMNFKAKGLNNINIEVNQYLKKESDIHIIGIDRGERHLLYLTLIDGKGNIKQQFSLNEIINEYQGKTYKTNYHDLLDKKEGDRDDARRNWKTIETIKELKEGYLSQVIHKISELMVEHNAIVVLEDLNMGFMRGRQKVEKQVYQKFEKMLIDKLNYLVDKKKNPTDLGGTLNAYQLTNKFESFQKMGKQSGFLFYVPAWNTSKMDPVTGFVNLLDTRYENIEKAKTFFSKFDSIHYNPLKKYVEFECDYNRFTTKAEGTQTKWTLCTYKERIETFRDPTQNSQWKSREIVLTDEFISLFEQYGIAYKNKEELKDAIARQTEKVFFERLLHLLKLTLQMRNSITGTETDYLISPVANAKGEFYDSRTASETLPKNADANGAYNIARKGLWVVEQIKQADDLKKLKLAISNKEWLGFVQNYGK

SEQ ID NO: 159 - protein, 1267 aa, synthetic construct
MGWRNGFQKILILINNKKMGNTNLFKGFTNFYPVSKTLRFELKPIGKTLEHIEKNGLLLQDEHRAESYVTVKKIIDEYHKAFIAKALDGLVLNVLEDYHLYYQLPKRDEAQNKKFEELQTEMRKQIADRFTKQDGFKNLFAKELIKEDLKAFVQTLEDRQLVEEFGNFTTYFTGFHENRKNMYSAEDKSTAIAYRLIHQNLPKFVDNMKAFDKIRNSAVKEKFALIISDDELGPIIQVKDIEEVFCLDYFNETLTQKGIDKYNQLIGGYMPEDGKEKKKGLNEYINLFNQTAKKEERIPKLKPLYKQILSDRSTASFIPEEFECDNEVLESIEKLYQEINKHALPQLKGLMNNLHDFDLHKIYLRNDLSLTDISQKMLGDWGAFQKAMNKWFDLNYKGKAKPGTEKYEEEQKKYFRNHESYSIGFINDCLAKSDIAEHHKKIEDYFKRAGEQINETENLFTLVEKGYSTVNDLLNNPYPKEKNLSQDQQNVDKIKAFLDGIKALQWFIKPLLGKGNEAEKDERFYGEFAMLWTTLDQITPLYNKVRNYMTQKPYSTEKIKLNFENSYFLNGWAQDYESKAGLIFIKDGNYYLGINNKKLTIEEKELLKGTDAKRIILDFQKPDNKNIPRLFIRSKGDNFAPAVEKYNLPIKDVIEIYDSGKFKTDYRKTNEEDYTKSLHKLIDYFKEGFSKHESYKHYPFSWKSTTEYKDIAEFYNDVEVSCYQVFEEGVNWGKIMDFVDQGKLYLFQIYNKDFSPYSKGTPNMHTLYWKMLFDAENLKDVVYKLNGQAEVFFRKSSIKAENKVVHKAEGSIPNKNELNAKKQSTFDYDIIKDRRYTTDKFQFHVPITMNFKARGLNNINTEVNQLIKKENEIHIIGIDRGERHLLYLTLIDSKGSIKQQFSLNEIINQYNGQNYKTNYHNLLDKKEGGRDEARRNWKTIETIKELKEGYLSQVIHKIAELMVEYNAIVVLEDLNMGFMRGRQKVEKQVYQKFEKMLIDKLNYLVDKKKKAGEFGGTLKAYQLTNKFESFQKMGKQSGLLYYVPAWNTSKMDPVTGFVNLLDTRYENMEKAKQFFGKFEAISYKQTKGYFEFEFDYMKYTNKAEGTKTRWTLCTNNERIETYRNPEKNSQWDSREVGLTKEFVSLFEQFGINFKDNAGLKEAICRQTEKAFYERLLHLLKLTLQMRNSITGTEIDYLISPVANDKGEFYDSRTAAEILPQNADANGAYNIARKGLWVIDQIKQADDLKKLKLAISNKEWLGFVQKDV

SEQ ID NO: 160 - protein, 1253 aa, synthetic construct
MKNLTEFTGLYPVSKTLRFELKPQGRTLEYIEKNGLLEQDEHRASSYILVKKIIDDYHKAFIANALRDFKLYSLEDYYLYYNIQKRDDEQKKKFEDIQSKLRKQIADRFTKEESFKNLFAKELIKENLIEFVQTVEDRELIKEFESFTTYFTGFHENRKNMYSAEEKSTAIAYRLIHQNLPKFIDNMRVFEKIANSPVKDKFQTILSDNQLGPVIQVMAVEDMFRLDYFNETLTQIGIDKYNSLCGGFSPNEGKEKIQGLNEYINLYNQTAKKEERIPKLKPLFKQILSDRSTASFIPDEFENDSEVLESIELFYQEVNEQVINKNVEGEHSLKELLKSLPEYELTKIYLRNDLSITDISQKIFGDWGVFQKAMNTWFELNYNGKAKFGTEKYEEEQRKYFANLDSFSIGFINECLLQLDTPYHKNIADYFALRGKTDTETQDLFAVLEDKYNAVTDLLNNPYPQDQDLAQDQKQVDKLKELLDAVKAIQWFIKPLLGKGNEADKDERFYGEFTSLWITLDQITPLYNKVRNYMTRKPYSTDKIKLNFENSYFLNGWAQDYESKAGLIFTKDGNYYLGINDKKLSNEDKTLLKSNSELNLAKRIVLDFQKPDNKNIPRLFIRSKGNNFAPAVEKYNLPIHEVIEIYDNGKFKTEYRKINETDYLKSLHLLIDYFKIGFSKHESYKHYPFSWKNTTEYKDIAEFYHDVEVSCYQVFEENVNWDTLMNFVDEGKLYLFQLYNKDFSPNSKGTPNLHTLYWKMLFDADNLKDVVYKLNGQAEVFFRKSSIKPENIVLHKANEAVNNKNEQNTKKQSRFEYDIIKDKRYTVDKFQFHVPITMNFKARGLNNINTEVNQWLQKSDNVHIIGIDRGERHLLYLTLIDSKGNIKQQFSLNEIVNEYEGKTYKTDYHKLLDNREGNRDEARKNWKTIETIKELKEGYLSQVIHKISELMVEYNAIVVLEDLNMGFMRGRQKVEKQVYQKFEKMLIDKLNYLVDKKQNPAEMGGTLHAYQFTNKFESFQKMGKQSGMLFYVPAWNTSKMDPVTGFVNLFDTRYENMEKARSFIGKFDTIRYNPKKEYFEFDFDYNKFTAKAEGTRTRWTLCTNDTRIETFRNPAKNSQWDNREIILSDEFINLFKLYNIDYQNSDLKVQICKQTEKAFFERLLHLLKLTLQMRNSMTGTEVDYLISPVTNSRGEFYDSRTASDILPKNADANGAYNIARKGMWVIEQIRKATDFRKLKLAISNKEWLSFVQH

SEQ ID NO: 161 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 162 - protein, 1250 aa, synthetic construct
MASLKKFTRLYPLSKTLRFELIPLGLTADHIGKSGILSQDEHRAESYKKVKKIIDEYHKAFIEKVLNNIHLQYDNIEQNNSLEEYFLYYMIKNKDEKKEKIFEEIQKKLRKQIADRFIDDPSFKNIDKKELIRSDLKDFVCSQEDLQLVDEFKDFTTYFTGFHENRKNMYSSEAQSTAIAFRLIHENLPKFIDNIQVFNKVAASSVSEFFTELYANFEECLTVTEIAEMFKLEYFNSVLTQKQIDVYNFILGGKSIEGGSKIKGLNEYINLYNQQQKDKSKRLPKFKPLFKEILSDRNSISWLPEKFKSDEEVLETIEKAYQELNEHVLNRNVGGEHSLKELLVRLEDFNLDKIYVRNDQQLTDISQKIFGHWGTISKALLEELKNEVPKKSNKETDEAYEERLNKILKSQGSVSIALINNSIQKLNIEEKKTVNSYFSLNSNICPKDNLYTRIENAYLEVKDLLNTPYTGKNLAQDKLNVEKIKNLLDAIKSLQHFVKPLLGDGKEPEKDEKFYGEFLSLWEELDKITPLYNMVRNYMTQKPYSTEKIKINFENSTLMDGWDVNKERDNTSVILRKDGLYYLAIMNKKNNQVFDAHNTPSNGICYEKMEYKLLPGANKMLPKVFFSKSRIHEFAPSKKLIENYKNETHKKGTTFNLDDCHKLIDFFKTSIKKHEDWNRFEFKFSDTTTYEDLSGFYKEVEQQGYKISFRNVSADYIDNLVKEGKIYLFQIYNKDFSPYSKGTPNLHTLYWKMIFDERNLANVVYKLNGQAEVFFRKSSISYDKPTHPANQEIDNKNILNKKKQSIFSYDLIKDKRYTVDKFQFHVPITMNFKSTGQDNINLSVNEYIRQSDDLHIIGIDRGERHLLYLTVIDLEGRIKEQYSLNEIVNIYNGNEYHTNYHDLLSKREDEREKARQSWQTIENIKDLKEGYLSQVIHKISELMIKYNAIVVLEDLNIGFMRGRQKVEASVYQKFEKMLIDKLNYLANKKIDPEEEGGILNAYQLTNKFTSFQKIGKQSGFLFYTQAWNTSKIDPSTGFVNLFDTRYETREKSKMFFSKFDSIKYNKDKDWFEFIFDYTNFTTKAEGTRTQWTICSYGKRIETLRDENKNSNWVSTEIDLTQSFKNFFTKYGIDINDNLKEFIVQQDTSEFFKGILYLFKLTLQMRNSAIGKDIDYIISPIADEKGIFYNSNECDSSLPKNADANGAYNIARKGLYIVRKIKHSDELKNLNLAITNKEWLQFAQSKPYINK

SEQ ID NO: 163 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 164 - protein, 1255 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDEMQKRQFADIQDKLRKQITQRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGKKIQGLNEYINLYNQQQKDKSARLPKLKPLYKQILSDRNAISWLPEQFQSDEKVLEAIQKAYQDLEEQVFNRKKEGEHSLKDLLLSLSDYDLSKIYIRNDTQMTDISQKAFGHWDVIHKALLEQLKEDVQKKPKKESDEAYEERLNKIIKSQGSIPIALINQGVQKQNSEEQNTLQTYFASLGAVETESVKKENLFTQIENAYAEVKDLLNTPYSGKNLAQDNVAIEKIKTLLDTIKALQHFVKPLLGDGTESEKDEKFYGEFSMLWEELDKITPLYNMVRNYMTRKPYSTEKIKLNFENSTLMNGWDLNKEQDNTTVILRKDGMYYLAIMNKKHNRVFDVKNISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLADVVYKLNGQAEVFFRKSSIICDKPTHPANQPIDNKNALNNKQQSVFEYDLVKDKRYTVDKFQFHVPITMNFKSTGGDNINLLVNEYIRQSDDLHIIGIDRGERHLLYLTVIDLQGRIKDKEQYSLNKIVNTYNGDEYPTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFDSFQKLGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASQGINLTDKFKELFAKYKIDIQADLKEAISQQDSADFFKGLLYLLKLTLQMRNSEIGTEIDYMQSPVADANGNFYNSDTCDDSLPKNADANGAYNIARKGLWIVQQIKAADDLKNVKLSISNKEWLKFAQEKPYLNE

SEQ ID NO: 165 - protein, 1257 aa, synthetic construct
MFIMTSLKRFTRVYPLSKTLRFELKPVGKTLDHIVSSGLLEQDQHRAGSYVEVKKIIDEYHKAFIESSLDDFELQYYNEGKNNSLEEFYSYYMCRSKDETQKKLFEENQDKLRKQIADRLSKDERFKRIDKKELIEKDLIDFVKKPEERQLLEEFKGFTTYFTGFHENRKNMYSAEAQSTAIAYRLIHENLPKFIDNIMVFDKVAASPVADSFAELYANFEEYLNVTEIAEMFNLAYYNVVLTQSQIDVYNAIIGGKTFENGVKIKGLNEYINLYSQQQKDKSARLPKLKPLYKQILSDRNAISWLPEYFSEDEKLLEAIQKSYQELDEQVFNRKREGEHSLKELLLGLEGFDLSKIYIRNDLQLTDISQKVYGSWSVIQKALLEELKGEVQKKSKKETDEAYEDRLNKILKSQGSISIALINDCVHKLNSEEQNTIQGYFATLGAVDNQILQKENLFVQIENAYTEIKDLLNTPYQGRNLAQDKVNVEKIKNLLDSIKSLQHFVKPLLGDGSEAEKDEKFYGEFVALWDELDKITPLYNMVRNYMTRKPYSTEKIKLNFENSTLMDGWDLNKEQANTTVILRKDGLYYLAIMNKKNNKVFDVKNISSKGECYEKMEYKLLPGANKMLPKVFFSKSRIHEFAPSEQLLENYNNETHKKGATFNLSDCHALIDFFKASINKHEDWSKFGFNFSDTSSYEDLSGFYREVEQQGYKISFRNVSVDYVDSLVEEGKIYLFQIYNKDFSLYSKGTPNLHTLYWKMLFDEKNLADVVYKLNGQAEVFFRKSSINYERPTHPANQPIDNKNPQNEKKQSVFNYDLIKDKRYTVDKFQFHVPITMNFKSTGSENINQSVNEHIQKSDDLHIIGIDRGERHLLYITVIDLKGRIKEQFSLNEIVNHYNGKNHCTDYHALLSKREEERMKARQSWQTIESIKELKEGYLSQVVHKISELMVKYNAIVVLEDLNMGFMRGRQKVEASVYQKFEKMLIDKLNYLADKKKGPEEEGGILNAYQLTNKFVSFQKMGKQSGFLFYVPAWNTSKIDPVTGFVNLFDTRYETREKAKAFFAKFESIRYNEDKDWFEFAFDYSKFTSKADGSCTKWTVCTYGKRIETFRDEKQNSNWVSKEVCLTEKFKDFFAKYGIELRSNLKEYIISQDSADFFKGLLSLLKLTLQMRNSETGTDVDYLQSPVADANGEFYNSENCDESLPENADANGAYNIARKGLWVVKQIKGADDLKNLKLAISNKEWLQFVQAKPYLND

SEQ ID NO: 166 - protein, 1262 aa, synthetic construct
MKTFQQFSRVYPLSKTLRFELKPIGSTLEHINKNGLLDQDQHRAKSYIQMKNIIDEYHKEFIEDVLDDLELQYDNEGRNNSISEFYTCYMIKSKDDNQRKLYEKIQEELRKQIANAFNKSDIYKRIFSEKLIKEDLKNFITNQKDNDKREQDIQIIEEFKNFTTYFTGFHENRKNMYTSEAQSTAIAYRLIHENLPKFIDNIMVFDKVAASPIADSFSELYTNFEECLNVMSIEEMFKLNYFNVVLTQKQIDVYNAIIGGKTIDNTNIKIKGLNEYINLYNQQQKDKSARLPKLKPLYKQILSDRNAISWLPEQFESDDKLLEAIQKAYQELDEQVLNRKIEGEHSLRELLVGLADYDLSKIYIRNDLQLTDISQKVFGHWGVISKALLEELKNEVPKKSKKESDEAYEDRLNKVIKSQGSISIAFINDCINKQLPEKQKTIQGYFAELGAVNNETIQKENLFAQIENAYTEVKDLLNTPYTGKNLAQDKVNVEKIKNLLDAIKALQHFIKPLLGDGTEPEKDEKFYGEFAALWEELDKITPLYNMVRNYMTRKPYSTEKIKLNFENSTLMDGWDLNKEQANTTVILRKDGLYYLAIMNKKHNRVFDVKAMPDDGDCYEKMEYKLLPGANKMLPKVFFSKSRIQEFAPSSQLLENYHNDTHKKGVTFNIKDCHALIDFFKASINKHEDWCKFGFRFSPTETYEDLSGFYREVEQQGYKISFRNVSVDYIHSLVEEGKIFLFQIYNKDFSPYSKGTPNLHTLYWKMLFDEKNLADVVYKLNGQAEVFFRKSSINYEQPTHPANKAIDNKNELNKKKQSLFTYDLIKDKRYTIDKFQFHVPITMNFKSTGNDNINQSVNEYIQQSDDLHIIGIDRGERHLLYLTVINLKGEIKEQYSLNEIVNTYKGNEYRTDYHDLLSKREDERMKARQSWQTIENIKELKEGYLSQVVHKIAELMIKYNAIVVLEDLNAGFMRGRQKVESSVYQKFEKMLIDKLNYLADKKKQPEEPGGILNAYQLTNKFVSFQKMGKQCGFLFYTQAWNTSKIDPVTGFVNLFDTRYETREKAKTFFGKFDSIRYNDEKDWFEFAFDYTNFTSKADGSRTNWKLCTYGKRIETFRDEKQNSNWTSKEVVLTDKFKEFFKESNIDIHSNLKEAIMQQDSADFFKKLLYLLKLTLQMRNSETGTNVDYMQSPVADEEGNFYNSDTCDSSLPKNADANGAYNIARKGLWIVQQIKTSDDLRNLKLAITNKEWLQFAQRKPYLDE

SEQ ID NO: 167 - protein, 1255 aa, synthetic construct
MGTLKQFTRVYPLSKTLRFELKPIGRTLEFINSSGLLEQDQHRADSYIKVKGIIDEYHKAFIETVLNDFKLNYTDEGKKNSLEEFYTCYMCKAKDEAQKKLFEEIQGKLRKQIADCFSKDDKFKRIDKKELIKEDLVNFVTNQEDRLLIDEFRDFTTYFTGFHENRKNMYSAEAQSTAIAYRLIHENLPKFIDNMLVFDKVAASPVSEHFVGLYSNFEEYLNVMNIAEMFRLDYFNIVLTQKQIDIYNYIIGGRTLDDGTKIKGLNEYINLYNQQQKDKSVRLPKLKPLYKQILSDRNAISWLPEQFESDEKALEAIQKAYQELDEQVFNRNKEGEHSLKELLQTLAEYDLDKIYIRNDLQMTDISQKVFGHWGIISKALLEQLKKELPKKSKKETDEAYEERLNKVLKSQGSISIAQINNSVWVMGMEEQNSIQAYFARLGAVNTETVQQENIFSHIENAYTEVKDLLNTPYPLNKNLAQDKVNVEKIKNLLDAIKSLQHYVKPLLGDGTESEKDEKFYGEFVALWEDLDKITPLYNMVRNYMTRKPYSTEKIKLNFENSTLMDGWDLNKEQANTTVILRKDGLYYLAIMNKKHNRVFDVKNMPESGDCYEKMEYKLLPGANKMLPKVFFSKSRINEFAPSEQLMANYRNETHKKGASFNIHDCHALIDFFKSSINKHEDWSRFGFHFSDTNTYEDLSGFYREVEQQGYKISFRNVSVDYIHSLVEEGKIYLFQIYNKDFSPYSKGTPNLHTLYWNMMFDERNLADVVYKLNGQAEVFFRKSSITCERPTHPANQAIENKNALNEKKQSVFTYDLIKDRRYTVDKFQFHVPITMNFKSTGNDNINQSVNEYIQKCDDLHIIGIDRGERHLLYLTVIDMKGQIKEQYSLNEIVNTYKGNEYRTNYHELLSKREDERMKARQSWQTIENIKELKEGYLSQVIHKISELMVKYNAIVVLEDLNMGFMRGRQKVEASVYQKFEKMLIDKLNYLADKKKNPEEEGGILNAYQLTNKFTSFQKMGKQSGFLFYTQAWNTSKIDPVTGFVNLFDTRYETREKAKVFFCKFDSIRYNRDKDWFEFAFDYNKFTTKAEGTHTQWILCTYGKRMETFRDEKQNSQWTSQECGLTDKFKEFFAKYGIDIHTNLKEAIAQQDSADFFKGLLYLLKLTLQMRNSKTGTDIDYMQSPVADANGNFYNSELCDNSLPKNADANGAYNIARKGLWIVRQIKASDDLRNLKLTISNKEWLQFAQNKPYLND

SEQ ID NO: 168 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 169 - protein, 1263 aa, synthetic construct
MKTLKNLTGLYSLSKTLRFELKPIGKTKENIEKNGILERDNERAIAYKAVKKVIDEYHKAFIELMLDDFELNKDTLNEFYYLYHLPTSEAKRKTDLPKVQEVLRKQISERFTKSEQFKRLFGKELIREDLVEFVKTPQYENIIRKMPGNEQLTDKEVKQIQERVQKDIAQFDDFTTYFSGFYDNRKNMYVPEDIATSIAHRMIGENLPKFIDNMDVFARIAASDVATHFDELNKAMELYLNVNEIPEMFQLDYFHMVLTQKQIDVYNAIIGGKVLDDGTKVQGLNEYVNLYNQQQKDKSKRLPKLKPLFKQILSERNAISWLPDEFDSDNEMLQSIGKCYHDLKEQVFGSLKTLLGSIKDYDLEHIYLPNDLQLTDIAQKHFGDWSVIKNAVIENLQSVNPKKKRENGENYDERILKLQKANDSYSIGFINALLRSKTDDFNPLENYFAGMGAEDNENGQKLNHFARIENAYTEVKTLLNADYPEGKSLSQDKANVEKIKNLLDSIKDLQHYVKPLLGSGMESDKDNRFYGEFTPLWEALDQITPLYNMVRNRMTQKPYSDEKIKLNFDNSTLLAGWDLNKEADNTCTLLRKDGNYYLAIINKRSNKVLKPENLISDGDCYEKMEYKLLPGANKMLPKVFFSKSRIDEFKPSESVLKNYQKETHKKGDNFNLDDCHALIDFFKESINKHEDWSKFGFHFSDTNSYEDLSGFYREVEQQGYKISFRNVSVNYINQLVDEGKIYLFQIYNKDFSPYSKGTPNMHTLYWRMLFDERNLADVVYKLNGEAEVFFRKHSIRVDKPTHPANKPIANKNAQNEKKESIFTYDLVKDRRYTVDKFQFHVPITMNFKAAGLNNINPLVNAYLKESNSTHIIGIDRGERHLLYLSLIDMKGNIVEQYTLNEIVNEYKGNTYRTNYHDLLDAKEKQRDEARRSWQTIENIKELKEGYMSQVIHKIAELMVKHNAIVVLEDLNMGFMRGRQKVEKQVYQKFEKMLIDKLNYLVDKKLDAEEMGGVLNAYQLTNKFEGFQKLGKQSGFLFYIPAWNTSKMDPTTGFVNLFDTRYENMEKSKVFFGKFDSIRYNSAKGWFEFAFDYGNFTAKAEGTRTNWTLCTYGTRIETKRNPEKNNEFDSVEIDLTEQFKALFAKHQIDLSGNLKEQICNQSDASFHKELLHLLHLTLQMRNSVTNSEVDFLLSPVMNASGEFYDSRTCGKNLPENADANGAYNIARKGLWIIEQIKNTNDNDLAKIKLAISNKEWLRYAQGLD

SEQ ID NO: 170 - protein, 1281 aa, synthetic construct
LKNKYYVCIFIKKTINSIINLKETNKMKKFSDFTNVYPVSKTLRFELKPIGKTQENLGKIIDEDNQRAKDYKVVKKVIDEYHKAVIEQLLNGFELDKDTLEKFKDLYHLSISEPKRKDLPKVQEVLREQISKRFIKSEQYKRLFGKELIQEDLPEFVYSSKYGDVIRKQHEKEHLSDDDINRERKRICDEIAQFDDFTSYFGGFHENRKNMYVADDKATSIAHRLINENLPKFVDNMDVFAKIAASDVAQHFDKLYKEMEPYLNVGAISEMFEIGYFSTVLTQKQIDVYNAIIGGKVEEDGRKIQGLNEYINLYNQQQKDKANRLPKLKPLFKQILSDRNAISWLPEEFESDNDMLQRIEECYQNLKEQVFDSLKTLLANIKEYDIAHIYLPNDLQLTDISQKHFGSWSVIKNAVIEKVKAENPQKKKESGEKYEERIAKELKHYDSLTIGFLNDLLKNQVGFTPIEMYFANMGAEDNENGQQVNHFVRIENAYTDICQLLSTEYKGDSLAQDKKNVEKIKNLLDAIKNLQHFVKPLLGKGNESEKDNRFYGEFTPLWEMLDQITPLYNMVRNRMTKKPYSEEKIKLNFENSQLLKGWDLNKEVANTCTMLRKDGNYYLVIMNKKHNTVLQPGKLVSDGDCYEKMEYKLLPGANKMLPKVFFSKSRIGEFNPSERIINNYNNNTHKKGDTFNLDDCHALIDFFKTSINKHEDWSKFDFKFSDTNTYSDLSGFYREVEQQGYKIAFRNVSVQYIDQLVDEGKIYLFQIYNKDFSPYSKGTPNMHTLYWRALFDEKNLANVVYKLNGEAEVFFRKHSLPYKPTHPANQPIANKNSQNKKKESTFAYDLIKDRRYTLDKFQLHVPITMNFKAAGINNINLMVKDYLKESDATHIIGIDRGERHLLYLSVINMKGEIVEQYSLNEIVNEYNGNTYRTNYHDLLDAKEKQRDEARRSWQTIENIKELKEGYMSQVVHKIAQLMVKYKAIVVLENLNMGFMRGRQKVEKQVYQKFEKMLIDKLNYLVDKQCAIDEEGGILHAYQLTNKFESFQKIGTQSGFLFYIPAWNTSKMDPTTGFVNLFDTRYENMEKARLFFAKFDSIRYNTNQNYIEFAFDYDNFTSKAEGTKTKWTLCTYGTRIETKRNPDKNNEFDSIELNLTEQFKALFTTYHIDITGNLKEQICNQNDATFYKGLLHLLHLTLQMRNSVTGTATDYLLSPVMNNKGEFFDSRKCGKNLPENADANGAYNIARKGLWVIEQIKQAEDLSNIDLAIKNKEWMQFAQKNR

SEQ ID NO: 171 - DNA, 3750 bp, synthetic construct
  source 1..3750: mol_type = other DNA
atggatatgaagtcactgaacagctttcagaaccaatattcactttcaaaaacgctgagatttcagcttattcctcaggggaaaacactggataatatcaacgagtcccgaatcctggaggaagaccaacaccgctctgagagctacaaactcgtgaagaaaataattgatgactaccacaaggcttacattgagcaagctctgggaagcttcgagttaaagattgcgtctgatagtaagaatgatagtctcgaggagttttactctcagtacatcgcggagagaaaggaagataaggcaaaaaagctgtttgagaaaactcaggataacctacggaagcagatttccaagaagctcaaacaaggagaggcatataagagactgttcgggaaagaactcattcaggaggatctcttggagttcgtcgccaccgaccccgaagcagactctaagaaacggctcattgaggagtttaaagactttaccacatactttatcggctttcacgagaataggaagaatatgtatgccgaagaggctcagtccacagccatcgcgtatcgaatcatccacgagaatctgccaaagtttattgataacattcgcaccttcgaggagctggccaagagctctattgctgacgttttaccccaggtgtatgaggattttaaggcatatctcaaagtggagtcagttaaggagctgttttctctagactatttcaataccgtacttacccagaaacagcttgatatatacaacgcagtgatcggtggcaaatcattggacgaaaactcacgcattcagggactgaatgagtatatcaacctgtataaccagcagcataaggataagaaattgccttttctgaagccactgtttaaacagattctgtccgacaggaatagcttaagctggctgccagaagcattcgacaatgataagcaggtccttcaggcagtgcatgattgctacacatccctgctagaaagtgttttccataaagacggcctgcagcagttactgcagagcctgcccacatataatctcaaaggcatctacttacggaacgatttgagcatgacaaatgtctcacagaagttgcttggcgactggggcgctataactcgcgccgtaaaagaaaagctgcaaaaggaaaaccccgctaaaaaacgtgaatcagatgaagcgtatcaggaacggatcaacaagatttttaaacaggccggaagttatagcttggactacatcaaccaggcactggaagccacagatcagaccaacatcaaggtggaagactactttattaatatgggcgtcgacaatgaacagaaggagccgttgttccaacgggtggcccaggcctataatcaagctagcgatctcctggaaaaggaatatcctgcaaacaaaaaccttatgcaagataaggagtcgatcgaacatatcaagtttctcctggataatctcaaggccgtgcagcattttatcaaacctttgttgggtgatgggaacgaagctgacaaggataaccggttctacggagagctaacggccctgtggaacgagttggaccaggtaaccagactctataacaaagtgagaaactacatgactagaaaaccctatagcgtcgacaagatcaagatcaatttcaagaactctacccttctaaatggttgggataggaataaagaacgagacaacactgccgtcatcctgcggaaagatgggaaattttacctagcaatcatgcataaggagcacaataaggtattcgaaaaattccccgtcggcacaaaggacagcgatttcgaaaagatggaatacaaactgctgcctggtgccaacaagatgctgcccaaggtgtttttctctaaatctcgcatcgacgaattcaagccttccgccgaactgctgcagaaataccagatgggcacacacaagaagggggaattattttcgctaaacgattgccattccctgatcgacttcttcaaggcttccatcgagaaacacgatgattggaagcagttcaattttcacttcagtccaacttccagctacgaagacctcagcggcttctatagagaggtggagcaacagggatacaaacttacttttaagagcgtggacgcggactacattaataagatggttgacgagggaaagatattccttttccagatctacaacaaagatttcagcgaacactccaaagggactcccaatctgcacaccctttattggaagatgctgtttgacgaaaggaatttgcagaacgtggtctataagcttaatggcgaagctgaggtctttttccggaaaaaaagtttaacctacacccggcccacccatcctaagaaggagccaattaagaacaagaatgtgcagaatgccaaaaaggagagcatcttcgactacgatctgatcaagaacaaaaggtttacggttgacagttttcagtttcacgtaccaattacaatgaacttcaagagtgagggacgttctaacctcaacgagagggtgaacgagttcctgcgacaaaataacgatgcccacataattgggattgatagaggggagcgccacttgctgtaccttgtcgttatcgacaggcatggtaatatcgtggagcagttctccctcaactccataattaacgagtaccaagggaatacctatgccactaattatcacgatttactggacaagcgtgaaaaggaaagggaggaggccagggagtcctggcagagtattgagaacatcaaagagctgaaagagggatacctctctcaagtggttcataaaatcgctgacttaatggtgaaataccatgctattgtcgtgctggaagatctgaacatgggcttcatgcgggggcgccagaaagttgaaaaacaagtgtaccagaaattcgagaaaatgctgattgacaagctaaactatttggtagacaaaaagcaggatgctgagacggacggcggactgctaaaagcatatcagctgacaaaccagtttgaatcatttcagaagctcggtaagcagtcgggcttcctgttctacgtgccagcctggaacacgtctaaaatcgatccgtgtaccggattcacgaacctcctggacactcgatacgagtcaatcgaaaaggcgaaaaagttttttcagaccttcaatgccattagatataatgcagcccaagggtacttcgagtttgaactcgactacaataagttcaataagagggctgacgggacacagaccctctggactctgtgtacctatgggccacgcatagagacactcaggtccaccgaggacaataacaaatggacttctaaagaggtggacctcaccgacgagctgaagaagcatttttaccactatggcattaagctggatgcagacctcaaagaagctataggtcagcagactgacaagccttttttcactaacttactccaccttttgaagctgacactccagatgcgcaattccaaaataggcaccgaagtcgactaccttatatcaccgatccgaaacgaggatggtactttctatgacagtagacaaggaaataagtcgctgcctgccaatgccgatgcgaatggagcctacaacatagctcgtaagggcttgtgggttatcaatcaaataaaacagacaccccaagatcaaaaaccgaagttggccattaccaataaggagtggcttcagttcgcacaagaaaaaccataccttaaggactga

SEQ ID NO: 172 - DNA, 3702 bp, synthetic construct
  source 1..3702: mol_type = other DNA
atggatcacttcaccaatctgtaccctgtgtcgaagaccctgagattcgagctgattccagacaagcgcaccaaggcaatcctggagcgcaccgacctgatcgcccaggatgagcatcgagctgagtcttataaactcgtgaagaagatcatcgatcggtatcataaaaagttcatcgacagtgtgctgggaactctgaaactgcctctggacgaactggactcactgcacgagctgtacagcaaatctcagaagtcagacgccgacaaaaaggccctcgagaagatccaggacaagctgcggaaactgatcgcagacgccctgactaaggattctaggtacaagaggatcgacaagaaagagctcatcagagaggacatcctgtctgtgatcgagcccgaggagcaagccctgatcgacgagttccgggacttcaccacatactttacaggctttcacgagaacaggaggaacatgtactccgctgaggcccagagcaccgctatcgcctatagactgatccacgagaacctgcctaagtttatcgacaacatggccacttttgagaagatcgcagcctctcccgtggccgagcacttcccacagctgtaccaggagatggcagaatatctgaacgtgcgggagatcggtgacctcttcaagctggattactacacagagctgctgacgcagagtcagatcgaggcttataacgcagtcatcggcggaaggactgtggaggagtctggaaagaagatccaggggatcaacgagtacgtgaacctgtacaatcagcagcagccctctagagacactcggctgcccaagctgaagcccctgtttaagcagattctgtctgatagggaggctgtgtcttggctgcctgaggagtttgagagcgataaagacatgctgaccgccgtgaaggagtgctaccacagcctgaacgatcacgtgtttgatcctctgcgcgagctgctgacaaacctgtctagttacaatctggacggcatctacatccccaacgatctgagcctgacagacattagtcaggccatgttcaaggattggtctgtgatcaaaaaggccatcgccgaagacgtgaaaaggaactgcccactgaaaaggaacgaaaaggccgacaattatgaggagaggattagtaagctgatcaagagagaaaacagcttctccattgggtacatgaatcactgcatccaggagaaggatatctgcgatcatttcgctaccctgggcgctagcgacaacggggaggagcaaaccgtgaacctgtttctgcagatccagaatgcctacaccgacgctcagagcctgatcgaaaatgactatcccgaggatcggaacctggcccaggacaaagagaacgtcgccagactgaaggccctgctggatgctgtgaaggccctgcagcggtttgtgaaacctctgaggggcaacggagacgagcctgacaaggacgagcgattctatggcgagctggccgtgctgtgggaggagctcgaccacatcacacctctgtacaacaaggtgcggaaccgcatgacaagaaagccctacagcatcgaaaagtttaaactgaacttccagaattccacactgctggacggctgggatctgaataaagagcgcgataacaccggagtgattatgagaaaggacggcaagtacttcctggccatcatgaacaaacagttcaatagaattttcgttgacgccccccaggccggacacgacgaggataccttcgagaagatggagtataagctgctgcccggagctaacaaaatgctgcccaaagtgttcttcagcaagtcccggatcgaagaattcaagcctagcccagagctgctggagcactatgagaagggcacccacaaaaaaggagataactttagtctgaaagactgtcatgagctgattgatttctttaaggccagcatcgccaagcatgaggactggtctaagttcgacttccatttttccccaactgatacatatgaggatctgtccggcttctacagggaggtggaacagatgggctataagatcagctacaagcagattcccgtgtcatacatcgacaagatggtggaggaaggaaagctgtttctgttccagatttacaacaaggatttcagcccatatagcaagggaacccccaatctgcacacgctctactggaagatggtgtttgacgaacggaacctggccaatgtggtctacaaactgaacggccaggccgaggtgttctataggaagaaatctctggactatgacagacctacccatcccgctaaccaggcaattaagaacaagaaccccgagacaacaaagaaagagtccacctttgattacgacatcatcaaagacaagagattcaccatggataaattccagttccacgtccccattaccatcaacttcaaggccaccgggtctggctctatcaatcctctggttaatcagtacatccacgaccacgacgacctgcatttcatcggcatcgatcggggcgagagacacctgctctacgtgaccgtgattgacagcaagggatgcatcaaggagcagttcagcctgaacgagatcgtgaacgagtaccagggcaacacctataagaccaactaccgcagcctgctggataaacgggacgacgagcgccagcgggagcggcagagctggaataccatcgagggtattaaggaactgaagcagggatacctgtctcaggtgattcacaagatcgtgagcctgatggtgaaataccacgctgtggtcgtgctggaagacctgaacatgggcttcaaacgcggccgccagaaagtcgagtcctccgtgtaccagcagtttgagaaggccctgattgataagctcaacctgctgatcgacaagaaaatcgacgccgatcagcccggtggcctgctgcacgcctaccagctgaccaacaagttcacctcctttagagacatgggcagacagaacggcttcctgttctatattcccgcatggaacaccagcaaaatcgatccagtgaccggcttcgtggacctgctgcatcctagatacgagagcgtggacaaatcccgctccttcttctgcaagtttaagagcatcaggtacaaccaggacaagggatggtatgagttcaccatggactataatgacttcacaactaaggctgaaggaacaaggacagagtggactctctgcacacacggcacccgggtggagacattcaggaacgccgagaaaaattcctcctgggattccagagaggttaatctcactgacgagttcaatgccctgtttgcgacctacggcgtcgagccccagggcaatctgaagcaggctatcgccgagagatcccagaaggaattcttcgataaactgacccacctgctggccctgacactgcagatgcggaataacatcaccggcaccgaagtggactacatgatctcccctgtggctgacgagaatgggaaattcttcgatagtcggacctgcgggaaggaactgccagaaaacgctgacgccaacggggcctataacatcgcccgaaaaggactgtgggtcgcccggcagattcaggccgcccacgtggatgagaaggtgaacatggccatctccaacaaggaatggctgtccttcgctcagtccaagccctatctgaatgactga

SEQ ID NO: 173 - DNA, 3720 bp, synthetic construct
  source 1..3720: mol_type = other DNA
atgaaacagttaaatgatcttactggtctgtactcactcagtaagacccttcggttcgaactgaaacctattggaaagaccctcgagcatattgaatcgaaaggattcattacacaggacgagaagagggccgaagaatacaagagagtaaaagatatcatcgatcggtaccacaaaagcttcattacaatgtgtctctgtggttttaaattcaatcaggaagacctcgacacatacgccgctctggcggaagacttcaatagagatgaaaaagcctttgaggagtctaaaaagactttacggaagcagatcgtgggagcctttaagaaaggcggcggctatagcgaccttttcaagaaagaactgatccagaagcacctgccagagatcgtgacagatgacgaggaaaagaaaatggtcgaaaacttctccaagttcacaacatatttcaccggtttcaacgagaatagaaagaatatgtactccgacgaggaaaagagcaccgcgattgcttacaggctgatacatgacaacctgcctatgtttcttgacaatacgcgtagtttctcccggatcgctgatagcgacgttaggcagtctttctgcaaaatagagtcatcttttagcgaatacctgaatgtggagcatctcgcagagatgtttcagctggattacttcagtgagacattgacgcaggaacagatcgcagtgtataaccacgtggttggtggccgcacattggaggacggaaccaaaattcagggaattaacgagtatgtcaacctatataaccagcagcataaggataatcgattaccactcctcaaaccgttgtataaaatgattctctcagatcgagtggcactgtcttggctgcccgacgaatttgcaaatgacaaggagatgatcgacgccatcaaagagacatacgattcactgaaggaaaatctcactggtgacggcgatggtagtcttagaaatctgctgctcaacatcaacaattacgatatcgagcacatctatattgcgaacgaccttggactaaccgacatcagtcagcagatgtttgggcaatatgacgtgtacacatccgctatcaaacaggaacttagaaattccgtcactcctacggctaaggaaagacgcgaaccagaactctatgctgagagaattaacaagctctttaagtccactaaatcattctctgtagcttacctgaactctttggtggatgccgagcacaccatccagaactactatcaacagcttggagcctatgatcgcgacggcgaacagcgcatcaatctctttactcaactggaaatggcttacgttgcagctaaagatattctgtccgggaagcatggtaacatctctcaaaccgatgccgagattgccattattaagaacttgctggatgcctacaagtccctgcagcattttataaaacccctgctggggaatggggatgaggcggacaaagacaacgagttcgacgcaaaactgagagaggtgtgggacgctttggacatagtcacccccctatataataaggttcgaaattggcttactcggaagccatattccacggagaaaattaagctcaattttgagaatgcccagctgctgaatgggtgggacaagaacaaagagacggactgcacaagcgtgctgctcaggaaggacgggaaatacttcttagcaatcatggataagaaggctaaccgtgcattcgatgtcgaagaccttccctgcgatggcatttgcttcgagaaaatgaactacaaacaaatcgcgctccccatgggcttaggggcgtttgtcaggaagtgcaccggctcggcaaaaaaactgggttggacctgtccctccagtctgctgaacaaggacatgaagatcatcatcaaagatgatgaggctactaatgtcctcccttctttaattgagtgctacaaggacttcttaaatatctatgagaaggacggcttcaagtataaggacttcaactttaagttcaagccaacccacgagtataagaagctgtcacacttttttgcagaggttcctactcagggctataaaattacttttcggaaagtaagcgagtcattcatcaaccaactggttgatgaagggaagctgtatctgttccagatatggaacaaagacttctcggaattcagtaaagggtcacctaatatgcacacactctactggaaaatgctatttgacgagcgcaatctggctgacgtggtatataagctgaacggccaggccgaagtcttttaccggaagtcaagtttagacgtggctaacaccaccattcacaaggcccatcagcccatccttaacaaaaaccaggaaaacaaaaagcaacagtccactttcgactacgacataattaagaatcggcgttacaccgtggataaatttcagttccatgtgccaatatccatcaacttcaaagcaactggcagggataatgttaactctcaggtcctggatatcatccggaatggcggaattaagcacattattggtattgatcgaggggagcggcacctattatacctaagtttgatagacttgaaggggaacatcgtgaagcagatgacactgaatgatatagtgaatgagtacaacggaaacacctacgcaacaaattacagagacttgctggcagagcgcgagggcaatagaactgaggcccgcaagaactggaagaaaatcgaaaacatcaaggacatcaaacaaggctatctttctcaagttgtgcacataattagcaagatgatggtcgaatacgacgccatcgtggtcctggaagatctcaacatgggcttcatgcggggaaggcaaaagattgaaagatccgtctatgagcaattcgagaagatgctgattgacaagctcaattattacgtagataagcaaaaggacgttaacgaagccggcggcttgctccatgcccttcagctaacctcccgcttcgagagctttaaaaaactcggaaagcagagtgggtgtttgttttacatcccagcctggaataccagcaagatagaccccgtaaccggatttgtgaacctgtttgatacgaggtacaccaatgccgatcaggccagaaagttctttagcctgtttgatagcataaggtataacgccgagaaaaactggtttgagttcgcctttgactacgataaattcacaacaaaggccaaagggactcgcacacggtggactctgtgcacatatggaactcgtataaggacgttcaggaacccagccaagcttaatcagtgggacaataaagaagtggtgttaaccgatgagtttaagaaggcgtttgccgatgccggtattgatatccacgggaacttgaaggaagctatatgttcactggaggataaaaaataccttgaaccgttgatgcatctgatgaaactgctcctgcagatgcgcaactctatcaccaacaccgaggtggactatctcctgagccctgtcgctgataaaaacggcagcttctatgattctagggtgtgtagctatgccttgcctaaggatgcagacgcaaacggggcttacaatatcgctcgtaagggactatgggctattcgccaaatccaggaaacccctgtgggagagcgaccgaatctggcaatcaagaataatgagtggttgaaatttgcccaacagaagccctaccgagacgaatga

SEQ ID NO: 174 - DNA, 3765 bp, synthetic construct
  source 1..3765: mol_type = other DNA
ctgctgaactacaaatactacatcgtgatgaagacatacgatgagctgacgggcctgtattccctgagcaaaacgctgagatttgagctgaagcctgtgggtaagaccctggagtacatcgagaacaagggcatcatcgctcaggacgagaagcgcgccgaggaatacaagctggtgaaaggcattatcgacagataccacaaatccttcatcagactgtgtctgtacaactttaagctgaagctggaatctgacaacggactggatagcctggaagagtacgtggaatacgcctcaatccaacggaggaccgacacccaggacgctgagttcaagaaggtgaaagagaacctgaggaagcagatcgtgagcgcatttaaaaacggggccacctatggcgatctgtttaagaaggagctgatccagcagatcctgcctgatttcgccgacaatgatgaggagagacagctggtggacaactttagcaagttcacaacctacttcaccgggtttcatgagaacaggaaaaatatgtactccgaggacgataaagctaccgccatcgcattccggctgatccacgagaatctgcccctgttcattgacaacatgaagagttttgccaagatcgccgagaccgtggtggccgagcacttcgccgatatcgagacggcttttgaggattgtctgaacgccctgatccccgatatgttcgctctgccatacttcaccaaaacactgacccaggagcagattgaagtgtacaataatatcatcggaggcagggtgctggaggacggcaccaaaatccagggcatcaatgagtacgttaacctctacaaccagcaacagaaggacaagtctgcgcgcctgcccctgctgaaaccactgtataagatgatcctgagcgatcacgtggccatttcctggctgcccgaggagttcgccagcgatgaggagatgctgtctgccatcaacggggcctacgacatgctgaaggacgtgctgtctgaaaagaacgaggactctctgttcaacctgctgaagaacatcaacgagtacgacaccgagcacatctttatcgctaacgacctgggcctgaccgacatttcccagcagatcttcggccagtacgacgtgtatagcagtgtgattaaagctgagctgaggaatcaggccagtatgaccgccaaggagaagaagaatcccgagctctatgaggacagaatcgccaaactgtacaaatcagccaaatcatttagcatcgattacctgaatagttttgtagacagcgaaaagtcaattcagaattattatgcccagctgggggcatacgaccgggatggcgagcagaggatcaacctgtttgcccagatcgaaatgaagcacatcgccgtggccgacatcctggccggaaaggtggccaatctgaaccagagcgaacagggcatcaaactgattaaggacttcctcgacgcatttaaagccctgcagcatttcatcaagcctctgctgggaaacggcgacgaaactgataaggacaacgccttcgacgccagactgagggtggcatgggacactctggacatcattactcccctgtacaacaaggtgcgcaactggctgacaagaaagccctactccgaggagaagatcaagctgaacttcgaaaacgcccagctgatgaatggctgggacctgaacaaggagcccgattgcacctctatcatactgagaaaggacgacaagttttacctggcaattatggacaaaaaggccaaccattccttcgataccgacgagctgcccaacgagggagattgttatgagaaggtggactacaagctgctgcctggcgccaataagatgttgcccaaggtgttttttagcaagagccgcatcgacgaatttgccccaagccagtccctgctggatgcttatgagaagggcagccacaagaagggcaccaatttctccctgaacgactgccataatctgatcgacttcttcaaacagtcaatcgccaaacatgaggactggaagaagttcccctttgattttagtgacacaagcagctacgaagacattagcggcttctatcgcgaggtggaacagcaggggtacatgctgtcttacagaaatgtgtctgccgcctacattgataagctggtcgacgagggcaagttgttcctgttccagatctggaacaaagatttttccgaatattccaaaggcactcctaacatgcacaccctgtactggaagatgctgttcgatgagaagaatctggccaacgtggtgtacaaactgaacggacaggcagaggtgttctaccgcaagaagtccctggacattgcaaataccacagtgcataccgctaaccggcctattgccaacaagaacaaggataacaagaaaaaagagagcacattcgagtacgacatcattaaaaaccggcggtacaccgtggacaagttccagttccacgtgcccataaccatgaacttcaagagcattgggaacgacaatatcaatgagagcgtgctgaatgtgattcggaataacgggattaagcacatcatcggaatcgacagaggcgagaggcatctgctgtacctgtcattgatcgatctgaaaggcaatatcgtgaagcagatgaccctgaacgacatcgtgaacgaatataatggcaacacctacagcaccaactataaggacctgctggccaccagggagggagataggaccgacgccagacgcaactggcagaaaattgagaacatcaaggacctgaaggagggatacctgtctcaggtggtgcacgtgatagcaaagatgatggtggagtacaaagccatcgtggtgctggaagatctgaacatgggctttatgcagggcaggcagaaaatcgagagaaacgtgtacgagcagtttgagcggaaactgatcgagaagcttaacttttacgtggacaaacagaagaaggccgacgaggtgggcggactgctgaatgcttaccagctgacctctaagttcgatagtttcaaaaaactcggcaagcagtctggctgcctgttctacatcccagcttggaacaccagcaagatcgaccctgtgaccggcttcgtgaacatgctggacacaagatacgagaataccgaaaaagccaggtgttttttctctaagtttgacagcatcaggtacaacacccagaaggactggttcgagttcgcctttgactatgggaacttcaccaccaaagccgatggcacccagaccaaatggaccctgtgctccttcggcactagggtgaagaccttcagaaaccccgagaaggtgaatcagtgggacaatgtggaggtggtcctgactgaggagtttaagagcctcttcgctgacgccggcatcaacatcaacggcaatctgaaggagcagatatgcaatctgtccgacaagaagtatctcgagccactgatgggcctgatgaagctgctgctgcagctgaggaatagtatcaccaatagcgaggtggactacctgctgagcccagtatgcgacaataaagggaacttctacgactcaagaacctgcagtaataagctgcctaaggacgccgatgcaaacggggcctacaacattgcaagaaaaggcctgtgggccctggctcgcatcgtggatagcgctgaaggggagcggcctaacctggccatctccaataaggactggctgtgtttcgcacagcagaaaccttatctgaacgattga

SEQ ID NO: 175 - DNA, 3729 bp, synthetic construct
  source 1..3729: mol_type = other DNA
atggagagatttgacgaactgaccggcctgtacagcctgtccaaaaccctccagttcgagctgaagcctatcgggaagactctggagcagatcgagagaaagggcatcatcgcccaggatgagaaaagggctgaagagtacgagatcgccaagtgtattattgacgagtaccacaaggcctttatcagcatgtgtctgaagggactgaggctgaatctgtccagcacaggctctctggacagcctggaggagtacgtggagcaagccagcaagctgagaagaagtgaatccgaggagaaaaatttcgacaccatcaagcagaacctgagacggcagatcgtgaactcctttaagagccgcggcggctctttcactgacctgttcaagaaggagctgattacccagcacctgcccgagtttgtgagtgagaagaacaaaaagcagattgtggagaacttttccaagttcactacttacttcactggcttccacgagaaccggaagaatctgtactccgaggaagagaaatccacagccatcgcttaccgactgattcacgaaaatctgcccatgtttatcgacaacatcaagaccttcgccaaaatcgccgactccgatgtggccaattactttgtggagatcgagaccaccttttccgagtacctggacggctcccatatcactgatatgtttaaactggagtactttaccgaaaccctgacccaggagcagatcagtctgtacaacaacgtgatcgggggcgtgagcaatgaggatggaaccaagaagaaggggctgaacgagtacgtcaatctgtacaatcagcagaataagacccggctgcctctcctgaagccactctacaagatgctgctgtccgacaaggtgtccctgagctggctgcctgatgacttcgtgtctgacgaagagatgatttatgctattaacgaaatgcagctcagcctgaaggacctgctgtactctgacggtgaaaacagcctgaagtatctgctgactcacatcggcgattacgacaccgagcatatttacatctccaacgacctgggcctgaccgacatcagccagcagatcttcggccagtatgatgtgtataccagcggcatcaaaaccgagctctgcaatcaaatcaagcagagcgccaaggaaaagcgcgagcccgaactgtacaaagaaaggatcaacaagctgttcaaaagcgccaaatcctttagcataaactacctcaattccttcgccgagggcgataagaccattcaggcctactatgccagactgggagcacatgatctggagggagagcagagtaccaacctgttcacccagattgaaatggccagcatcgccgcctctgacatcctggccgggaagcacaccaatattaaccaaagcgaggaggataccaagctgatcaaggacctgctggatacctacaaagctctgcagcacttcatcaagcccctgctgggaaacggcgacgaggccgacaaagataacgaattcgacgcccgcctgagaaacgcctgggacgcactgagcgtggtgacaccactgtacaataaggttagaaactggctgactagaaagccctacagcaccgagaagatcaaactgaatttcgacaatgctcagctgctgggggggtgggacctgaataaggagcccgattgcacttcagtgctgctgcggaaggatgacatgttctacctggccatcatggacaagaagtacaaccacgccttcgatatcgatgagctgccatgcgagggcgagtgctacgagaaggtggattataagctcctccccggcgccaataagatgctgcccaaggtgtttttcagcaagtcaagaatttctgaatttgccccatctctggccatccagaagagctacaacgagggcacccacaaaaaggggtccaacttttctatcagcgactgtcaccgcctgattgattttttcaagcagagcattgccaagcacgaagactggtctaaattccctttctctttctccgacactaagagatatgaggacatctcaggattctatagagaggtggagcagcaggggtacatgctgagctatcgcaacgtgtccgtgagctttatcaatcagctggtggacgaggggaagctgtacctgttccagatctggaataaggactttagcaagtactctaaagggacccccaatatgcacacactgtactggaaaatgctgttcgatgaagtgaacctggctgacaccgtttacaagctgaacggtcaggctgaggtgttctacaggaagtctagcctgaaactggaaaacacaaccatccacaaggccaaccagaccattaagaacaaaaatgtgcagaatgagaagaagacaagcactttcgactacgacatcgtgaagaatcgcagatacacagtggataaattccagtttcacgtgccaatcaccctgaacttcaaggccaccggcggcgacaacatcaacgcaaacgtgcaggacataatccggaataatggcatcgagcatatcatcggcatcgacagaggcgagagacacctgctgtacctgagcctgattgatctgaagggtaacattgtgaagcagatgaccctaaacgacatcattaacgaatataagggcaatatctataagacaaactacaaggatctcctggtgacacgcgagggggaccgcacagaggctaggaggaattggcataagatcgagaatatcaaggacctgaaggagggctacctgagtcaggtggtgcacatcatagccagaatgatggccgagtacaaagccatcgtggtcctggaggacctgaatatgggatttatgcgggggcgccagaagatcgagcggaacgtgtacgaacagttcgaacggatgctgatcgataaactgaactactacgtggataagcagaaaaaggccacagagaatggcggactgctgcatgccctgcagctggccaacaagttcgagagctttaagaagctgggcaaacagtctggctgtctgttctacatacctgcttggaatacctccaaaattgatcccgtcactgggtttgtgaatctgtttgaaattcactatgagaatgtggacaaggccaggtgctttttctcaaagttcgatatcatccagtacaacgaggagcgcgactggttcgagtttgccttcgattacaatgactttgggaccaaagctgagggcaccaagtctaaatggaccctgtgcacatatggcaccagaattaaaacctttcgaaaccctaacaaactgaaccagtgggacaatgaggaggtggtgctgaccgaagagtttaagaagatcttcaacgaggctgggatcgacatcaacgggaatattaaggacgcaatctgccagctgaaggagaagaaacaccttgagagcctgatgcacctgatgaaactcctgctccagatgaggaacagcgtgagcaacagcgagatcgactacctgctgagccccgtggccgatgagaatggggagttttacgacagcagaacatgcgccccaactctgccaaaggatgcagacgccaacggagcgtacaatatcgctaggaagggcctgtgggtgatcgagcagatcaaacagactgccgacaagcccaggctggccatgactaacaaggagtggctgaagttcgcccaggataagccctatctgaacgaatag

SEQ ID NO: 176 - DNA, 3738 bp, synthetic construct
  source 1..3738: mol_type = other DNA
atgaatacctttaacgagctgtccggcctgtacagcctgcggaagaccctgcagttcgagctgaagcccatcggaaagaccctggaaaacatcgagaaaaagggcatcatcgagcaggacacacagagagatgtggaatataagaaggtgaagggcatcatcgacaactaccacaaggcctttatcaaaatgtgcctgtggaacctggagctgaagctggagagcgatggccactccgactccctggaggactacgtgagactggccagtatcatcagaagaggcgagctggacgagatcgagttttctaaagtcaaggacaacctgcggaagcagatcgtgtcggcttttaagaatgggaactcctatggcgatctgtttaaggaggaactgatccaggaacacctccccaactttgtgactgatgaggctgagaagcagatggtggataatttcagcaagttcaccacttacttctccgagttccataagaacagaaaaaatatgtatagcgacgagaagaagtcaaccgccatcgcatacagactgatccacgagaacctgccaatcttcatcgataacatcaagaccttcaaaaagattgccaacactgaaatcgtgaaccactttgccgacatcaagcaggcttttcaagaatgtctgaacgttgagaacatcgacgaaatgttccagctgaactacttcaccaagacactgccacaggagcatatcgagacctacaataacattattggcgggaaaaccaacgaggacgggagcaaaatccagggcctgaatgagtatatcaacctgtataaccagcagcagaaggatcacagcaacaggctgcccctgttcaagcccctttataagatgatcctgagcgacagagaagccctgagctggctgcccgaagagtttgccagcgacgaggagatgattaatgccatcaacgaggtgtatgatagccttaaaaacgtgctggccaacgacaataacggcctgaagcacctgttgctgaacatcaaccagtatgatacggagcagatctatatcgctaacgacctgggactgaccgatatttcccagcagatgttcggcaaatatgacgtgttcaccagcggcatcaagaacgagctgagaggccagatttctccctctgccaaggagaaacgcgagcctgagctctacgaggagaagatcaacaagatcttcaaatccgccagatctttcactatcaactacctgaacagctttgtgcaggacggaaagacaatccagagctacttcgcacagctcggcgccaccaacacagattctgcccagtgcattgacatcttcaccaagattgagatggcccacatcgccgccaccgatatcctggagggcaagcacaactccatcgaccagtctgatagcgatattaaactgattaaggacctgctggatgcttacaaggagctgcagcacttcataaagccactgctggggtccggcgacgaggccatgaaggacaatgagttcgacgctcagctgcactatgcctgggactctctgaatattattacccccctgtacaataaggtgaggaattggctgacaagaaaaccttattccacagagaagattaaactgaatttcgagaatgcacagctgctgggaggctgggacatgaacaaagagaccgattgtacctctgtgctgctccggaaggacaacatgtactaccttgccattatggataagaaaagcaatcacgcatttgatattgatgtgctgccaaatgagggcgactgctacgagaaggtggactacaagctgctgcccgacgcctacaagatgctgccaaaagtgttcttctccaagagtcgtatcaacgagttcgcaccctcaaaggatattcagaacgcctaccagaagggcacccacaaaaagggccctaacttcagcatctctgactgccaccggctgatcgattttttcaaacagagtatcgccaagcacgaggattggcagaagttcccattctctttctcagacaccgactcatacgacgacatctctggcttttatcgcgaagtgaaacagcagggctacatgctgggctataggaaggtgtccgtgtctttcattaaccagctgatcgacgacggcaagctctatctgtttcagatctggaacaaggatttttccgagcattccaaagggatgccaaatatccacaccctgtactggaaaatgctgttcgatgagagaaacctgagcaacatcatctaccggctgaacggcaaggccgaggtgttttacagacagaactcactgaagctggagaataccactattcacaaagccaaccagcctatcaagaacaagaacatccagaattctaaggagtgcagcacctttgactacgatatcattaagaaccgacggtacactgcagataaattccagttccacgtgcccatcacactgaacttcaggtctaccggctctgacaatatcaacaacaaagtgaacgatgtgatcagaaataatgatattgaacacatcattggcatcgacaggggagagaggcacctgctgtatctgagcctgattgatctgaagggcaacatcgtgaagcagatgaccctgaatgatattgtgaatgagtacaacggcaacacgtacaagaccaattataaagacctgctcgtgcagcgcgaaggcgaccgcaccgaggcaaggagaaattggcagaagatcgagaacatcaaggagatcaaagaagggtacctgtcccaggtgatccacatcatcaccaagatgatggtggaatacaaagccattgtggtgctggaagacctgaatatgggcttcatgagaggaaggcagaagattgagcgcaacgtgtatgagcagttcgagaagaagctgatcgataagctgaactattatgtggacaaacagaaagacatcaccgatgccggcggcctgatgcacgccctgcagctcgctaacaagttcgagagctttaagaagctgggtaagcagagtggctgtctgttttatatccctgcctggaatacctctaagatcgatccagtgacagggtttgtgaacctgctggacactcactacgagaatattgacaaggcacggtgcttttttagcaagtttgacagcatcagatacaacgccagcaacgactggttcgaattcgagctcgactacgataaattcaccgacaaggcacgcggaaccaagacccactggaccctgtgcagctatggcacccgcattcggacctttcgcaaccctctgaagctgaaccaatgggacaacgaagaagtggtgctgacagaggagtttaaaaaggtcttcaacaacgccaatattgacatctatggaaacctgaagaacagcatctgctcgctgaatgacaaaaccaccctggagtctctgatgcagctgatgaagctgatggtgcagatgcggaatagcattacaggcactgagaccgattatctgctgagccctgtgacagacgccaacggcaacttctacgattcacgcaacaatatacctacccttcccattgacgccgacgccaatggcgcctataatatcgcccgcaagggcctgtggatcatccagaagattcagcagtctcagcccggggagaaactgaacctagctatctcaaaccgggagtggctgcagttcgcccagcagagaccctacctgaatgagtga

SEQ ID NO: 177 - DNA, 3732 bp, synthetic construct
  source 1..3732: mol_type = other DNA
atgaagacattcaatgatctgaccggcctgtatagcctgagcaagaccctgaggttcgaactgaagccggtgggcaagaccaaggataatatcgagacaaagggcatcattgctcaggatgagaaacgcgccgaggaatacaagaaggtgaaggatatcatcgaccgctatcataaaaaattcatcgagatgtgtctggccaacctgaagctgaagacaatttccgacggcaataacgactctttgaaagagtatgtgacactggcctcaaaggcaaataaggacgagaaggaggacaacgacttcaaagatgtgaaaacagccctgcgcaagcagatcgtggacgccttcaagaagggcggcagctatagtgacctgttcaagaaagagctgattcaggtgcacctgcccgattttgtgacagacgagcaggagaagcagatggtggagaacttcggcaagttcactacctactttaccgggtttaatgagaataggcagaatatgtacagtgacgaggaaaagagcacctccatcgcatacagactgatccatgagaatctccccatgttcattgataacatcaagtccttcgccaagatcgccgaacacgaggacatcgacttcctgcccgatatcgagaacggcttcaaggaggaactgaagaggctgaaggcccagagcatctccgaggtgttcgacctggccaactttaccaacactttgacccaatcccagatcgatagctataacgccattatcggcgcacgccacgacgaaaacggggataaagtgcagggcatcaaccagtacgtgaatctctacaaccaaaagaacaaggacgccaggctgcccctgctgaaacccctgtacaagatgatcctgtcagatcgcggagccctgtcctggctgcctgaggagtttgccaccgacgaggaaatgctggcagctatcaacgagacccacggaaacctgaagaacgtgatgaccgacgtgcggaagctgctgcagaacatcgatagctacgacacagagcacatttatatcgccaacgacaaggggctgactgacatctcccagcagatcttcggccagtacgacgtgtatacctctgccattaaggctgagctgcgggatagcatcacccccagcgctaaggagcgcaaggacccagaactgctggagaagaggatcaatgacatcttcaaggcctccaagtccttcagcatcgaatatctgaatagccacgtggacagcgacaaaaccattcaatcctactacaaggagctgggcgcctacgacaggaatggcgagcagcggattaatctgttttcccagatcgagctggcctacgtggacgcccacgatgtgctgctgggaaaacataccaatctgaaccagagcgaggatagtatcaagaagattaaagccctgctggacgcctacaaagcactgctgcacttcatcaagcccctgctggggaacggcgatgaggccgacaaggacaacgagtttgatgctaagctgcgcgccatttgggacgagctggacatcgtgacccctctgtacgataaagtgaggaacaggctgacaagaaagccctacagtacagagaagatcaaactcaacttcgataatgcccagctgctgaacgggtgggacatgaataaagagccagactgcacctccgtgctgctgcgcaaggacggccagtactatctcgcaatcatggacaagaagagcaaccacgccttcgatatcgatgagctgccttgtaacggagaatgctacgacaagatggactacaagctgctgcctggagcaaacaaaatgctgcccaaggtgttttttagcaagtccaggatcaaggagtttgctccctccaaggagatttgcgacgcctaccagaagggaactcataagaaaggggccaattttagcatcaaggattgcagaaggctgattgacttcttcaaggatagcattgccaagcacgaggactggtcaaagttcccttttaccttctccgacaccagtacttatgaggacatcagcggcttctacagggaggtggagcagcagggctacatgctggggtatcgcaaggtgtcagtcagcttcatcaatcagctggtggatgagggaaagctgtacctgttccagatttggaacaaggactttagcgagtattcaatggggacccccaacatgcacaccctgtactggaagatgctcttcgatgagcggaatctggccaacgtggtgtacaaactgaatggccaggccgaggtgttctaccggaagaaaagcctagacctgaacaagactaccatccatcgagccaaccagccaatcgctaataaaaacatgcagaacgagaagagagaaagtaccttctgctacgatatcgtgaaaaacaggagatacaccgtggacaagttccagttccacgtgccgatcacaattaactttaaagctacagggtcagacaacatcaacgcctccgtcctggatgtgatcagaaacaacgggatcgagcatatcatcgggatcgatcggggagagagacacctgctgtacctgtctctgatcgacatgaagggcaatattgtgaagcagatgaccctgaatgacattattaacgagtacaagggcaatacatataccaccaactacaaagaactgctgcaggcacgggagggcgacagaaaagaggcacggcagaattggcagaaaatcgagaacatcaaggaactgaaggagggctatctgagccaggtcgtgcacgtgattaccaagatgatggtggagtacaaggccatcgtggtcctggaggacctgaatggcggcttcatgagggggcgccagaagatcgagagacaggtgtacgagaagtttgagaaaatgctgatcgacaagctgaactactacgtggataagcagagagacgctaacgaaaacgggggcctgctgcacgcctaccagctggccagcaaattcgataccttcaagaaactcggaaagcagagcggttgcctgttttacatcccagcctggaacacctccaagatcgaccctgtgaccggatttgtcaacatgctggatacccgatatgagaacgccgacaaggcccgcaacttcttttccaagttcaagtccatcaattacaatgctgacaagaactggttcgagttcgtgatagacgactactcaaagtttacggacaaggccaaggataccagaaccgattgggtgctgtgcacatacggcaccaggatcaagactttccggaatcctgagaagctgaaccagtgggataacaaggaaattgtgctgaccgacgaattcaagaaagtgtttatggaggccgggatcgacatcaacggcaacctgaaagaggctatttgcactctgacagagaaaaagcatctggagtccctgatgcagctgatgaagctgctggtgcagatgaggaattctgagaccaactctgaggtggactacctcctgagccccgtcgccgacaccgagggacatttttatgacagcagaaactgcggggacaatctgcccaaggacgccgacgctaacggcgcctacaatatcgcaagaaagggcctgtgggccgtgatgaagattaaggccagcaagccccaggagaatctgaagcttggaatctctaacaaggagtggctgcagttcgctcaggaaaagccttacctgaacgactaa

SEQ ID NO: 178 - DNA, 3765 bp, synthetic construct
  source 1..3765: mol_type = other DNA
atgaagaacatcctggagcagtttgtgggcctgtaccccctgtctaagacactcagatttgaactgaagcccctgggcaaaactctggagcacatcgagaagaaaggcctgatcgcccaggacgagcagagggccgaagagtacaagctggtgaaggacatcattgacagataccataaggcctttatccacatgtgcctgaagcacttcaagctgaagatgtacagcgagcaggggtatgattccctggaggagtacagaaagctggctagcatctctaagcgaaacgagaaggaagaacagcagttcgacaaagtgaaagagaacctgagaaagcagatcgtggacgccttcaaaaacggaggaagctacgacgacctgttcaagaaggagctgattcagaagcatctgcctagattcatcgagggcgagggcgaggaggagaagcggatcgtggataacttcaacaagttcaccacctacttcaccggcttccacgagaacaggaagaatatgtactccgacgagaaggagagcaccgcaatcgcctaccggctgattcacgagaatctgcctctgttcctggacaacatgaagagctttgccaagattgccgaaagcgaagtggctgcccggtttaccgagatagaaacagcctaccggacctacctgaatgtggagcacatctctgagctctttaccctcgattacttttcaaccgtgttgacacaggagcagattgaggtgtacaacaatgtgatcggcgggcgggtggatgatgacaacgtgaagatacagggcctcaacgagtacgtgaacctgtacaaccagcagcagaaggaccggagcaaacggctgcccctgctgaagagcctctataagatgatcctgagcgataggattgctatttcctggctgccagaagaattcaagagtgatgaggagatgatcgaagccatcaacaatatgcatgatgatctgaaagatatcctggccggagataacgaagattcactgaagtctctgctgcagcacatcggacagtatgacctgtctaagatctacattgccaataacccaggcctgaccgatatctctcagcagatgttcggatgctacgacgtgttcaccaacggaatcaagcaggaactgagaaactccatcaccccaaccaagaaggagaaggccgataacgagatctacgaggagaggatcaataagatgttcaagagcgagaaatcattcagcatcgcctacttgaactccctgcctcacccaaagactgatgctccccagaagaacgtggaggactatttcgctctgctggggacctgtaatcagaacgacgagcagcagatcaatctctttgctcagattgagatggccagactggtggcctccgacattctggccggaaggcatgtgaatctgaatcagagcgagaatgatattaaactgattaaggatctgctggacgcctataaagccctgcagcacttcgtgaaaccactgctgggcagcggcgatgaggctgagaaagacaacgagtttgatgctcgactgagggccgcgtggaacgctctggatattgtgacccctctgtacaacaaggtgcgaaactggctgaccaggaagccttacagcaccgagaaaatcaaactgaatttcgagaatgcccagctgctgggcggctgggatcaaaataaggagccagactgcacatccgtgctgctgaggaaggacgggatgtactaccttgccatcatggacaagaaagccaaccacgccttcgactgtgactgtctgccctccgatggggcctgcttcgagaaaatcgactacaagctgctgcctggcgccaacaaaatgctgccaaaggtgttcttctccaagtctcgcattaaggagttctctccctctgagagcatcatcgccgcctacaagaagggaacccataagaagggcccaaatttctctctgagcgactgccaccggctgatcgactttttcaaggcatcaatcgataaacacgaggattggtctaaattccggtttcggttctccgacaccaaaacttacgaggacatctccggattttaccgcgaggtggagcagcagggctacatgctgggtttcaggaaagtgagcgagacttttgtgaataagctggtggacgagggcaagctgtatctctttcacatctggaataaagacttcagtaagcacagcaagggcacacccaacctgcataccatctactggaagatgctgttcgacgagaagaacctgactgacgtggtgtacaagctgaacggccaggccgaggtcttctatagaaagaaatctctggacctgaataaaactaccactcacaaggcccacgcccctatcacaaacaagaacacccagaacgccaagaaggggtccgtgttcgactatgacatcatcaagaatcgccggtatacagtggataagttccagttccacgtgccaatcactctgaattttaaggcaaccggccggaattacatcaatgagcacacccaggaagccatcaggaacaacgggatcgagcacatcatcggcatcgacagaggcgagcggcatctgctctacctgagtctgatcgatctgaagggaaacatcgtgaagcaaatgactctgaacgatattgtgaacgagtataacgggcggacctacgccaccaattacaaggatctgctggccacccgggagggagagagaacagatgcacgccgcaactggcagaaaatcgagaatattaaggagattaaggaagggtacctctctcaggtggtgcatatcctgtctaagatgatggtggattataaggcaatcgtggtgctggaggatctgaacaccggcttcatgaggagccggcagaaaattgagagacaggtgtatgaaaagtttgagaaaatgctgatcgacaagctcaattgctatgtggataagcagaaggatgccgacgagactgggggggccctgcaccccctgcagctgaccaacaagttcgagtccttccggaaactgggaaaacagagtggctggctgttctatattccagcatggaacaccagtaagatcgaccccgtgacaggattcgtcaatatgctggacacccgctacgaaaatgccgacaaggcaagatgcttcttctccaagttcgatagcatcaggtacaacgccgacaaggactggttcgaattcgcaatggactacagcaaattcactgataaggccaaggacactcatacatggtggactctctgtagctacggcacaagaatcaagaccttcagaaaccccgccaagaacaatctgtgggacaacgaggaagtggtgctgacagatgagttcaagaaggtgttcgccgccgccggcatcgacgtgcatgagaatctgaaggaggcaatttgcgccctgaccgacaaaaagtacctggaacccctgatgcgcctgatgacactgctggtccagatgaggaattccgccaccaacagcgaaaccgattacctgctgagtccagtggccgatgagtctggcatgttttatgattcccgggagggcaaggaaactctgccaaaggacgccgacgccaatggggcctataatatcgccaggaaaggcttgtggactatcagaaggatccaggccaccaatagcgaggagaaagtgaacctcgtgctgagcaacagagaatggctgcagttcgcccagcagaaaccatacctgaatgattga

SEQ ID NO: 179 - DNA, 2145 bp, synthetic construct
  source 1..2145: mol_type = other DNA
ctgaccaggaagccctacaagaccgagaaaatcaagctgaactttgagaattcccagctgctgggcggctgggacgtgaacaaggagccagattgcacctcagtgctgctgagaaaagatggcatgtactacctgggcatcatggataaaaaggcaaacaagagtttctactgcgattgcctgccatcagagggcagctcttacgagaaggtggactacaaactgctgccaggggccaacaaaatgctgcccaaggttttcttttccaagagccggaagtcggagttcgcccctagcgaagtgatcacaaaggcctacgagaacggaacacacaagaagggggctaactttagcctctcagattgtcacaggctgatcgactttttcaaggccagtattaataagcatgaggactggagcaggttcggctttatcttctctgaaacaaatacttacgaggatatggtgggcttttacagggaggtggagcagcagggctacatgctgggctttaggaacgtgtccgaggagtacattgatcggctggttgacgatgggaaactgtacctgtttcagatctggaacaaagactttagtgagcactccaagggcacccccaacctgcacacaatctactggaagatgctgttcgacgaacgcaacctggagaacatcgtgtataaactgaacggacaggctgagctgttttacaggaagaagagcctggatctgtgcaagaccaccgtgcacaaggcccaccagtctgtggccaataagaaccctcagaatgacaagcgggagtctatttttgaatacgacattattaagaacagacgctatactgtggacaagttccagtttcacgtgcccattactattaacttcaaggccacaggggatgacagactgaatagcgccaccctggaggccattagggacggaggcatcgaacacatcatcggcattgatagaggcgaacgccacctgctgtacctgagcctgatcgacctgaaaggcaatatcgtgaagcagttcaccctgaacgagatcgccagcgaatacaacggcgccccctgtcctccaaccaactataaggatctgctggtggcccgggaaggggacagaaacgaggcccggagaaattggcagaagatcgagaacatcaaagaaatcaaggaagggtacctgtcacaggtcgtgcatattatcgccaaaatgatggtggagtacaaggccatcgtggtgctggaggacctgaacatgggctttatgagaggtagacagaagatcgaacgccaggtgtacgaaaagttcgagaagatgctgatcgataagctgaattgctacgtggataagcagaaggaggccaccgatatcggcggagtgctgcacccactgcagctgacaagcagattcgaaagttttcggaagctgggaaagcagagcggatggctgttttacattcctgcctggaacactagcaagattgaccctgtgaccggcttcgtgaatatgctggacacacggtacgagaacgtggacaaaactagatgcttcttctctaagtttgacgtgattcgctataacggggacaaggacctgttcgagttcacatttgactacgataagtttacagacaaagccaagggaaccagaactaagtggacactgtgcacctacggcagcagaattaaaactttcagaaatccaaagaagaacaatcagtgggacaacgaggaaatcgtgctcacagacgagttcaagaaggccttcgccgacgccggcattgacatcgagggcaatctgaaagatgccatctgcagcctgacggagaagaagcacctggagcctctgatgaacctcatgaagctcctgctgcagatgcggaacagtaagaccggcaccgagatcgactatctgttgagccccgtggctgatgcagacggaaacttctacgacagccgcaacgagatctccaccctgcccaaggacgctgacgccaacggcgcatacaacatcgcccggaagggcctgtgggccatccggaagatccagagcgcaccatccggagagaaacccaatctggccattagcaacaaagagtggctgcagtttgcccagcagaagccctatctggatgactaa

SEQ ID NO: 180 - DNA, 3852 bp, synthetic construct
  source 1..3852: mol_type = other DNA
atgaacacatttaaccagttcaccaacctatataatgtgcagaagaccctttgttttgagctccagcccgtaggaaaaactagggagaacatcgaggaggacggattactcaaacaggacgaagagagagccgagaactacaagaaggtgaaaggcttcatagatgaataccataagcagtacattaaggaccgcctttggaattatgaactgcctctgaaaggtgagggcaaacgcaacagtctggaggagtaccaacagttttacgagctgtccaagcgggacgcaaatcaggaggcaactttcacagaaatcaaggataacctgcgcgctatcatagctaaaagacttaccgaaaagggctcggcatacgagcggattttcaaaaaggaactgatccgggaggacctcattgaatttctcgataaggaagaagacaaggagctggtgagacagttctccgatttcactacctatttcaccgggtttcatgaaaatcgcgcaaacatgtataaagatgaggaacagagtacgtctatcgcttaccgactcatccatcagaatctgccgaagttcatggataatattaaggcattttcggcaatagcccagacaccagttgcggaacacttcaaggaactgtatgctcgttgggagagttatttgaatgttagttccatcgacgagatgttcagactggattacttttctcataccctgactcagcctcatatagaggtgtacaattccataattggcaagagaatcttggaggatgggacagagatcaaggggattaacgaatatgtcaacctctacaaccagcaacaaaaggacaaaaagctccccttgtttgtgcccctgtacaaacagatactgtcagacagggaacgactgagctggctgagtgaggagttcgatagcgatgctaaaatgctcaaagccatcaatgagtgctatgatcacctgcacgatctcctgatgggcaaagagaacgaaagcctctgcgagcttctgaagcatttgacggatttcaacctctcacagattaatatcaccaacgacctgtctcttactgatattagccaaagcatgtttgggcggtatgatgtttttaccacggggttgaaaaatacccttaagatctccacaccacaaaagcgcgatgagaaggaggaagcttacgaggacagaattactaagctgtttaaagcgtgcaagagcttttcaatcgcagagctcaatggtttgcaactaccggtcgcagaggatggagggcacaaaagagtagaagactatttcataagcctgggcgctgtcggaaaagaaaaaaatctgttcgaacagatcgaggaggcctatactgaggctctccccattctgcagcttaaagaaacagacgatacactcagccagaacaaggctgctgtggccaaaattaaggatctcttggacgcctttaaaaatctacagcactttgtgaagcccttgcttggttccggcgaagaaaacgaaaaagacgaagtgttttatggggcctttcagacattatgggatgagttggatgcagtcacccccctctataataaagtaaggaactggctgactaggaaaccttacagcacggagaaaattaagctgaattttgacaacgcgcaactcctagatgggtgggacgaaaacaaagaaacagccaatgcttcaattatcctttgtaaggacgggttttattacctgggtatcgttaaaaaggacaatcggaaactattgggcatgcccatgccttccgacggcgaatgttatgataaggtcgtctacaagtttttcaaagacatcaccacaatggtgcctaaatgcacaactcaaaagaaggatgtcgtcgcacatttcgcacactccaacgaggattacattctgttcgacaaaaagaccttcaatgcaccagtgacgattaccaaggagatctacgagctcaacaatattctgtataacggcgttaagaagtttcagattgagtaccttcgttctactggggataagtctggatacgagcatgctgtcttcacttggaagaccttttgtctccaattcctgaaagcctataaatctaccagcatctataacctaaagttagtggagcaacacatcgactcctactacgatctgtctagtttctattctgccgttaatctgttgttgtacaacctgagttatcggaaggtttctatgtcatacgttcattcattggtcgaggaaggaaaactgtttttgttccgaatctggaacaaggatttttccgagtacagcaagggcacaccaaatcttcacaccctgtattggaaaatgttgttcgacgaaagaaatcttgccgacgtggtattcaaactgaatggtcaggctgaagtgttctacagaaaggccagcattaagcaggagaatagaattattcacccggcccaccaggctatcaacaataagaacccactcaacagaacccctaccagcacattcgactacgatatcatcaaaaataagcgctacacagtggacaagttcttattccacgtgccgattaccattaattttaaggccaagggactgacgaatattaatccacttgtccttgacgttatccggaagggtggcttctcacatattattggcatcgatcggggggaacgtcacctcttgtacctgtcactgatcgacttaaaaggcaacatcgttaagcagatgactttgaacgaaattatcaacgtgtaccgggagcaaacatatgtgacaaattatcacaacctactggcccaacgagagggagatcgcaccaaagcacgaaggagctgggacactatcgaaaacattaaagaactcaaagagggatacctgtctcaggtcgtgcatgtgatcagcaagatggtggttgagtaccacgcgatagtcgtgctggaagatcttaatatgggattcatgcaaagtaggcagaagatcgagaggcaggtgtacgaaaaattcgagaagatgctgatcgataaactcaactgctacatatacaaacaggtcgatcccacatcggagggaggtgtgttacacgctctgcagcttaccaacaagttcgagagctttcggaagctgggaaagcaaagtggttgcctcttctatatccctgcctggaatacaagcaaaatagaccccctaactggctttgtgaacttcataaaccccaagtatgaatctattcaggcggccagggatctcatcggcaagtttgaggacatccgatacaacccagaaaagaactatttcgagttccacatcaaagactacgctgcgttcaacccaaaggccaaatcttcaagacaggagtgggtgatctgtactaaggggactaggattaggacgtttaggaaccctgacaaaaacaacgagtgggacagtgaggaaatagtactgaccgagaagtttaaggagctgtttgactcctacggcattgactacaggtgtaatctgttagcgagcatactaatccagacaaagaaagactttttccataatgaggacgtgaagaagccttctctgctgtcactcctgaaattaacccttcagttacgcaactcccacataaattccgaggtagactatattctctcaccagtagccgacgccaaaggatccttttatgactcccgcacctgcggttctagtctgcccaataatgccgacgccaatggggcctttaacattgcacgtaagggcctgatgttagtggaacgcatccggtccataaaagatgatgaaaaacctgccttaactatcaccaatgaagaatggctgcattatgcccaggctcagtga

SEQ ID NO: 181 - DNA, 3840 bp, synthetic construct
  source 1..3840: mol_type = other DNA
atgaagtctctgaccaatctgtaccccgtgagcaagactctgaggttcgagcttcagcctattggaaagactaaggagaacatcgaaaagcacgggatcctgtctcgggacgagcagcgggctgaggattatattaccgtgaagaagtacattgacgagtaccacaagcagctgatcaaggatcggctctggaactttaagctgcccatgaagagcgacagcaagctgaactccctccaggaataccaggaactgtacgagctgtccaagagagacgcctgccaggaggacagatttaccgagctgaaggacaacctgcgggccatcatcgccaagcaactgactggggggaccgcttatggtcggattttcaagaaggagctgattcgagaggacctgatcgacttcctgacccaggaggaggagaaggagacagtgcgccagttcgccgatttcacaacttacttcactggcttccacgagaacaggaagaacatgtacagtgccgaggagaagtctaccgctatcgcctaccggctgatccaccagaacctgcctaagtttatggacaacatgaaggccttcgccaaaatcgccaagagtcctgtcgccgaaaagtttgccaacatttacaaggagtgggaagatagcctcaacgtgtcctgccttgaggaaatcttccagctggactatttctccgaaactctgacccagccccatatcgaggtgtacaattacatcattggcaagaagaccaaggaagacggcaatgacgtgaagggcatcaatgaatatgtgaatgagtacaacatgaggcacaaggacaaccctctgcctctgcttgtgcccctgtacaaacagatccttagcgatagagaaaagctgtcctggatcgccgaggagtttgattccgacgagaagatgctgtccgcgattaacgagagctacaactccctgcatgatgtgctgatgggcgaagagaacgagagcctgaggtctgtgctgctgcacattaaggactacaacctggagagggtgaatattaactcagagtccctgaccgacatcagccagcacatctttggcagatacgacgtcttcaccaatggtattaaagccaagctgcgcggaaagaaccccaagaaaaggaatgagtctgacgaaagctttgaagacagaatcacaaaaatctttaagacccaaaagagctacagcatcgcctacctgaacaacctgccccagcccaccatggaggatggaagggtgagaacaattgaggattatttcatcagcttgggcgccatcaacatcgaggcaaagcagaagatcaatctgttcgcccagattgagaacgcataccacgacgccttcaccattctgaagaggaccgacaccgacgacactctctcccaggataagaaggcagtggagaagatcaaagtgctgctggatgccttcaaggacctgcagcactttatcaagcccctgctgggctctggcgaggaaaatgagaaggatgagctgttctatggcatctttcagctgatctgggacgagctggaggctatcaccccactgtataacaaggtgaggaactggctgacccgcaagccatacagcacagagaagatcaagctgaacttcgataatgcccagctgctggacggatgggatgaaaacaaggaaacagctaacgcctcaattatcctgtgcaaagacggcctgtactacctggggatcctgaacaaagattaccggaagctgctggggatgcctatgccaagcgagggcgactgctacgataaggtggtgtacaagttcctgaaagacatcaccacgatggtgccaaaatgtactactcagaagaaggaagtggtggcccactttggccagagtgtggaggattacgtcctgttcgatcccaagaccttcaatgcccctgtgaccgtgactaaggagatctttgacctgaacaatgtgctgtacaatggggtgaagaagttccagatcgagtatctgcgcagcactgacgactcactgggctacgagcacgccgtgtccacctggaagagcttctgcatgcagtttcttaaagcctacaagtctactagtatctataacctggcctccgtggagcagaagatgaactcttactctgacctgtccagcttctacaaagccgtgaatctgctcctgtataacctcagctataggaaggtgagcgtggattacattcacagcctgaccgaggagggcaaactgtatctgttcagaatctggaataaagacttctccgagtttagcaaaggagctcccaacctgtttaccctgtattggaagatgatcttcgacgaacggaacctggacaacgtggtgtacaaactgaacggccaggccgaggtgtttttccgcaagagcagcattaagcccgagaacagagtgatccaccccgcccacagacccatcgacaataagaacgagcagaacaagaaacggaccagcaccttcaaatacgacatcattaaggattatagatatacagtggacaagttccagttccacgtgccaatcactattggctttaagagcgaaggacagacaaatatcaattcccgggtgcaggatattatccggagaggggggtttactcatatcatcggcatcgacaggggcgagcgccacttactttacctgtccctgatagacctccgcggcaacatcgtgatgcagaagactctgaatgtgatctctcgggaagtgcggggcgtgacctatagcacaaactaccgggacatgctggagaagagagaaggtgacaacaaagaagccaggcggtcttggggcgtgattgagagcatcaaggagctgaaggagggctacctgagccaggccatcagggagatcgccaacatgatggtggagtataatgccatcgtggtgctggaagacctgaaccagggcttcatgcgcggcagacagaaaatcgaacggcaggtctatgagaagttcgagaagatgctgattgacaagctgaactgttacgtggacaagcagatcgcccctagcagcatcggcggcgccctgcatcccctgcagctgaccaacaagtttgagagcttccggaagctgggaaaacagagtggctgcttgttttatattccggcctggaacacctccaagatcgaccctgtgaccggcttcgtgaatctcttcgacacacgctacgacaccagggagaaagctcgcatgttcttcagcaaattcaaaagaattaagttcaacacagagaaggattggttcgagttcgccttcaactacaacgacttcacctccaaggctgaggggactaggacagaatggaccctctgcacctacggggagagaatcaggcagttcagaaaccccgagaagaaccacaactgggacgacgagaccatcgtgctgacagacgagttcaaaagactgttctgtgagtacggcattgatattcatggcaacctgaaggagagcattgtggctcagtccgatgccaaattcttccgcggcctgctgggtctgatgaagttgctgctgcagatgaggaactccatcgccaattccgaggaggattacctgctctctcccgtgatggatgaaaaggggtgtttctttgactcacgcgataatgacggaaccctaccagagaacgccgacgccaatggcgcctacaacatcgcaagaaaaggcctgtggattatccggaagatccgggaaaccgccgagaatgagaagcccagcctgaaaatcaccaataagcagtggctgctgttcgcccagagcaagccttacctgaacgactga

SEQ ID NO: 182 - DNA, 3855 bp, synthetic construct
  source 1..3855: mol_type = other DNA
atgaacaccagcaacctgtccagattcaccaatctgtacagcatttccaagaccctgaggtttgagcttcaacctctgggcaagaccaaagactacattgagaagaatgggatcctcatgcgcgacgagaagagggccgaggactacaagaccgtgaagggcatcatcgacgagtaccacaagaagtatatcaagtcccgcctgtgggactttaagctgccactggcaagcgagggaaagcgggatagcctggaggagtacaaagccctgtacgaggttagcaagagatccgaagccgacgaggccgccttcaaagaggtgaaggataacctgaggagtatcattgccaagagactgactagcggcaaggcttacgagactatcttcaagaaggagctgatcagagaggaccttattaattctctggaggatgaggtggagagagaaattgtgtcccagttcgccgactttaccacctacttcggcggcttccatgagaatagaaagaacatgtacgatgccggagaaaaatctaccgccatcgcctaccgcctgatccatcagaacctccctaagtttatggataacatgaaggctttcgccaaaattgccgagacatccatcgccgaacacttcgcagacatctatgagggcagcaaggagatgctgaacgtcgggagcatcgaggaaatctttagactggattacttctcagagatcctgactcagcctcacatcgaggtgtacaatagcattatcggaaaaagggtgctggaggatggaactgagattaagggaattaacgagtatgtgaacctgtacaaccagcagcagaaggataagagactgccactgctcgtgcccctgtataagcagatcctgagcgacagagagaagctgtcctggctggccgaagagtttgactgtgatgaaaagatgctggcagccatcaacgaaacctacgcccatctgcacgacctgctgatggggaacgagaatgagagcctgagatcactgctgctgcacctccgggactacgacctggagcagatcaacatatcaaacgacctgtctctgacagacatatctcagcatctgtttggccggtacgatgtgttcacaaatggcatcaaggaggagctgagagtgatcacacccagaaagaggaaagagactgacgaacagctggaggacaggattagcaagatcttcaagacacagaaaagtttctgcattgccttcctcaactccctgccccagccagccatggaagatggcaaggcccgctgtattgaggactattttatggccctgggcgccgtgaacaacgaaaccactcagaaagagaacctgttcgcccagatcgaaaacgcctatgagaacgccaagtccgtgctgcagatgaaggaaaccggcgacatgctgagccagaacaaacccgccgtggccaagatcaaggccctgctggacgctctgaaggacctgcagcacttcattaaacccctgctgggctccggagaggagaacgagaaggatgagctgttttatggctcttttcagatgatgtgggatgagttggacgccgtgacctcactgtacaacaaagtgcgtaactggctgaccagaaagccatacagcacagagaagatcaaactgaatttcgataacgcccagctgctggacggatgggacgagaataaggaaaccaccaacgcctccatcctgctgtacaaggacggaaactactacctggggatcatcaagaaggaggatagaaagattctgggcagccctatgcctacagacggggagtgctatgataaggtggtctacaagttttttaaagacatcaccaccatggtccccaagtgtacaacccagaagaaggacgtgatcgctcacttcatgcactctgatgatgattacattctgtatgacaagaaaaccttcgatgccccagtgaccatcaccaaggagatctataacctgaacaacgtgctgtacaacggggtgaaaaagtttcagattgagtacctgcggtccactggagacaagaggggctacgaacacgccgtgttcatctggaagtctttctgcatgcacttcctgaaggcctacaagagcacaagtatctacaacctggtgctggtggagcagcagatcaactcctattacgatctgtctagcttttataatgctgtgaatcttctgctgtacaacctgtcctaccggaaagtgagcgtgaattacattcacagcctggtggacgagggcaagctgtacctgtttaggatctggaataaagacttcagcgagtacagcaaggggacccccaacctgcatacactgtactggaaaatgctgttcgacgagcggaacctggcagatgttgtgtataagctcaacggccaggccgaggtgttctatagaaagagttctatccagcctgagcatcggatcgtgcatccagccggcaaacccatcgcaaacaagaacgagcacagcaaagagccaaccagcactttcaagtatgacatcgtgaaggaccgcagatacaccgtggacaaattccagtttcatgtccctatcaccatcaactttaaggcagccgggcaggagaacatcaaccccgtggtgctggacgctattaggcggggaggcttcacccacattattggcattgaccggggagagaggcatctgctgtacctgagtcttatcgacctgcagggaaacatcgtggagcagatgaccctcaacgagatcatcaacgaatataaaggcctgaaacacaagactaactatcatgacctgctggccaagagggagggcgagagaacagaggcccgaaggtcatgggacaccatcgagaatatcaaagaaatgaaagagggctacctgagccaggtggtgcatatcatcagcaagatgatggtggagtacaacgctattgtggtgctcgaagatctgaacactggattcatgagaagcagacagaagattgagaggcaggtgtacgagaagttcgagaagatgctgatcgataagctgaactgttacatcgacaaacaggtgggcgctagcgatatcgccggcctgctgcacccactgcagctggcttgcgaagcaaaaaaatggaagagaagccaccagtgcgggtgcctgttctacatccctgcctggaacacctccaagattgatcccgtgacaggcttcgtgaacctgtttgacactaggtacgagaacgccgccaaggccaaagccttcttcggcaaattcggttccatcagatacaatgccgagaaggattggtttgagtttgccttcgactacaatgacttcaccaccaaggccgaggggacacggaccgagtggacactgtgcacttaccgggagcggattagaaccttccggaacccccagaaaaatcatcagtgggacgatgaagagatcgtgctgaccgacgccttcaagcagctgttcgataagtacgacatcgacatgaagggcaatctgaaggaggccatatgcgcccagaatgacgtgcagttcttcaaggacatgatggaactgatgaagctcctgctgcagatgaggaatagcataactaacagcgagaccgattacctgctgtctccagtggccgacgagaagggccagttttttgactcccgccggggcataaccacactgcccgataacgccgacgccaacggggcctataatattgcccggaagggcctgtgggtgatcaggaaaatccaggaaaccgctgagaatgagaagcccagtctggctataacaaacaaggagtggctgcagtttgcccagacaaagccctatctgaatgagtag

SEQ ID NO: 183 - DNA, 3741 bp, synthetic construct
  source 1..3741: mol_type = other DNA
atgaaacagtttacaaatctgtatccagtgagtaaaacactgcggttcgagctgcagcccatcggtaagaccaaggagaacatcgagaagaatggcatactgacccgcgacgaaaaacgcgccaaggactaccaggtcgtgaagggattcatcgacgagtatcacaaacagtatatcaaggaccggctgtggaatttcaagctgcctctggcttctgagggcaatctggactctcttgaagagtaccagatgctctacgagatgccacgcagggatgatacccacgaggaggatttcagtgaggtgaaggataacctgagggccatcatcaccaagcgactgaccgagaacggttcagcatacgacagaatctttaagaaggagctgatccgcgaagatttgatcgagttcctgaacaatgaggaagataaggccctggtgagacagttcgccgactttacaacatattttagcggctttcacgaaaacaggagaaatatgtactctgccgaggagaagagcaccgccatcgcctacagactgatccaccagaacttgccaaagttcatggacaacatgaaggccttcgccaagatcgccgagacatccgtggccgaacatttcagcaacatttatgagggctgggaggagtacctgaacgtcggcagtattgaagaaattttccggctggactacttctccgagactctgactcagcctcacatcgaggtctataattacatcatcggcaagaaagtgctcgaagacggaaccgagatcaaggggatcaacgagtacgtgaatctgtacaaccagcagcagaaggataagagcaagagactgccattcctggtccctctgtacaagcaaattttgtccgatagagagaagctgtcctggctggccgaggagttcgacagcgatgagaagatgctgggcgccatcaatgagagctacacccacctgcacgagctgctgatgggcgaagagaacgagtccctgcgcagcctgctgctgcacctgaaggaatacgacctgtcccagataaatatcactaacgatctgagcctgacaaatatctcccagcacctgtttggacgatatgacgtgtactccaatgccattaaggaacagctgaagatcatcatccctaggaagaaaaaagagaccgacgaagagtttgaggataggatcagcaagatcttcaagacacagaagtccttcagcatcagctttctgaataatctgccccaccccgagacagagaatggaaagcctcggagcgtggaggaatatttcattagcattggcactatcaacaccaaaaccacccagaaggagaatctgttcgctcagatcgagaacgcctacgaaaacgtgagagtgatcctccagatgaaagacactggcaatgccctgagccagaataaaccagccgtgaccaagatcaaggccctgctcgacgccttcaaagacctgcagcacttcatcaagcctttactgggcagcggcgaagagctggagaaggacgagctgttttatggcagctttcagatgatctgggatgagctgaacaccgtcacccctctgtacaacaaggtgaggaactggctgacaaggaagccctacagtacagaaaagatcaagctgaacttcgacaattcccagctgctgggcggctgggacgtgaataaggagcctgattgtactggcatcttgctgcgcaaggacagcttctattacctgggaatcatggataaaaaagcaaatcgggtgttcgaaaccgacatcaccccatcagagggcgactgctatgagaaaatggtgtacaaacagctgggccagatttctcagcagcttcctagaattgccttttccaagacctggcagcagaaactgtccattcctgaggacgtgatcaagatcaagaagaatgaatcctttaagaaaaatagcggcgatctccagaagctgatcagctactacaaatcttttatctcccagcacgacgaatggaatagctatttcgatatcaatttcaccgataggaatgattacaagaacctgcctgacttttatagcgaggtggatagccagttttactccctgagcttctcaagggtgcctagcagctatatcaatcagttggtcgacgagggaaagctgtacctgtttcgcatctggaataaggacttcagcgagtactccaagggcaccccaaacctgcataccttgtattggaagatgctgtttgacgagcggaacctgagtaacgtggtgtacaagctgaacggacaggccgaagtgttctatcggaaggccagcattcagcccgagaatagaatcatccacaaggccaacctgtctatcgtgaataaaaatgagctgaacaagaagaggacctccactttcgagtacgacatcattaaggatcgccgctacaccgtggacaagttccagtttcacgtgcctatcactatcaacttcaagggcacaggccagctgaacataaaccctattgtccaggaaaccatcagacagggagggttcacccacatcatcggaatcgacagaggcgaaaggcatctcctgtacctgtccctgattgacctgaatggcaatatcgtgaagcagatgacgctgaacgacatcttcaacgagtataaaggccagacctataaaacaaactatcacgatctgctggtgaaacgggagggcgatcgcaccgatgcccgccggtcttgggacaccattgagaccattaaggagctgaaagagggctatctgtctcaggtggtgcacgtgatctcaaagatgatggtggaatacaaggccatcgtggtgctcgaagatctgaataccggctttatgcgcggcagacagaaaattgagcggcaggtctacgaaaaattcgagaagatgctgatcgagaagctgaactgttacatcgacaaacaggccgacgccaccgaggtgacaggcctgctgcacccactgcagctgacatgcgaagccaaaaagtggaagcgctcccaccagtgcggctgcctgttctacattcctgcctggaacacttctaagatcgatcccgtcacagggttcgtgaaccttctggacacccggtacgacactagagagaaggccaggctgttcttctccaagttccagaggattagcttcaatacagagaagggctggttcgagtttacctttgactacaatgatttcaccactaaggctgagggcactagaacccagtggaccctgtgcacccacggggagagaatcagaacattccggaacccccagaagaataatcagtgggataatgagagaatcgtgctgaccgacgagttcaagaagctgttcgaccagaaagaaatcgatatttctggcaatatgaaggaggccatttgcaaccagaaggacgcccagttctatcgcgacctgctgggcctgatgaagctgctgctgcagatgcggaatagcatcgccaattctgaggaggattacctgctgtcccccatcgccgacaaaaatgggcatttcttcgacagccgcgagcggatctccagcctgcccgtggacgccgacgcaaatggtgcctacaacatcgccaggaagggactgtggattgtgcggaagatcagaaacacctctgagggcgagaaactgtccctggcaatcactaacaaggagtggctgctgttcgcacagtccaagccctatctgaatgattga

SEQ ID NO: 184 - DNA, 3750 bp, synthetic construct
  source 1..3750: mol_type = other DNA
atgaagaaactgacaaacctgtaccccgtgagcaaaaccctgaggttcgaactccaggctatcggcaagaccaaggagaatatcgaaaagaatggaattctgcagagagatgagaagcgcgccgaggactacaagatcgtgaagtccctgatcgatgaataccacaaacagttcattaaggatcgcttgtggaactttaagctgccattgcacaacgagggccacctggactccctggaggagtatcaggcactgtacgagatttccaagcggaacgacacccaggaagccgaattcactgagatcaaagacaaccttaggtcaattatcagcaagcgactgaccgagtgtggctctgcctacgagcggatcttcaaaaaggaactgatcagggaggacctgatcgatttcctggaaagcaacgaggataaggacatcgtgagacaatttgctgatttcaccacctatttcagcgggtttcacgagaataggagaaacatgtacgtggccgaggagaagtccaccgccatcgcctataggctgatccaccagaacctgcccaaatttatggacaacatgaaagccttcgccaagatcgccgagacctccgtggccgagcacttcaccgacatctacgagggctggaaagaattcctgaacgtgggcagcctggaggaaatatttaggctcgactatttctccgagacactgacacagccccatatcgaagtgtacaattacattatcggcaagaagatcctggaggatggcgccgaaattaagggcatcaatgagtacgtgaatctgtataaccagcagcagaaagacaagagcaaaagactgccattcctggtgcccctctacaagcagatcctgtcagaccgcgacaaactgtcctggctggctgacgaattcgactccgacgagaagatgctggccgcaatcaatgagtcatacaatcacctgcacgacctgctgatgggcctggagaatgagtctctgaggtccctgctcctgaacatcaaagactttaatctgtcccagattaatatctccaacgacctgagcctgactgatatctctcagcacctgttcggacgctacgatgtgtttacatcaggcattaaagacgagctgcggattatcacacctcgcaaaaagaaggagagcgatgaggagttcgaagaccgcatctccaaaatctttaaaactcagaagtcctttagcgtggactttctggacaagctgccacagcctgtcatggaagacgaaaaacccagaaccatcgaggattattttatgaccctgggcgccgtgaatactgaggccacacagaaggaaaactttttcgcccagatagagaacgcctacgaggatgcccgcaccatcctccaaattaaggacaccggagacaccctgagccagaataaaagtgccgtggccaaaattaaagccctgctggatgcactgaaggatctccagcacttcattaaacctctgctggggtctggcgaggaaaacgagaaggacgagttgttttacggaagcttccagatgatgtgggatgagctggacaccgtcacaagcctgtacaataaggtgaggaactggctgacacggaagcctttctccactgagaagatcaaactgaacttcgacaacagtcaactgctgggcggatgggacgtgaataaggagcccgactgtaaaggtatcctgctgagaaaggacgacttctattatctgggcatcatggacaagaaaagcaatagaatctttgaggccgatgtgacacccaccgatggcgagtgctacgacaagatcgactataagctgctgcccggcgctaataaaatgctgccaaaggtgttcttctcaaagtctaggatcgacgagttcgccccatccgaagctatcgtgagctcctacaagagaggcacccacaagaaaggcgccgtgttcaacctcgcagattgccaccggctgattgacttctttaagcagagcatcaataagcacgaggattggagcaagtttggattccatttttctgataccaaatcttacgaggacatcagcggcttttacagagaggtggaacagcagggctacatgctgtcatctcatcccgtgtcctcctcctacattgacacactggtgagcgagggcaagttgtacctgttcaggatctggaacaaggacttctctgaatctagtaagggcactcccaacctgcacacactgtactggaagatgctgttcgatgagagaaatctggtggacgtcgtgtacaagctgaacggtcaggccgaagtgttttatcgcaaagccagcataaagcctgagaattgcatcattcacaaggccaaccagcctatcgctaacaagaacgagctgaacaccaagcgggcctccaccttcaagtacgacatcattaaggacaaaaggtacacagtggataagttccagtttcatgtccccatcaccattaacttcaaggctgccggccagaacaacatcaaccccatcgtgcaggaggccatcaagcaggacgagttctcccacattattggcattgatagaggcgaaaggcacctgctgtacctgagcctgatcgatctgaaaggcaacatcgtgaagcagatgaccctgaatgagattatcaatgagtacaagggccagacctataaaacaaactatcacgacctgctggccaaaagagagggagacagaaccgaggcccgcaggtcttgggagaccatcgaaacaattaaggagctgaaggagggctacctgagccaggtggtgcatatcatctctaagatgatggtggagtacaacgcaatcgtggtgctggaagacctgaacaccgggttcatgcggggaaggcagaagatcgagagacaggtgtacgagaagtttgagaagatgctgatcgataaactgaattgctacatcgacaagcagttatctccaacagatgagggcggcctgctgcatccactgcagctgacctgtgacgctcagaagtggaagagaagccaccagtgcggctgtctgttctacatccctgcctggaatacctctaagatcgatcccgtgacaggcttcgtgaacctgctggatacccactacgacaccagagagaaggctagagtgttcttctccaaattccagaggatcagctacaatgctcccaagggctggttcgagttcgcttttgactacaacgatttcacaacaaaagccaaggggacccgcactcagtggacactgtgcacccagggcgagcgcattaggaccttccggaacccccagaagaatcatcagtgggacgacgagaggatcatgctgaccgatgcctataaacagctgtttgacaagtacgacatcgacatcaacggtaacatcaaggaagccattagcagtcagacagacgcccagttcttcaaagacctgatggggctgatgaagctgctgctgcagatgcgcaattccatcacaaacagcgaggaggactatctgctgtcccctgtggccaatggaacaggacatttctttgatagcagggaaggcatttcttctctgcctaaggacgccgacgcgaacggcgcatataacatcgcccgcaaggggctgtgggtggtgcagaagatccaggagacccctgagggcgagaagcctagcctgactatcaccaacaaagaatggctgcagtttgcccagacaaagccttacctgaacgactaa

SEQ ID NO: 185 - DNA, 3768 bp, synthetic construct
  source 1..3768: mol_type = other DNA
atgaaggagaaggagcagtactccgattttagccgtctctatcccgtgtctaagaccctgagattcgagctgaaacccatcggaagaaccatgaagaatattgaaaagaacggtatactggagcgggacaatcagagggccaacgattacaaaatcgtgaaggaatttattgacgagtaccacaaacagcacattaaggacagactgtgggatttcaaactccccctgaagagcgatggcaggctggacagcctgaaggagtatcaggagctgtatgagctgtctaagcgggacgccaatcaggagtcagcctttaccgaaatcaaggataacctgagaagcatcatcgcccggagactgacccacgattcccctgcctacaagagaattgataagaaggagctgatcagagaggacctgctggagttcctggagaacgaggaagataaggagatcgtgagacagtttgccgattttaccacttatttcaccgggttccaccagaacaggcagaatatgtatacagcagaggaaaagagcaccgccatcgcctaccgcctgatccaccagaacctgccaaagttcatggacaacatgaaggcttttgccaaaatcgccgagactagcgtggctgagcatttcgccgatatctacgaaggatggaaggagtacctgaacgtgggcagtatcgaaaagatcttccagctggattacttcagtgagacaatgactcagccacatatcgaagtgtacaactacattatcggcaagaagatcctggaggacgggacagaaattaaggggatcaatgagtacgtgaatctgtacaatcaacagcagaaggataagtcacagcgcctcccgttcctggtgcccctgtacaagcagatcctgtctgaccgcgagaagctgtcctggatggccgaggagttcgacagcgatgagaaaatgttggccgccatcaacgaatcttacgtgcatctgcacgatctgctgatgggcaccgaaaacgagagcctgagaagcctcctgtcccacatgaaggatttcaatctggagcagatcaacatcaacaacgacctgagcctgaccgacatctcacagcacctgttcggccgctacgatgtcttcactaacgggattaaggatgagctgcgggccattactccacggaagaagaaagagtctgacgaggactttgaggatagaatcagcaagatctttaaaacgcagaaatccttttcaatcagtctgctgaataagctgcctcagcctgtgatggaagacggcaagcccaggacagtggaggagtatttcatgagcctgggcgccgtgaacaccgagacaacccagaaggaaaacctgttcgcccagatcgagaacgcctacgagaacgcccggagcatcctgcagatgaaggacaccggcgatgccctgagccagaataaacaggccgtggccaagataaaggccctgctggatgccttcaaagacctgcagcacttcattaaacctctgctgggctcaggggaggagaacgagaaggatgagctgttttacggcgtgttccagctgatttgggacgaactggatacaatgacacccctgtacaataaagtgaggaattggctcacccgcaaaccttactcaaccgagaagattaaacttaattttgacaacgcacagctgctgggcgggtgggatgtgaacaaagagcccgattgcactggcgtgctgctgcagaaagacggcttctattacctggggatcatgaacaagaaggccaaccggatctttgagtctaaggtgacccccagcaatgaggattgctatgagaaaattgattacaagctgcttccaggtgccaataagatgctgcccaaggtttttttctccaagtccaggattgacgagtttgctccttccgaggccattgtggatagctacagacgcggaacacacaaaaagggccccgacttcaatcttagcgactgtcacagactgatcgacttctttaaggatagcattgccaagcacgaggattggtccaagttcgtgtttcatttctccgagaccagcacttacgaggacatctccggcttttatcgcgaagtcgagcagcagggctacatgctggctagtcacccagtgtcagtcagttatgtggaacagatggtggatgagggaaagctgtacctcttcagaatctggaacaaggacttctccgagcattcaaagggcacccccaacctgcacaccctgtactggaagatgctgttcgacgagagaaatctggccgacgtggtgtacaagctgaatgggcaggctgaggtgttttacagaagagcttccatcaagcccaagaaccggatcattcaccaggccaacagccccatcgccaacaagaacgaactgaacgagaagcgcacctccacctttaagtatgatattattaaagacagacggtacaccgtggataagtttcagtttcatgtgcccatcacaatcggatttaaggccatcgggcagaacaatatcaatcccatcgtgcaggacaccatacggcagggcgggttcactcatatcatcggaatcgacaggggcgaacgccacctgctgtacctgagcctgatcgacctgaagggcaacatcatcaagcagatgaccctgaatgatattgtcaacgagtataatggcgtgctgtacaagaccaactaccgggacctgctgaagaaaagggagggcgaacggacagatgcacgcagaagctgggagactattgaaaccatcaaggagctgaaggaaggctacctgtcccaggtggtgcacattatctccaagatgatggtcgagtacaacgccattattgtgctggaggacctgaacaccggatttatgaggggcaggcagaaaattgagcggcaggtgtacgaaaagtttgagaagatgctgattgacaagctgaattgttacatcgacaagcagacaaaccccgaagacgtgggcggcctgctgcacccactgcagctcacatgcgatgcacagaagtggaagaggagccaccagtgtggctgtctgttttacatccccgcctggaacacctccaaaatcgaccccgtcaccggcttcgtgaatctgttcgacactaggtacgagacacgagagaaggcccggctgtttttctccaagttccagcgcatcgacttcaacaccgagagcgactggttcgagttttcctttgactacaatgacttcacaaccaaagcagaaggcacccggactaagtggaccctttgcacttacggagagcggatcagaaccttcaggaatcctgagaagaatcatcagtgggacgacgaaaggatcgtgctgaccgatgagttcacccagctgttcgagcgctataacatcgatatccagggcaacctgaaagaggctatttctgcccagtctgacgcacagttttaccgggaactcctggggctgatgaagctgctgctgcagatgcgcaactcaatcaccaatagcgaggaggattacctgctgtcccccgtggcagacgaatcttcccatttttttgattcccgggagaacgtggagatcctgcccaacaatgctgacgctaacggcgcctataatatcgcccgcaagggcctgtgggtgatcaggcggattcaggaaaccgctgagaacgagaaaatcagcctggccatctccaacaaggagtggctgcagttcgcccagactcagccctacctgaacgactga

SEQ ID NO: 186 - DNA, 2364 bp, synthetic construct
  source 1..2364: mol_type = other DNA
ctccagctgaccgatacagaggacaaactcagtcagaataaaccagctgtgggcaagattaaggccctgctggacgccttcaaagacctgcagcacttcatcaagcctctgctgggctccggggaagaaaatgagaaggatgagctgttctatggcgccttccagctgatctgggatgaactggacaccgtgacccctctgtacaataaagtgaggaactggctgaccaggaagccgtatagcaccgagaaaatcaaactgaactttgacaacgcccagctgctggggggatgggatgtgaacaaggaaccggactgcaccggcgtgctgctgaggaaggacgggttctattacctgggcatcatgaacaaaaagagtaatcgcatcttcgatgctgacgtgacccctgccgacgggatttgctacgaaaagatcgattataaactcctgcctggggccaacaagatgctgcctaaggtgttcttttctaagagtcggatcgatgaattcgccccatccgaggccatcctgagcagctacaagcggggcacacataagaaaggcgccgacttctccctgtccgactgccaccggctgatcgatttcttcaaggcttccatcaacaaacacgaggactggagtaagtttggcttccaattctccgataccaagacctatgaggacatcagcggcttttacagggaggtggagcagcagggatatatgctgtcatcccaccaggtgagcgaagcctacatcaaccagatggtggaggagggcaagctctttctgttcaggatctggaacaaagatttctccgagtacagcaagggcaccccaaatatgcacactctctactggcggatgctgttcgacgaacgcaatctggccgatgtggtgtacaagctgaatggacaggccgaagtgttctaccggaaggcttccattaaggccgagaaccagattatgcaccccgctcatcaccccatcgaaaacaagaatacactgaacgagaagcgaagtagcaccttcgactacgacctggtgaaagaccggaggtacaccgtggacaagttccagttccacgtccccatcaccatcaacttcaaggccatcggccagaccaacgtcaatcccatcgtgcacgagaccattagacggggcggctttactcacgtgatcggcatcgatcggggcgagagacaccttctgtaccttagcctgatcgatctgaagggccatatcgtgaaacagatgaccctgaacgagattatcaacgagtacaatggcctggcccacaagaccaactactacgacctgctggtgaagcgagagggtgagcgaactaccgctaggcgcagctgggacaccatcgaaaacatcaaggaactgaaagagggctacctgagccaggtgatccacattatctccaagatgatggtggagtataacgccattgtggtgctggaggatctgaacatggggtttatgcggggaaggcagaagatcgagagacaggtgtacgagaagtttgagaagatgctgattgataaactgaactgctacatcgataagcaggccgacagtcagtctgagggcggcctgctgcaccccatccagctggccaataagttcgagagcttcaggaagctgggtaagcagagcggctgcctgttttatatccctgcatggaacaccagcaagatcgatccagtgaccggctttgtcaacctgttcgatacccggtacgaaactagggaaaaggccaagctctttttcagccatttccagcgtatctgctttaatgctgagaaggactggtttgaattcagttttgattacaacgacttcactaccaaagccgagggcaccaggacccagtggacactgtgctcttatggcaccagaatcagaaatttccgcaatcctctgcagaatcatcagtgggacgatgaagagattgtgctgaccgaggccttcaaggctctgttcgacaagtacgacatcgacatccatgccaatctgaaggaagccattaacgcccagaccgatgctcagttcttcaaggatctgatgggcctgatgaagctgctgctgcagatgaggaactccaaaactaacagcgaggtggactatctgctgagccctgtggctgatgagcacggccgcttcttcgatagtagagccggcgccggctctctgcctgacaacgccgatgccaatggcgcctacaacatcgccagaaagggactgtgggtgatccggaagatccaagagacccccgagggcgagaagctgagtctggccatcaccaacaaggaatggctggagttcgcccagacaaagccctacctgaatgactag

SEQ ID NO: 187 - DNA, 3795 bp, synthetic construct
  source 1..3795: mol_type = other DNA
ctgggcctgttcctgagactccggccaaagctgttcgtgatcctgtgcaagagcaactcaaacgtgatgaggaacctgaccaacctgtaccccgtgtctaagactctgcggtttgaactgcagcccatcgggaaaaccaaagagaacatcgagaagaatggaatcctgcagagggacgaaaagcgggccgaggactaccagaaggtcaagaacctgatcgacgagtaccacaagcagttcatcaaggacagactgtggaccttcgagctccccctggagattctggaggagtacaaagaactgtatgagacccctaagcgagacgaagccgcctttaccgaggtgaaggataacctgcgggccctgatcgcctcccagctgaaggccaagggaagtatctatgaccgcatcttcaagaaagagctgatcagagaagacctgatcgagttcctggataacgaggaggataaggagatcgtgagacagtttgccgactttaccacttacttcagtggctttcacaagaaccgggagaacatgtactccgcagaggagaagagcaccgctatcgcatacagactgatccaccagaatctgcccaagtttatggacaacatgaaggccttcgccctgattgctaaatcccccgtcgccgagcacttccccgatctgtactcagcctgggaggagtgcctgaacgtggcatccatcgaggaaatgtttcgcctggactatttctcccagacactgacccagaccggcatcgaagtgtataactatatcatcggcaaaaaaattctggaggatggcacagagatcaagggaattaacgagtacgtcaatctgtacaatcagcagcagaaggacaagaaggaaagactgcccctgctggtcccactttataaacagatcctgtctgatcgcgagaaactgtcttggttggcagaggagtttgactccgatgaaaagatgctgaacgcaattaatgagctgtatgcccaccttcatgacctgctgatgggcgaagagaacgagtctctgcactctattctcctgcagctgaaagaatacgacctgtctcagattaacattgccaacgatctgtctctgacagccattagtcagcagatgttcggcagatatgacgtgtttaccaacggaatgaaagatattctcaggaccatcactcctcacaagaagaaggagaccgaggaagatttcgaggagaggatcagcaaaatcctgaagatccagaagtctatctctatcgcagaactgaacaagctgcctcagcccattagcgaggatggcgggaaacccaaactggtggaagattatttcatgagcctgggggccgtggacgacggcgtaacccagaaggctaatctgttcgcccagattgaaaacgcccacaccgacgctctgtccgtgctgcagctgacaggtaccggcgacaccctgtcccagaacaagacagccgtggccaagattaaaactctgctggatgcctttaaggatctgcagcacttcattaagccactgctggggagcggcgaggagaacgagaaagatgagctgttttacggcagcttccagctgttttgggacgagctggacgctgtgacccccctgtacaataaggtgagaaactggctcacccggaagccatattccacagagaagatcaagctcaacttcgataatgcccagctgctcgggggctgggacgtgaacaaggagccagattgcactggcatcctgctgaggaaggacggactgtattacctgggaatcatgaacaagaagagcaacagaatcttcgatgccagcgtgacccctagtgacggagactgctatgagaaaatcgactacaaactgctgcccggcgccaacaagatgctgcccaaggtgtttttcagcaagtccagaattgacgagtttgcccccagcgatgccatcatcaattcctataagagagagacacacaagaaaggcgccaatttctccctgagggactgccacagactgatcgattttttcaaacagtccatcagcaagcatgaagactggagtaagttcggcttccacttttccgatacatccagttatgaggacatctccgggttctatcgggaagtggagcagcagggctacatgctgagctctcaccctgtgagcagtgcttatatccaccagatggtggatgaggggaaactgtttttgttcaggatttggaacaaggatttcagcgaatactctaaaggtacacccaacttacataccttgtattggaagatgctgttcgacgaaagaaatctggctgatgtggtgtacaaactgaacggccaggccgaggtgttctaccggaaagcctctatcaagcctgagaatagaatcatacaccccgccaatcaggacattaagaataagaatgctctgaacgagaaggccacttctcggtttgaatatgacattgtgaaggaccggagatacaccgtggataagtttcagttccacgtgcctctgaccatcaatttcaaagccactggacaggcaaatgtgaaccccgtggtgcaggaggccatccgcaagggcgagttcactcacattattgggatcgaccgcggcgagagacacctgctgtatctgtctctgatcgacctgaaagggagaatcgtgaagcagatgacactcaatgaaatcgtgaacgagtacaatggccactctcacacaacagactaccatggactgctcgccgatcgggagggccagcgcaccactgcaaggagatcttgggatactatcgaaaacatcaaggagctgaaagaaggatatctgagccaggtgatccacgtcatcacaaagatgatggtggaatacaaggccatcgtggtgctggaagacctgaacatggggtttatgagaggcagacagaagatcgaaaggcaggtgtatgagaagttcgagaaaatgctgatcgagaaactgaactgctatatcgataagcaggccgatcccaccgatgtgggcggcctgctgcacgccctgcagctgacaaacaaattcgagtccttcaagaaactgggcaagcagagcggctgcctgttctacatcccagcctggaataccagcaaaattgacccagtgactggctttgtgaatctgtttgataccaggtacgagacaagggagaagtccagactgtttttctctagattcgataggattgcctataatcaggacaaggactggtttgagttctcatttgactatgacaactttactactagggccgaagggtgcaggacccactggactctgtgcacccagggcacaagaatcagaaacttccggaacccacagaagaataaccagtgggatgacgaagaggtgaacctgaccgccctgttcaaacagctgttcgacctgtatgacatcgatatccacggcaacctgatggaggccatccagagacagacagaggccaagttctaccaggagctgatgcacttaatgaagctgaccctgcagatgaggaatagcagaatcaactccgaggtggactacctgctgagccctgtggctgacgaaaagggcaggtttttcgattccagatccggggattgtgtgctccccgacaacgccgacgccaacggcgcttacaacatcgctagaaagggcctgatgctgattcagaccatcagagaaacccccgatggcgagaagcccagcctgaccatcaccaatagggagtggctgcgattcgcccaggagaagccttacctggtcgactaa

SEQ ID NO: 188 - DNA, 3747 bp, synthetic construct
  source 1..3747: mol_type = other DNA
atgaagcagttcactaatctgtaccctgtgagcaagacactgagattcgagctgcagcccattggaagtacaaaggagaacattgagaagaacgggattctgtctagagatgagcagagggccgaagactacaagaaagtgaagaacctgattgataaataccacaaacagtttatcaaagaccggctgtggaattttcagctcccactggagaataaggggaacctggacagtctggaggagtatcgcatcctgtacgagacccccaagagggatgaggccgtgttcactgaggtgaaggacaacctgagggctctgattgtgaatcagctgaaggccaagggcagcgcctatgagcgcatcttcaagaaggaactgatccgggaagatctgattgagtttctggacatggaggaggacaagaaaacagtgagacagttcgctgattttaccacctacttcactggattcaacgagaacagggccaatatgtacagcgccgaggagaaaagtactgctatcgcatacagactgatccatcagaatctgcctaagtttatggacaacatgaaagcttttgcccaaatcgtgcagtcaccagtggccgaacactttaccgacctgtactcctactgggaagagtacctcaatgtggcctccatcgaggagatgtttcagctggatttcttcagccagaccctgacccagaccgggatcgaagtgtataactacatcatcggcaagaagattctggaggatggaaccgagatcaagggtatcaacgagtacgtgaactattacaaccagcaccagaaggataaaaagcagcgcctgcccctgctggtgccactgtacaagcagatcctgtctgacagagagcgcctgtcatggctcgctgaggaattcgattccgatgagaagatgctgaaggccatcaacgagctgtatgtgcacctgcacgacctgctgatgggaaaggagaacgagtcccttagatctctgctgctgaagctcaaggagtatgacctgagccagatcaatattgccaataacttctctctgaccgccatctgccaccagatgttcggcagatatgacgtgttcattaacggcatgaaggatattctgagagccattacaccccacaaaaagaaggagaccgaagaggagtttgaagagaggatttcaaagatcctgaagacccaaaagtctatcagtatcgccgagctgaacaagctgccacagcccgtgtgcgaggactgctgcaagcccaaactggttgaggattacttcatgtccctgggggcagtggatgatggcgtgacacagaagctcaacctgttcgcccagatcgagaacgcccacacagatgctctgagcgtgctgcagctgaccggcacaggagatacgctgtctcagaataagcccgccgtggccaagatcaaaaacctgctggacaccttcaaaaatctccagcattttatccagccactgctgggcagcggcgaggagaatgagaaggacgaactcttctatggctcctttcagctgttctgggacgagctggatgctgtaaccccactgtataacaaggtgaggaactggctgacacggaagccttactccaccgagaagattaaactgaatttcgacaatgcccagctgttgggcggctgggacgtgaacaaagagagcgactgcaccggcgtgctgcttagaaaaggggcctattactatctgggaatcatgaacaaaaaggccaataggattttcgatgcctgtatcaccccctcaaacggcgactgctatgaaaagatcgattataagctcctgcccggcgcaaacaagatgctgccaaaagtgttcttttctaagagccacatcgatgagtatgcccccagcgacgtgatcatcgagaattataaaaagggcacacataagaagggcgccgacttcagcctgcaggactgccacagactgattgatttctttaagcagtccatctcaaagcacgaggattggtctaaattcggctttcagtttagccccacctgctcatacgaagatatcagcgggttctatcgggaagtggagcagcagggctatatgctgtccacacaccctgtgtctagcgcctatatcgatgagatggtggccgagggcaagctgttcctgttcaggatttggaataaggatttttccgaatactctaaaggcactcccaatctgcacaccctgtattggaagatgctgttcgacaagagaaacctggccgatgtggtctacaagctgaacggccaggccgaagtgttctacaggaaggctagcatcaaaccagacaaccggatcattcaccctgctaaccaagatatcaagaacaagaacgccctgaacgagaacaagacttctaggttcgagtatgatatcatcaaagaccacagatacaccgtggataagttccagtttcacgtgcccattacaattaacttcaaggccatcggccaggccaatattaatcccattgtgaacgatgccatcaggaagggcgtgttcacacacatcatcggaatcgatcggggagagcggcacctgctgtatctgtccctgattgatctgaaggggcgcattatcaaacagatgaccctgaatgagatcgtgaatgagtacaacggccactcccacgccaccaattatcgggacctgctggccaacagagagggcgagagaactaccgcccgcaggtcttgggataccatcgagaacatcaaggagctgaaggaaggctacctgagccaggtgatccacgtgattaccaagatgatggtggaatacaaggccatcgtggtcctcgaagacctgaataccggcttcatgaggggaaggcagaagatcgagagacaggtctacgagaagttcgagcggatgctgatcgagaagctgaattgctacattgacaaacagacaacccccaccgccgagggcggcctgctgcatgccctgcagctgaccaataaattcgagagctttaagaagctggggaagcagtccgggtgcctgttctacatccctgcctggaatacctctaagatagaccccaccaccgggttcgtgaatctgttcgacaccagatacgaaactcgggagaaatcgcggctgttcttcagcagatttgatagaattgcctataacagagacaaagattggttcgaattctcatttgattacaataatttcacaaccaaggccgaggagtgtcggaccaggtggaccctgtgtacccagggaacccggattatcaactttagaacccctcagaagaacaatcagtgggaggacgaggaagtgaacctgaccgtgctgttcaagcagttgttcgaccggtacgacatcaacatccatggaaatctgatggagacaattcagcagcagaccgaggccaagttctaccaggaactgatgcacctgctgaagctgacactgcagatgcgcaactctaggaccaactccgaggtggactacctgctttcccctgtggctgatgagcacggacacttcttcgatagcagggaggacatcgaaactctgccaaacaacgccgacgccaacggggcctacaacattgcccggaagggcctgtgggtgatcagaaagatccaggagacaccagagggcgagagaccctccctggccatcacaaataaagagtggctgcagttcgcccagactaaaccctacctgaatgattga

SEQ ID NO: 189 - DNA, 3822 bp, synthetic construct
  source 1..3822: mol_type = other DNA
atgactcagaaattcgacgacttcattcacttatactctctgagtaagactctgcggttcgaggcaaggcccatcggtgacactctgcgcaactttattaaaaacgggctgcttaaacgggacgaacatcgagccgagtcatacgtgaaagtgaagaagctgattgacgagtaccacaaggcgttcattgacagagttttgtctaacgggggactgaattatgaggataaaggggagtatgactccctgactgagtactatgtcctatattccacgacccgccgggacgaaaccacccagaaacattttaaagccacacagcagaacctgcgagatcagatagtgaaaaaactcacagatgacgacgcttataagcaccttttcggcaaggaattgatcgaatcctacaaagacaaagaagataagaagaagctccatgaggcagatctggtacagttcattaataccgccaatccgaaacagagactgaatttctctaagaaggaggctattgaccttgtcaaagagttttgtgggttcaccagttattttggcgacttccacaagaatagaaagaatatgtacagcgccgaagaaaagtcaaccggtatcgcgtatcgcttgatcaatgagaatctgccaaaattcattgataacatggagtccttcaagaaaattgctgcaatcccagaaatggaagataacctgaaagagattcacgacaattttgccgagcacttaaatgtcgagaacattcagaacatgttccagctcaactattataaccagttgcttacccagaaacagatcgatgtgtacaatgccataatcgggggtaaaacggatgaggagcataaagaaaagatcaaggggattaacgaatatgtgaacctctataaccaggctcacaaggacgctaagttaccaaagcttaagaccctgtttaagcagatactctctgaccgtaacgcaatctcctggctgcccgaggagttcgacaatgaccaggaggccctcaacgctatcttagactgttacgcgcggctcagtgaaaatgttctggggaaggagaatcttaaacggctgctgtgcagcttgagcgaatatgatactaagggtatatttctgcggaatgatctccaacttacgtcaatctcaaaaaagatgtcaggtagttggactgatatcccctctgcaatcaaaaatgacatgaaggatggagcccctgccaaaaaaagaaaagaaagcgaagaggattacgaaaagcggatcgacaacctgtttaagaaactcgactctttctctataggctacatcgacgattgtttgaacaagttcgacaacaacaatacctttacaatcgaaggatatttcaaggaattgggagcaaaagatacccagtcagaagacatcttcaagcaaatcgctaacgcatacacagacgtcaagcctctcctgaactctccttaccccaagtccaagaatctgagccaagataaggagaacgtcaaaaagattaagaggttccttgacgccctgatgtccctggttcactttgtgaaaccattgctgggaaatggcgatgagagcaataaagatgagaagttctacggagagctctcactactgtggacagagttagagacaatagtgcctctttataacatggtacgaaattacatgacacggaagccatacagtaactccaagatcaaactcaatttcgaaaatagccaactgcttggcgggtgggatgtaaataaagaaaaggagcgcgcttccatcctactcagacgcaatggcctgtactatctggctattatggataaagactctagcaaactgttgggcaaaagtatgccaagcgacggtgagtgctatgagaagatggtgtataaacaaatctcgtttaacagcggctttggggggttcattaggaagtgctttaactcagctacggaattaggatggaaatgtagccctacatgcctcaataaggatggcaagataataatactcgacgaggaagctacagacataagaccagagctcattgacaactataaatcattcctcgatatctacgagaaagatggctataaatacaagaactttgggtttcacttcaagaaatcgtctgaatatgagaacatcaacgatttcttcaaagaagtcgagcagcaaggatataagatcaccttcacgaatgtctcagtggcatttatcgacaagctggtgaaagaaggaaagatgtaccttttccaaatctactccaaggatttttccgagtactctaagggcacaccgaatatgcacactctgtactggaaagccttgttcgatgataggaacctaaaggatgttgtgtacaagctagacggccaggctgagatgtttttccgaaaaaagagcatcaactgtaatcacccaacacatcctgccaatcagcccattcagaacaagaacaaggataacaagaaaaaggagagtgtctttaagtatgacctcactaaggacaggagatatgccgtggataagtttatgtttcatgtgcctatcaagatgaactttaagtccactgggacagagaacatcaacctgcctgtgagagagtacctgaaaactagtaatgacactcatattatcggaattgacagaggcgagaggcacctgctctacctggtggtcattgatttacacggtaacatcgtggaacagtattcactcaatgatatcgtaaatgagtacaatggcaatacttacaggaccaactaccatgatctgcttgatgctcgtgaagaagacaggctgaagcagaggcagtcgtggcaaacaattgagaacatcaaagaactgaaggagggttacttaagtcaggttatacacaagataacccagctgatgatcaagtaccatgcaatcatagtgttagaagatctgaacatgggatttatgcgtggccgtcaaaaagtggagaagcaggtctaccaaaagttcgagaagatgctgattgataagctaaattacctggtcgataagaaggcggacattgagagcactggaggtctgcttaacgcctatcagttgactaataagtttcccggtttcaaaaacctgggcaagcagagcgggtttcttttctacattcccgcatggaacaccagcaaaatcgaccccgtaaccgggtttgttaacctgctcgacattcgcaatgttgataaggccaaggcattcttcgccaaatttgacagcatttggtacaataaagagaaggactggtttgagtttgccttagactatgataaattcggcagcaaagccgagggcaccagaactaaatggaccctttgcacccagggcaaacgcatcaagacattcaggaatgccgacgaaaactccaactgggattatcagattatagacttgaccaaggatctgaagcaactatttgcccaatacaatatcgacatcaatgggaacctaaaagaagcgatctctaatcagacagaaaagacgtttttcgtggagcttttgggcctgctgaaactgacattgcagatgcggaacagtattaccggaacggaaaccgattatttggtgagtccggttgccgacgaaaatggaaatttctatgattcccgaacatgcgggcatagcctccctgaaaacgccgacgctaacggagcttttaatatagcacgcaagggcttgatgattattgaacagattaaagcgtccgacaacctctccaagctcaaatttgacatttctaacaaatcctggctcaatttcgcacagcaaaaaccctacaaacatgagtga

SEQ ID NO: 190 - DNA, 3813 bp, synthetic construct
  source 1..3813: mol_type = other DNA
atgaaaagaaagttcgacgatttcatccacctgtacagcctgagcaagactctgcgattcgaggccagccccatcggagacacactgcggaatttcaaaaagaatggcctgctggagcgggataaacacagagccgagtcatacgtgaaagtgaaaaagcttatcgacgagtaccacaaggtgtttatcgatagagtgctgaacggcagcgtgctgaactacgtgaacaagggcaagtatgactccctgacagagtactatgacctgtacagcgtcccaaagaaggatgaaacctctcagaagcacttcaaggccatccagcagcacctgagacagcagattgtgaagaaattcaccgacgacaaaaactacaagagactctttggcaaagagctgctggagtcctacaaggataaagaggacaagaagaagctgaatgaggccgacctggtgcagttcattaatgccgccaaccccgaacagctgctgtccctgagcaagaaggaggccatcgatctggtgcaggaattttccggattcaccacttacttcaacgagtttcacaagaacaggaaaaatatgtacagcgccgaggaaaaaagtacaggcatcgcctacaggctgatcaacgagaatctcccaaaattcatcgataatatgaagagcttcaagaagatcgtggacatcccagagatgaaggataatctcaagcagatccacgaatatttcgtggactacctgaacgtcgaaaacatccacgaaatgtttcagctggactactataaccagctgctgacccagaagcagatcgacgtgtacaatgcaattatcggagggaaaaccgacaatgagcataaggagaaaatcaaagggatcaatgagtacgtgaacctgtacaaccagacccacaaggacgccaaactgcccaagctgaaggtgctgtttaagcagatcctgagcgacaggaacgccatcagttggctgccagaggagttcaaggatgatcaggaggtgctgaacgccatcaaggattgctacgcccggctgtctaaaaacgtgctgggagataatatcctgaaagaactgctgtgctcactggccgaatacgacaccaagggcatcttcctgcggaacgacctgcagctgaccgatattagccagaagatgtttgggaactggtcagtgattcccagcgccattaagaaggatgtggcccctgcaaagaagcgtaaagagctggaggaggactatgagaaacggatcgacaacctgttcaagaaacgcgaaagcttcagcattgactatatcgacagctgcctggataaattcgacgagaacaacactcacacaatcgaggggtactttgccacactgggcgccgttgatacccccaccacacagagagagaacatctttgcccagatcgctaacacctacacagacctggaaccactgctgaagtcaccctacagcaagaataagaacctgagtcaggacaaggacaatgtcgccaagattaagctgtttctggatgccctgatgagcctgatgcacttcgtgaagccactgctgggcaagggggacgagagcaacaaggatgagaagttttatggcgacttcacactgctctggaccgagcttgagaccgtggtgcctctgtataacatggtgagaaactacatgaccagaaagccttactcaaaatccaaaattaagctgaatttcgacaacagccagctgctgggcgggtgggacgccaacaaggagagcgactacgctagcatcctgctgcgcagagatgggaagtactacctggccatcatggacaaggattctaagaaactgctgggcaagagcatgccttctgacggcgagtgctacgaaaagatggtgtataagctgctgccaggcgccaataagatgctgccaaaggtcttctttgccacaagccgcattaaggacttcaagccatcagagcagctgctggagaactacaacaagggaacccacaaaaagggagtcaatttctccatctctgattgccatgccctgatcgattactttaagcagtccattaataagcacgaggattggaagaatttcaactttaacttcagcgagacatccacatacgaggacctgtcagccttctacagggaggtggagcagcagggctacaagatcacctttaccaatgtgagcgtgtcatttatcgacaaactggtggaggagggcaagatgtacctgttccagatctataacaaagatttttcagagtactccaagggcaccccgaacatgcatactctctattggaaggccctgttcgacgagcggaacctgaaggatgtggtgtacaagctgaatggccaggccgaaatgttcttcagggagaaatccatcaaggtcagcacaatccaccccgctaatcgccctatccagaacaaaaataaggacaacaagaaaaaagagtcaatcttcgagtacgacctcatcaaggacaggcgctacaccgtggataagttcatgttccacgtgcccatcactatgaactttaagtctgccgataccgagaacattaatctgcccgtgagagaatacctgcagacttctgacgacacacacatcatcggaatcgatcgcggcgaacggcatctgctgtacctggtcgtcatcgatttgcagggcaatatcgtggagcagtatactctgaatgatattgtgaacgaatacaacggcaacacctacaggacaaactatcatgatctgctgaacgctagagaggcagagaggctgaaggccagacagtcttggcagaccattgagaacatcaaggagctgaaggaggggtacctgtctcaggtgatccataagatcacccagctgatgattaaataccacgccatcgtggtgctggaggatctgaacaagggctttattcgcggccgccagaaggtggagaagcaggtgtatcagaagttcgagaaaatgctgatcgataagctcaattatctggtggacaaaaaagctgatatcgagaccaccgggggcctgctgaacgcctaccagctgaccagtaaattcgagtctttccagaaactgggaaagcaatccggtttcctgttttacatccccgcctggaacacaagcaagatcgatccagtgaccggcttcgtgaatcggctggacaccaggtaccataacgtggacaaaagtaaagcttttttcgctaaatttgatagcatccggtacaacaaagaaaaggactggtttgagttcgccctggactataagaactttggaaacaaggccgaagggacaagaacaaagtggaccctctgcacccagggcaaacggatcaagacattcaggaacgccgagaaaaatagcaattgggactaccagatcatcgacctgactaaagaactgaagcagctgttcgcccattacgacatagacatcaatggcaatctgaaaaaggctatctctaaccagactgagaagacatttttcgtggagctcatgcagtttctgaagctgaccctgcagatgcgtaattcaatcaccaacactgagaccgattatctggtgtccccagtggccgatgagaatggcaatttctacgacagccgcaaatgcggctcctcactgcccgagaatgccgacgctaacggcgcttttaacatcgctaggaaggggctcatgatcatcgagcagatcaaggcaagtgacgacctgtccaagctgaagttcgacatttctaacaaaagttggctgaacttcgcccagcagaaaccctacaaacatgaatga

SEQ ID NO: 191 - DNA, 3366 bp, synthetic construct
  source 1..3366: mol_type = other DNA
ctggtccagttcatcaataccgccaatctgaagcagagactgaacctgagcaaagaagaagccaaagacctggtgcaggaattttgtggcttcaccacatattttggcgacttctaccagaaccgcgaaaacatgtactccgccgaggagaagtccaccggcatcgcctaccggctgatcaacgagaatctgcccaagttcatcgataatatggagacttttaaaaagatcgctgccatccccgagatggaggacaacctgaaggaaattcacgacaatctgtctgagcacctgaatgtggagaacatccaggacatgtttcaactgaattactataatcagctgctgacccagaagcagatcgatgtgtacaatgccattatcggcgggaagaccgatgatgagcacaaagagaagattaagggcattaacgaatatgtcaatttatacaaccaggctcacaaggacgccaaactgcctaagctgaagaccctgtttaagcagatcctgtctgacaggaatgctatctcctggctgcctgaagagtttgacaacgatcaggagaccctgaacgccatcaaggactgctatgcccacctgtccggcaacatcctgaaggacgagaacctgaaacggctgctgtgctccctgagcgagtacgataccaaaggcatcttcctgagaaatgatagccaactgacctccatctccaagaaaatgtccgggtcttggacagacatccccagcgccatcaagaatgacatgaaggacggagtgcccgctaagaagagaaaagagagcgaagaggattatgagaaacggatcgacaacctcttcaagaagcaggactctttcagcatcgattacatggatgcctgcctgaataagttcgtggaaaacaacccttacactattgaggggtatttcaaagagctgggggctaaggatactcagagcgaagatatctttaagcagatcgagaacgcctacaccgacgtgaaacctctgctgaatagcacatatcctaagaataagaacctgtcccaggacaaggagaacgtggccaagattaaacgcttcctggataccctgatgagtctggtgcacttcgtgaagcctctgctgggaaaaggcgacgagaggaacaaggacgaaaaattctatggcgagctgtccctgctgtggacagaactggaaaccatcgtgcctctgtacaacatggtgagaaattacatgaccaggaagccttactccaacagcaaaatcaagctgaattttgataactcacagctgctgggaggatgggacgccaacaaagaaagcgattacagctccatcctgctgtatagggatggaaagtactacctggccatcttcgacaaggattctaagaaactgctcgggaaaagtatgccctccgacggggagtgctacgagaagatggtgtataagctgctgcctggagccaataaaatgctgcccaaggtgttcttcgccaagagcaggattaaggactttaaacccagcgagcaactgctggaaaagtataacaaaggtactcacaaaaagggcaagaatttctccatcagcgactgccacgcactgattgactttttcaagcagagcattaacaaacacgaagattggaaaaactttgacttcaactttagtgagacctccacctacgaggacctgaactccttttatagggaggtggaactccagggctataagatcacattcactaaggtgagcgcttccttcatcgacaagctggtggaagaaggcaaagtgtacctgttccagatctacaataaggacttcagtgagtattctaagggcactcctaacatgcacaccctgtactggaaagccctgttcgacgatagaaacctgaaagatgtggtgtataaactgaacggccaagccgagatgtttttcagaaagaagtctatcaactgcaaccaccccacacacccagcaaaccagcccattcagaacaagaacaaggacaataaaaagaaggagagcgtgtttgaatatgacctgatcaaagaccaccggtataccgtggataaattcatgttccatgtgcccattacaatgaattttaagtccacaaacgagaaggatatcaatctgcacgtgcgcgagtacctgcagaccagtaatgacacccacatcattggcatcgaccggggcgagcgccatctgctgtatctggtggtgatcgaccttcacggcaatatcgtggaacagtacacactgaacgacatcgtgaatgagtataatggcaatacctacaggaccaattaccacgacctgctggacgcaagggaggaggacaggctgaagcagaggcagtcctggcagaccatcgagaacatcaaggaactgaaggagggatatctgtctcaggtgatccacaaaatcacccagctgatgattaaataccacgccattatcgtgctggaagacctgaatattggcttcatgaggggcagacagaaagtggagaagcaggagtaccagaagttcgagaagatgctcatcgacaagctgaactacctggtggacaagaaagctgatatcgagagcaccggaggcctgctcaacgcctatcagttgaccaataagttcgccagctttaaaaagctggggaagcagtccggctttctgttttacatccctgcctggaatacgagcaaaattgatcctgtgactggcttcgtgaatctgctggacacccgttatcagaacgtggacaaggctaaggctttcttcgccaaattcgatagcatcaggtacaacaaggacaaggactggttcgagttcgccctggattacaacaatttcggcagcaaggccgagggaaccaggaccaaatggacactgtgtacacagggaaagagaatcaagacatccttcaataagatgagttccaaatggaacaaccaggaaatcgaccttactaaggatctgaaacagctgtttgtgcagtacgatatcgatatcaacggcaacctgaaagaggccatctctaaacagaccaaatatacctttttcgtggagctcatgggcctgctgaagctgaccctgcagatgagaaattccatcaccggaaccgagacagactacctggtgtcccccgtggccgacgagaatggcaatttctatgactccagaacctgtggccccagccttcctgagaacgccgatgccaacggcgccttcaacatcgcccggaagggtctgatgattatcgagcagattaaggcatccgacgacctgagcaagctgaagttcgatatcagcaataagagctggctgaattttgcccagaagaagccctacaagcacgaatag

SEQ ID NO: 192 - DNA, 3924 bp, synthetic construct
  source 1..3924: mol_type = other DNA
atggccaagaaattcgaggactttaccaaactgtatcctctgtccaagaccctgtgcttcgaggccaggcctatcggagccactaagtccaatatcattaagaatggactgctggacgaagacaagcatagagctgagagctacgtgaaagtgaagaagctgattgacgagtatcacaaggcctttatcgacagggtgctggccgacgggtgtctgtgttacaagaacgagggaaacgaggactcactggaggagtattacgagttctacagcctctcctccaaggataaaagcgatgacaccagaaagcactttgctacaatccagcagaacctgcggtctaaaatcgccgagaccctgaccaaggacaaagcctacgctaaccttttcgggaacaaactgattgaatcacataaagataaggaggataagaacaatatcattgatagtgatctgatccagtttgtgagcaccgctacccccgatcagctggacagccagagcaaagatgatgccaccaaactgattaaggagttctggggatttactacctacttcaccgggtttttcgaaaatcggaaaaacatgtacacaagcgaagagaagtccacagggatcgcatacaggctgatcaatgagaacctgcccaagtttattgataacatggaaagcttcaaaaagatcatggagaaacccgaaatgtccgccaacatggaggaactgagagccaacctggaagagtacctgaacgtggaatccatctccgaaatgttcgagctgaattactacaacatgctgctgactcagaagcagatcgacgtgtataatgccgtgatcggcggcaagaccgacgaagaacaggatatcaaaacaaagggaattaatgagtacgtgaacctgtataatcagcagcacaaagacgccaagctgcccaagctgaagaccctgttcaagcagattctcagcgacagaaacgctatttcatggctgcccgaagagttcgacaaggaccagaatgtgctgaatgccatcaaggactgttacgtgagactgaccgcaaacgtgctgggcaacaatgtgctgaacagcctgctgagcactctgtctgagtacaacacagagtcaatcttcatcaggaacgacatccagctgactaacatttcccagaagatggccggcagctggaactacatccaggacgccatcaagcaggacatcaagaacgtggcccctgcccgtaagagaaaagagagcgaggaggactatgaggagagaatctctaaaaacttcaagaaggccgactcctactccatcaaatacattgacgactgcctgaatcgcgcctacaagaacaacacctacacagtggagggctacttcgccacccttggcgccaccaataccccttccctgcagagggagaatctgttcgcccagatcgctaacgcctatacaaacatctccagcctgctgtctagcgactactccgccgaaaaaaacctggcccaggataaggagaatgtggccaagatcaagaccctgctggactgcatcaaatcactccagcatttcgtgaaaccactgctgggaaaaggggacgagtcagataaagacgagaggttctacggcgagctgagcatgctgtggaaagaactggatactgtgacccctctgtataacatggtgaggaattacatgacccgcaagccttacagccagaagaagatcaagctgaacttcgaaaacccccagctgctgggaggctgggatgccaacaaggagaaagactacgccagcatcctgctgcgcagggacggcaaatactatctgggaattatggacaaagagagcaagaagctgctcggaaagcccatgcctagcgatggcgattactacgaaaagatggtgtacaagttttttaaagatattacaaccatgatcccaaagtgtagcacccagctgaaggccgtgaaggagcacttttctaagagcaacgctgacttcgtgctgtccggcaaaaacttcaataccccactgatcatttccaaagaggtcttcgaactgaacaatgtgaagtatgggcagttcaagaaattccagaaggactatgtggccaccaccaacgatatcgaagggtacgcccacgccgtgaagatctggattaagttctgcatggatttcctgggcacctacgacagcactatttcttatgacctgtcaagtctggccagtaacgagtataccagcttggatacattctaccaggatgtgaatcgcctgctgtatgccgtgagcttcatcaaagtgagcgtgtctcatatcgactccctggtggaggaaggaaaaatgtacctgttccagatctataataaagacttcagcgaatatagcaagggtacccccaacatgcacaccctgtactggaaggccctgttcgatgagaggaatctggccgacgtggtgtataagctgaacggacaggccgagctcttctatagagagaagtccatcgattgcacacaccctactcacccagccaaccacccaatcttgaataagaataaggacaacgaaaaaaaggagtccatcttcgagtacgacctcatcaaggaccgccgatacaccgtggataagttcatgttccacgtgcccattactatgaatttcaaaagcaccggggccgacaatatcaatcagctggtgagagagcacctgaaggacgccgacgccccccacattatcggaatcgacagaggtgagagacacctgctctatctggtggtcattgatatgcacggcaacatcaaagagcagttcaccctgaacgacatcgtcaatgagtataatggcaacacctatcggaccaattatcacgatctgttggatgctcgggaggacgcaaggctgaaggccaggcagagctggcagacaattgagaatatcaaggagctgaaggaaggctacttgtctcaggtgattcacaaaatcacccagctgatggtgaagtaccatgctattgtagtgctggaggacctgagcatgggtttcatgaggggcaggcagaaggtggaaaaacaggtgtatcagaagtttgagaagatgctgatcgacaagctgaactactatgtggacaagaaggccaacgccgagcaggctggaggtctgctgaatgcctaccagctgacctccaaattcgactctttccagaagctcggcaagcaatctggatttctgctgtacattcccgcctggaacacatccaagattgacccagtgaccggctttgtgaatctgctggacacccgctaccagaatgtggaaaaggccaaagccttcttctgcaaattcgaggccatcagatataactccaacaagaattggttcgaatttaccattgattacaacaacttcggccagaaagccgagggcacaaggacaaaatggaccctgtgcacacaggggaagagaatccggacctttaggaaccccgagaagaactccgagtgggacaatcaggagatcgatctgaccagcgccctgaagaacctgtttgcccactaccacatcgacatcaatgggaacattaaggaggccatctccgcacagtctgacaagaccttttttaccgagctgctgcatctgctgaagctgaccctgcagatgcggaacagtatcactggaactgaaacagattacctgatttctcccgtggccgacgacaatggctatttctatgacagcaggacctgtaatgatactctgcccaagaatgccgacgccaacggcgcctacaatatagccaggaagggcctgatgctgatcgagcagattaagaaggcaaaggatatcgctaatatcaaattcgatattagcaataagtcttggctgaacttcgctcagcagaaaccttataaggacgagtaa

SEQ ID NO: 193 - DNA, 3825 bp, synthetic construct
  source 1..3825: mol_type = other DNA
atgattaaggagttcgaggacttcaaaaggctgtatcctatccagaaaaccctgaggttcgaggctaaacctatcggaagcaccctggaacacctggtgaagtcaggtatcctcgatgaagacgagcatcgggccgccagctacgtgagggtgaagaagctgattgatgagtatcacaaggcctttatcgatagagtgctgaacgacggatgcctcccctttaagaataagggcgagaagaattccattgaagagtactacgaatcatacaccagcaaggataaagaggaggatagcaagaagaggttcaaagagatccagcagaacctgcgaagcatcatcgtgaataagctgacaaaagacaaggcctatgccaacctgtttgggaactacctgatcgaatcccataaggataaggaagacaagaaaacaatgatcgacagcgacctgatccagtttattaaagacgccgactctctggagctgggctctatgtctaaggacgaagccatcgagctggtgaaggagttttggtccttcaccacctactttgtgggcttctacgacaataggaagaacatgtatagcgccgaggaaaagagcacagccattgcctaccggctgatcaacgagaacctccccaagttcattgataacatggaggccttcaagaaaattataagcagacctgagattcaggccaacacggagcagctgtacagcgactttgcagagtacctgaacgtggaatccattcaggagatgttccagctggattattatgacattctgctgactcagaaacagatcgacgtgtacaacgccatcattggggggaagaccgacgagaaacacgacatcaagaccaagggcatcaatgagtacattaatctatataaccagcagcacaaggaggacaagctccccaagctgaaagtgctgttcaaacagatcctgagcgaccgaaatgccatctcctggctccctgaggagtttaactccgaccaggagatgctgatctctatcaaagactgctacgagaaactgtgcgtgaacgtgctgggcgacaaggttctgaagagcctgctgtcctccctggacgactatgagctggagggcatctttctgcagaatgaccagcagctgacaaatatcagccagaagatttttggctcctggagcgtgatccaggaagctattattaggaatatcaagaataccgcccccgccaggaagcataaggagacagaggaggattacgagaagaggatcttcagcatttttaagcaggctgggagcttcagtattaaatacatcgacgactgcctgtatgacctggacaagaataacatcaacacaattgagaactactttgccactctgggcgccgagaatacccccgagatccagagagagaatctctttgctctgatcaagaacgcctatactgatgtggccggactgctgtgcagcgagtaccctactgagaagaatctgtcacaggatgaaaatcacgtggccaaaattaaggccctgttggatgctatcaagagcctgcagcactttgtgaaacctcttctgggcaatggagacgaacacgataaggacgagaggttctatggagagctggtgtccctctggacagagttagacaccgtgactcccctgtacaacatggtgcgcaacaggatcacacagaaaccttatagccagaagaagatcaagctgaatttcgagaacccccagctgctgggaggatgggacgccaacaaggagaaagactactcctgtatcatcctgcgccgggagggcatgtattacctggccatcatggacaaggatagcagaaagctgctgggcaaagagatgcctagcgacggcgagtgttacgagaagatggtttacaagctgctgcccggcgctaataaaatgctgcccaaggtgttcttcgccaagtcccggatcgaggagttcatgccctccgagcagatcatcgaaaagtacaacaacggcacccataaaaagggcaaggatttcaacatcaccgattgccacaacctcattgactactttaagcagtctatcaataaacacgaagactggtccaagttcgggtttactttctcagagactagcacctacgaggacctcagcgggttctacagggaggtcgagcagcaggggtataagctgagtttcaccaatgtttccgccagctatatcaatagcctggtggatgagggaaagatgtatctgtttcagatttacaacaaggacttctccgaatacagcaagggcactcctaacatgcacaccctgtattggaaggcactgttcgatgagcagaacctggccgacgtggtgtacaagctcaatggccaggccgagatcttttacaggaagaagagcatcgatgccacccaccccacacacccagccaacagacctgtgcagaacaagaacaaggacaacaagaagaaggaatccctgttcgagtacgacctgatcaaagaccggagatacagcgtggacaaatttatgtttcatgtgcctatcaccatgaattttaagtccaatggctccgagaatatcaaccagcaggtgaaagagtacctgcagctggccaacgacacccacatcattggcattgacaggggagagcgccacctgctgtacctggtggtgatcgacatgcatgggaatattaaggagcagtttagcctgaatgagatcgtgaatacctacaaaggaaatatctaccacactaattatcacgacctgctggaggcccgggaggaggagaggctgaaagcccggcagagctggcagacaatcgagaacattaaggagttgaaggagggctacctgtctcaggtggtgcacaaaatcacccagctgatggtgaagtatcacgccatcgtggtgctggaggacctgaacatgggattcatgaggggccggcagaaggtcgagaagcaagtgtatcagaagttcgagaagatgctgatcgacaagctgaattacctggtgaacaaacaggctaatattacagaggccggggggctgctgaatgcctatcaactgacctcaaaatttgacagttttcagaagctgggcaagcagagcggcttcctgttctacattcctgcctggaacacctccaagatcgaccccgtgaccggcttcgtcaacctgctggataccaggtaccagaatgtggagaaggccaaggcctttttcagcaaatttgacgccatcagattcaaccaggataaagactggtttgagttcaacctggactacaacaaatttggggagaaggccgagggaaccagaaccagatggactctgtgtacccaggggaagagaatatacacattcagaaacgaggataaaaattctcagtgggacaacattgagatcgatctgacttccgaaatgaaatccctgctggagctgtaccacatcgatattcagggcaatctgaaggaggccatcaatagccaaaccgataagtccttctttacaaagctcatccacctgctgaagctcacactgcagatgaggaactctattacccgcacagagactgactacttgattagccccgtggccgacgaggatggcgagttctacgacagcagatcctgtggtcctgagctgcccaagaacgccgacgccaacggcgcatacaacattgctagaaaaggcctgatgctgatcaggcagatcaaggaggcaaaagagctggataagatcaagttcgatatctctaacaaagcctggctgaatttcgcccagcagaaaccatacaagaatgactga

SEQ ID NO: 194 - DNA, 3960 bp, synthetic construct
  source 1..3960: mol_type = other DNA
atggctaagattttcgaggatttcaagcggctgtaccctctgagcaagacactgagattcgatgctaagcccgtgggcgctaccctggacaacatagtgaaaagcggcctgctggaggaagacgagcacagggccgcctcctacgtgagagtgaagaagctcattgacgagtaccacaaggtgtttattgaccgggtcctcgacaatgggtgtctgcccctggagaacaagggcgaaaataattcactggccgagtactacgactcctatgtgtcaaaaagccagaacgaggacgccaagaaggcctttgaggaaaaccagcaaaacctgagatccatcatcgccaagaagctcacaggagacaaggcttatgctaacctgtttggtaagaatctgatcgagagctataaggataaaaaagacaaaaaaaaaattatcgattctgatctgattcagttcatcaataccgccgattccacccagctggattctatgacccaggtggaggccaaagagctggtgaaggaattctggggctttgtgacctatttctacggcttctttgacaacagaaagaacatgtacactgccgagaagaagagcaccggcattgcctaccggctgattaacgagaatcttcctaagttcattgacaatatggaggccttcaagaaggtgattgcccgccccgagatacaggccaacatggaagagctgtactccgatttcagcgagtacctgaacgtggaatcaattcaggagatgttccagctggattactacgatatgctgctgactcagaagcagatcgatgtgtataacgccatcattggcggcaagacagacgacgagcacgacgtgaagatcaaggggattaacgagtacatcaacctctacaatcagcagcacaaggacacccggctgcctaagctgaaggccctgtttaaacagattctgtccgacaggaatgccatctcctggctgcccgaggagtttaacagcgatcaggaggtgctgaatgctatcaaggattgttacgagcggctgtctgagaacgtgctgggagataaagtgctgaagtcactgctgggcagcctggccgattactcactggagggcatcttcatcagaaacgacctccagctgaccgatatcagccagaagatgtttggcaactggggtgttatccagaacgctatcatgcagaatatcaaacatgtggcccctgcccggaaacacaaggagtccgaggaggagtacgagaaacggattgccggcatctttaagaaggcagactcctttagcatttcctatctgaacgattgcctgaatgaggccgaccccaataatgcatacttcgtggagaattacttcgctacttttggcgccgtgaacaccccaacaatgcagcgggagaacctgttcgctctggtgcagaacaagtacacagaggtggctgccctgctgcactctgattacccaaccgcaaagcacctggcccaggataaggctaacgtggccaagatcaaggccctgctggacgctatcaagagcctgcagcatttcgtgaaacctctgctgggaaagggtgatgagagtgacaaggacgagcgcttctacggcgagctggccagcctgtgggccgagctggagactgtgacacctctgtacaatatgatccgcaattacatgacaagaaagccctactctcagaagaagattaagctgaacttcgagaatccccagctgctggacgggtgggacgcaaacaaggagaaggattatgccaccatcatccttagacggaatggcctgtactacctggccatcatgggaaaggactcaaagaacctgctggggaaggctatgcccagcgacggagagtgctatgagaagatggtgtacaagcagttcgacatttccaagcagctgccaaaatgcaccacagagctgaaacacgtgaggaaggctctggtggaggacgccaagagaagctgcctgctgagcgacttcaataattggaacaagccactgaacgtgactaggaagctgtgggagctgaacaatttcgtgtgggacaagaagaaagaggattgggtgctgagaaagaaggataacgagaccagaccaaagaagtttcacaaaaagtacctggagctgaccagcgacaagaagggctacaaccaggcaaagaatgactggatcaagttcaccaaggagttcctgagcagctataaaaaggtggaggcatacgacatccactataagaaaaggtacaattctgtggacgagctgtacaagcagctgaacggggacctgtatgcaatctctttcacatacgtgagcgcttctttcattgaacagctggtgtctgaaggaaagatgtacctgttccaaatctacaacaaggacttcagtgagtactccaagggaactcccaatatgcatacactgtattggaaggctctctttgacgagaggaatctcgccgatgtggtgtacaaactgaacgggcaggcagaaatgttctaccgcaagaaatctatcgagaacacccacccaacccatccagccaatcatccaatcctgaataagaataaggataacaaaaagaaggagagtctgtttgattacgatctgattaaggacagaaggtacacagtggacaagtttatgtttcatgttcctatcaccatgaattttaagagcagcgggagcgagaacatcaaccaggacgtgaaggcatacctgagacatgccgacgatatgcacatcatcggtatcgatagaggcgagagacatctgttgtacctggtggtgatcgacctgcagggcaacatcaaagagcagtactcactgaatgagatcgtgaacgaatataacggcaacacataccacaccaactaccatgatctgctggacgtgcgggaagaggagcggctgaaggcccggcagagctggcagaccattgaaaacatcaaagagctgaaggagggctacctgagccaggtgatccataagatcacccagctgatggtgaaataccacgcaatcgtggtgctcgaagacctgaacatggggttcatgagaggccgccagaaggtggagaaacaggtgtaccagaagttcgagaagatgctgatcgataagctcaattacctggtggataagaaggctgacgcttccgtttccggcggactgctgaatgcctaccagctgacctctaagtttgattccttccagaaaatggggaagcagagcggatttctgttttacatccccgcttggaataccagcaagatcgaccctgtgaccggattcgtgaacctgctggatacccggtatcagaacgtggaaaaggccaaagtgttcttcagtaagtttgacgccatcaggtacaacaaggataaggattggttcgaatttaacctggattatgacaagtttggaaagaaggccgaggggaccagaacaaaatgggctctgtgcaccaggggcatgaggatcgacactttccgcaacaaagagaagaactctcagtgggataaccaggagattgatctgacagccgagatgaagagcctgctggagcactactacatcgacattcacggcaacctcaaggacgccatctccgcccagaccgataaggctttctttaccgggctgctgcatattctgaagctgacactgcagatgaggaactccattaccgggaccgagaccgactatctcgtgagccccgtggccgacgaaaatgggatcttctacgacagtaggagctgcggggacgagctgccagagaacgccgatgccaatggtgcttataatatcgccaggaagggcctgatgatgatcgagcagatcaaagacgccaaggacctgaacaacctgaaattcgatatctctaacaaggcgtggctgaacttcgcccagcagaagccctataagaacggatga

SEQ ID NO: 195 - DNA, 3960 bp, synthetic construct
  source 1..3960: mol_type = other DNA
atggagtttaacgatttcaagcgcttgtatcccctgagcaagaccctgaggttcgaggccaagcctatcggcgacaccctgaagaacatcatcaagaatggcctgctggaggaggacgagcacagggcccagagctatgtgaaagtgaagaagctgattgacgagtaccacaaagtgttcatcgaccgtgtgctgaatgacggatgcctgaccatcgaaaacaagggaaaaaaggattctctggaggagtattatgagtcctatatgtccaagtccaatgatgagaatgtgtctaagacattcaaggacatccaggaaaacctgcgctctgtgatcgccaacaagctgaccaaggacaaaggctacgccaacctgtttggaaataagctgatcgagtcctataaggataaggacgatacaaagaagatcattgatagcgacctgatccagtttatcaataccgccgagcctagcaatctggactcaatgtcccaggatgaggcaaaggagctggttaaagagttctggggctttaccacctatttcgaagggttccacaagaacagaaagaatatgtacacctcagaagaaaagagtaccggaatcgcctacaggctggtgaacgaaaacctgcctaagtttatcgataatatggaggccttcaagaaggccatcgccaagcccgagatccaggctaatatggaggagctctatagcaattttgctgagtacctgaacgtggaatccatccaggaaatgtttcagctggactactacaatatgctgctgacccagaagcagattgacgtgtacaacgccatcatcggcggcaagaccgacgaagaccacgacgtgaagatcaagggcatcaacgaatacatcaacctgtacaatcagcagcacaaagatgagaaactgcccaagctgaaagcactgtttaagcagatcctgagtgaccggaacgccatcagttggctgcctgaagaatttaactccgatcaggaagtgctgaacgcaattaaggattgttacgagcgcctgagcgagaacgtgctgggagacaaggtgctgaagagcctgctgtgcagcctctctgactacaacctggatggcatcttcgtgagaaatgacacccagctgaccgatataagccagaaaatgtttggcaattggtctgtcattcagaatgccatcatgcagaacattaagaaaaagaaactggcccggaaaagaaaagaatctgaggaggattatgagaagagaatccctgatatttttaagaaggccgactctttcagcatccagtacattaacgacagcctcaataaaatggacgataataacctgcacgcagttgatgaatattttgcgacactgggcgctgtgaacacaccaacaatgcagcacgaaaatctcttcgccctgatccagaacgcctacaccgacatctccgacctgctggacacaccatacccagagaataagaacctggcccaggataagacaaatgtggctaaggtgaaggccctgctcgacgccattaagagcctgcagcacttcgtgaagccccttctgggcaagggcgatgaaagcgacaaagatgagcgcttctacggcgaactggccagcctatggaccgagctggacaccgtgacactgctgtttaacatggtgcacaattacatgaccagaaaaccctactctcagaagaagatcaagctgaactacaaaaacacccagctgctggctggctgggatgcgaacaaagagaaagagcacgccgccatcatcctgcggagaaacggtatgtattacatcgccatcatggacaaagactccaagaatctgctggataaagctatgcccagtgacggcgagtgctacgaaaagatggtgtataagcagtttgatatttcaaagcagctgcctaagtgcacaactgagctgaaacgcgtccgcaaggccctgatagaggacgccaagcggtcttgcctgctgtccgacagcaaagattggaataagcctctcaatgtgaccaggaagctgtgggagctcaataactatgtgtgggacaagaagaaagccgactgggtgctcaggaagaaggagaatgagactagaccaaagaagttccacaaaaagtacctggagctcaccagcgacaagaaggggtataaccaggccaaaaacgactggatcaagttcaccaaggaattcctgtcaagctataagaaagtgaaagactacgatattcactacaagaagcgatacaactcagtggacgagctgtacaaacagctgaactctgatttttacaccatctccttcacctatgtgtctgtgagtttcattgacaagctggtcaatgaaggcaaaatgtacctgttccagatctacaacaaggatttcagcaattacagtaagggcacaccaaatatgcacaccctgtactggaaagccctgttcgatgagcggaacctggccgacgtggtgtataagctcaacggagaggcagagatgttttatcggaagaagagcatcaacaacacccacccaacccatcccgccaaccaccccatccagaacaaaaacaaggacaacaaaaaaaaggaaagcgtgtttgagtacgacctggtgaaagattaccggtacaccgaggacaagttcctgttccatgtgccaatcaccatgaatttcaagagcgtgggttctgagaacatcaatcagcaggtgaaggaatacctgcagcaggccgacgacactcacatcatcggcatcgacaggggcgagcgccacctgctgtacctcgtggtgatcgacatggaggggaatatcaaggagcagtttagtctgaacgaaattgtgaacgagtataacggcaatacatatcggactaactaccacgacctgctggacgtgtgcgcagataagcggctgaaggctagccagagctggcagacaatcgagaacatcaaggagcttaaggagggatacctcagccaggccattcacaagattactcagctgatggtgaagtaccatgccgtcgtggtgctggaagacctgaacaaaggcttcatgagagggcggcagaaggtggagaagcaggtgtatcagaagttcgagaagatgctgatcgataagctgaactacctggtggacaaaaaggccgacgctgcccagagcggcgggctgctgaatgcttatcagctgacctccaagttcgactcattccagaagctgggaaagcagagtggctttctgttctatatccctgcctggaacactagcaagattgatcctgtgacaggcttcgtgaacctgttcgacaccagatacaccaacgccgacaaggccctcaaattcttctcaaaatttgacgccatcagatacaacgaggagaaggactggttcgagttcgagttcgactacgacgagttcacccagaaagcccacgggaccagaaccaagtggactctgtgcacatatggcatgaggctgtgttcctttaaaaatcccgccaaacagtataattgggactccgaagtggtggccctgacagacgagttcaagaggatcctgggagaggcaggcatcgatattcacgagaacctgaaggacgcaatctgcaatctggagggcaaatcccagaagtacctggagcccctgatgcagttcatgaaactgctgctgcagctgcggaattcccgcaagaaccccgaggaggattacatcctgtcccccgtggccgatgagaacggcgtgttttatgactccagaagctgtggcgacaagctgcctgagaacgcagacgccaacggcgcatacaacattgcccggaagggcctgatgctgatcagacagattaaaaaggccaaggagctggataaggtgaaattcgatattagcaacaaggcctggctgaactttgcccagcagaagccatacaagaacgaatga

SEQ ID NO: 196 - DNA, 3912 bp, synthetic construct
  source 1..3912: mol_type = other DNA
atggaattcaacgacttcaaacgcctgtaccctctgtctaagacactgaggttcgaggctaagcccatcggtagcacactgaacaatatcatcaaatccggcctgctggaagaggacgagcaccgcgctcagtcctatgtgaaggtgaagaagctgatcgatgagtaccataaggtgttcatcgaccgggtgctggatgacggctgccttaccatcgagaacaaggacaagaaggattccctggaggaatattacgaatcctatatgtccaagtctaacgacgagaacgtgagcaagacatttaaggagattcaggaaaacctgcgctctgtgatcgctaagaagctcaccgacgataaagcctacgccaatctgttcggcaagaacctgattgaaagctataaagataaggacgataagaacaagattatcgattctgacttgatccagttcattaatacagccgagccttctcagctcgactctatgtctcaggacgaggccaaagagctggtgaaggagttctggggctttaccacatatttcgtgggattttttgacaacagaaagaacatgtacacctccgaggagaagtctaccggcattgcctacagactggtgaacgaaaacctgccaaagtttatcgataacatggaggccttcaagaaggccatcgccaaacctgagatccaggcaaacatgggcgaactgtatagcaacttcgccgaatatctgaatgtggaaagcatccaggagatgttccagctggactactacaacatgctcctgacacaaaagcagatcgacgtgtacaatgccatcattgggggcaaaacagatgaggagcatgacgttaagatcaagggcatcaatgaatacatcaacctgtacaatcagcagcacaaggacgagaagctgcccaaactgaaggccctgttcaagcagattctgagcgacagaaatgccattagctggctgccagaggaattcaatagtgataaagaggtcctgaacgctatcaaggactgttatgagaggctgagcgagaatgtgctgggggacaaggtgctgaaatccctgctctgcagcctgagcgactataacctcaacggcatttttgtgcgcaatgacctgcagctcacagacattagccagaagatgttcggcaattggagcgtgatccagaacgccattatgcagaacattaaaaacgtggccccagcacgcaagagaaaggagagtgaggaagattacgagaagcgcatcagcgatatcttcaagaaggccgacagtttctccatccagtacatcaacgattgcctgaatgagatggacgataataacctgcacgccgtggatggctactttgccaccctgggcgccgtgaacactccaactatgcagcgggagaatctgtttgccctgatccagaatgcttatacagacatttccaacctgctggacacaccctatcccgagaacaaaaatctggctcaggataaaaccaatgtggccaaggtgaaagccctgctggacgccattaagagcctccagcactttgtgaagcctctgctgggcatgggcgacgagtcagacaaggacgagaggttctacggcgagctggcctccctctggaccgaactggacactgtgacccccctgtataacatgatccgcaactacatgacccgcaaaccctatagcgaaaagaaaatcaagctcaactttgagaacccccagctgctgggcggctgggacgccaacaaggagaaagactacgccacaatcatcctgcgcaggaacgggatgtactatctggcaatcatgaacaaggacagcaaaaaactgctggggaagaccatgccttctgatggggagtgctatgagaaaatggtgtacaagtttttcaaggatgtgaccaccatgatccctaagtgtagcacccagctgaaggacgtgcaggcctactttaaggtgaacaccgatgatttcgtgctgaatagcaaagcctttaacaagcctcttactatcacaaaagaggtgttcgatctgaataacgtgctgtacggcaaattcaagaaattccagaaggggtatctgtccgccaccggcgacaccgccggctacacacatgccgtgaacgtctggattaatttttgcatggactttctgaattcctatgaaagcacatgtatgtacgacttcacaagcctgaagagcgagagctatctgtccctggacgccttctatcaggacgccaacctgctgctgtacaaactgtccttcaccaacgtgtctgtttcttttatcgacaaactggtggatgagggcaagatgtacctgtttcagatctacaacaaggatttcagcgactacagcaagggtacacctaacatgcatactctgtattggaaagcactgtttgatgaacggaacctggtcgacgtggtgtacaagctgaatggacaggccgagatgttctaccggaaaaagtccatcgactacacccatcccactcaccctgccaaccaccccatccagaacaagaacaaggataataaaaagaaggagtctgtgttcgaatacgatctggtgaaggacaggcggtacacggtggataagttcctgtttcacgtcccaatcacaatgaactttaagagcgtgggctctgagaatatcaaccagcaggtgagagagtatctccagcaggccgatgacacacacattatcggcatcgacaggggcgagcgccacctcctgtacctggtggtgatcgacatgcagggcaacatcaaagaacagttcaccctgaacgagatcgtgaacgagtacaacggaaacacatataggactaactatcatgaccttctggacacacgggaggaagaaagactgacagccagacagagctggcagaccatcgagaacatcaaggagctgaaggaggggtacctgtcccaggtgatccacaagatcacccagttgatggttaagtaccacgcagtggtggtgctggaggatctgaacaaggggttcatgagaggccgccagaaggtggagaaacaggtgtaccagaaattcgaaaagatgctgatcgacaaactgaactacctggtggacaagaaggccgacgcaactcagagcggagggttgctgaacgcataccagctgaagagcaagttcgacagcttccagaagctgggcaagcagtcagggtttctgttctacattccagcttggaacaccagcaagatcgaccccgtgacaggcttcgtgaacctgcttgacaccagataccagaacactgagaaggccaaggctttcttctccaagttcgatgccatccgctacaatgccgacaaagattggttcgaattcaatttggactatgataagttcggaacaaaggccgagggaacacgtacaacctggaccctgtgcacccagggcaaccgcatctgcacatttagaaatgcagagaagaactcccagtgggacaaccaggagattgacctgacaagagaaatgaagtctctgttcgagcactatcacatcaacatctgtggcaatctgaaggaggaaatttgctcccagaccgacaaagccttcttcaccgggctgctgcacatcctgaaactcaccctgcagatgaggaacagcattaccggcaccgagaccgactatctggtgtcccctgtggccgacgaaaatggcgtgttttatgacagcagaagctgcggggatatgctgcccaagaacgccgacgctaatggcgcttacaacattgctcgcaaaggcctgatgctgatcggccagatcaaggagactaaggacctggccaacttcaaatacgacatcagcaacaaagcctggctgaactttgcccagcagaaaccatataagaatgagtga

SEQ ID NO: 197 - DNA, 3825 bp, synthetic construct
  source 1..3825: mol_type = other DNA
atggacaagaagttcgaggatttcaagagactgtaccccctgagtaaaaccctgcggttcgaggctaaaccaattggctctaccctggataacatcattaaaagcggcctgctggacgaagatgagcacagggccgtgtcatacgtgaaggtgaagaagttgatcgacgagtaccacaaatcctttatagacagagtgctggatgagggctgcctgccatttgaaaacaacggggagaaagacagcctggaggagtactacgaatcatataaactgaaaagtaacgacgagaacgctaacaagacctttaaggaaatccagcagaacctgaggtctgtgatcgccaataagctgaccgacgataaagcatacgccaatctgtttggcaacaagctgatcgaatcttacaaggataaggaggataaaaagaagaccattgactctgacctgatccagttcatcaacacagccgaaccatctcagctggactctatgagccaggatgaggccaaagagctggtgaaagagttctggggattcacaacctacttcgtgggctttttcgacaataggaaaaatatgtacacatcagaggagaagagcaccgggatcgcctaccgcctggtgaatgagaacctgcccaagtttatcgacaatatggaagccttcaagaaagtgatcgcaaaaagcgaaatccaggccaacatcgaagagctgtactccaattttgccgagtacctgaacgttgaatctatccaggagatgtttcagctcgactactacaacatgctgctgactcagaagcagatcgacgtttacaacgccatcatcggcggcaaaacagacgagaagcacgacgtgaagatcaagggcataaacgagtacattaatctgtataaccagcagcacaaggatgagaagctgcctaaactgaaagccctgttcaagcagatcctgtcagatcggaatgctatttcatggctgcccgaggaattcaacgatgatcaggaggtgctgaacgctatcaaagactgttatgaacggctgagcgagaacgtgctcggcaacaaggtgctgaagagtctgctgtgttccctggccgattacaacctggacgatatttttattcggaacgacctgcagctgacagacatcagccagaaaatgtttggcaactggagcgtgatccaggacgccatcatccagaacatcaaaaacgtggcccccgcaagaaagaggaaagagagcgaagaggactacgagaagagaatttccggaatctttaagaaagccgacagcttctccattctgtacatcaacagctgtctgaatgagatggacgataactcactgcatgccgtggacggctactttgccactctcggagccgtgaacacacccaccatgcagcgcgagaatctgtttgctctgatccagaacgcttatacggacatttccgatcttctgaacaccaagtaccccgccaacaaaaatctggcccaggacaaaactaatgtggccaaggtgaaggccctgctggacgctatcaagtccctgcagcacttcgtgaagccactgctggggaagggcgacgaatccgataaagacgagagattctatggggagctggcctctttgtggaccgagctggacaccgtgacacctctgtacaacatgatcaggaattacatgacacggaaaccatatagcgagaagaaaattaagctgaacttcgagaaccctcagctgctgggcgggtgggacgccaataaggagaaggattatagcaccattattctgagacggaacggcatgtactacttggcaattatgaacaaggattcccggaggctgctcggaaaggccatgccaagcgatggggaatgttatgagaagatggtgtacaagctgcttcctggcgccaacaaaatgctgccaaaggtgttctttgctaagtccagaatcgacgacttcaagcccaatatccagatcgtggagaactataacaacggcactcacaaaaaacggaagaatttcaacatacaggattgccacgacctgatcgacttctttaagcagagcattaaaaagcacgaggactggtctaaattcagcttcaactttagcgatacttctacctacgaggacctgtccgggttttacagagaagtggaacagcaggggtacaagctctcctttatgaatgtcagcgtgtccttcatcgataaactcgtggacgagggcaagatgtacctgtttcagatttacaacaaggacttcagcgagtattccaagggcaccccaaacatgcacacactctactggaaggccctgttcgacgagcgcaacctggctgacgtggtttacaagctgaacggccaggccgaaatgttctatcggaagaaatccatagactacacccatccaacccaccccgcaaaccacccgatcctgaacaagaataaggacaacaagaagaaggagtccctgtttgagtacgatctgattaaagaccgcagatacaccgtggacaaattcctgttccacgtgccaatcaccatgaactttaagagcgtgggctcagaaaacatcaaccagcaggtcagagagtatctgcagcaggccgacgacacccacatcatcggcatcgataggggagaaagacacctgctgtacctggtggtgattgacatgcagggaaacatcaaggagcagtttacactgaatgagatcgtgaacgagtacaatgggaacacctatcgcaccaactatcacgacctgctggatattagagaggaggagcggctggccgctcgccagtcttggcagaccatcgagaacatcaaggagctgaaggaaggatacctgagccaggtgatccacaagatcacccagctgatggtgaagtaccacgctatcgtagtgctggaggacctgaacatgggcttcatgagggggagacagaaagtggagaagcaggtgtaccagaaatttgagaagatgctgatcgacaagctgaactatctggtggataagaaggccgatgctacacagcccggcggcatcctgaacgcctaccagctgactagcaagtttgactctttccagaagctggggaagcagtctggctttctgttttacatccccgcttggaatacctccaagattgacagcgtgactggctttgtgaacctgctggacaccaggtaccagaacaccgagaaggccaaagtgttcttctcaaaatttgacgccatccggtacaatgaggaaaaggattggttcgaattctacctggactacgacaagttcggttccaaggccgaagggaccagaaccaagtggaccctgtgcacccagggcaagagaatcaggacattcagaaacccagacaagaactctcagtgggacaaccaggaggtggacctgaccagagagatgaagagcctgtttgagcactaccacatcaacatctgcggcaatctgaaggaggagatctgcagccagaccgacaaagcctttttcacaggtctgctccatgtgctgaagctgaccctgcagatgcgcaatagcatcaccgggaccgagacagactacctggtgagccctgtcgccgatgaggagggcaacttttatgacagccgctactgcaacatcaccctgccaaagaatgccgacgccaacggtgcctacaatatcgctagaaagggcctgatgctcgtgaagcagatcaaagccgccacagacctggccaactttaagtacgatatctctaacaaggcctggctgaatttcgcccagcagaagccctataagaatgaatga

SEQ ID NO: 198 - DNA, 3756 bp, synthetic construct
  source 1..3756: mol_type = other DNA
atgaagaaatcctcactgcaggattttacaaatcagtacagcctgtcaaaaaccttgagattcgagctgattccccaaggagaaaccttggagcacattgagaaaaacggactgttaagccaggacgaacatcgagctgagtcttatattatcgtgaagaagatcatcgatgagtatcacaaggccttcataaccaaagccctggacggggtgaaactaaattcactggaggactacttcctatactaccagctgcctaaacgggacgaggagcaaaagaagaaattcgaggaaattcagaccaagttaaggaaacagatcgccgatcgattcgctaaacaggagagctttaaaaatctcttcgcaaaagagcttatcaaggatgacttgatcaactttgtcaagagtaacgacgacaagctcctggtcgcggaatttcaaaatttcactacctacttcacgggcttccacgaaaaccgaaaaaatatgtacagcgctgaagataaatcaactgccattgcttttaggttgatacaccagaacttgccaaagttcatagacaatatgagagcattcgacaagataaagatctctaaagtgaaagacagctttaagaccatactggcggacgatgaactgggcgcaattatccaggtgatagccgtagaagacgtgttcacccttaactactttaatgatacactcacacagttgggcatagataagtataatcagctcataggagggttcacaagcgaagacggtaagatcaagatcaaaggtctgaacgagtacatcaacctatacaaccaaactgcaaagaaagaggagagactgccgaaattgaagccgctctacaagcaaattctgtccgaccgctccactgcctccttcatccctgaggcgttttcgaatgataatgaagtgctggagtccatcgagaaactgtatcaggaaattaacgacttggttctcaataagcgggtaaagggtgaacacagccttaaagaattgctccagagtctaaacgaatacgacgtttccaaggtgtacttgagaaatgacctgtcactcactgatatctcacagaagatgtttggagactggggagtatttcagaaaggaatgcagacctggtacgccgtgaattataagggcaagaataaggccggcaccgaaaagtacgaggatgagcagaagaaatatttctcaaaccaggatagctacagtattggctttattaacgagtgcttactcctcttagataccgtgtatcagaagcggattgaggactattttaaattgctgggagagaggaatactgaagaggagaaatccgagaatctcttcgtcctaattgagaaaaactacaacggcattaaggatctgcttaacaatccatatccccacgacaaaaatcttgcccaagatcaggccaacgtggacaagattaagaactttttagacgtcgtgaaaacattgcagtggtttattaaacctcttctgggcaagggaaacgaggctgagaaagatgagcgattttacggtgagtttacttctctatggaccacactggaccaggtgacacccctctacaacaaagttcggaattacatgacccaaaaaccctactcaaccgagaagattaagctgaattttgagaattccacactccttgacgggtgggatgttaacaaggaggtggacaatactgcaatgatttttcgcaagaacggtctttattatctgggcatcatgaacaagaagcataacaagattttcaagaccgacatcgcaaatactgggggtgagtgctacgaaaagatggagtacaaactgttaccaggggccaacaaaatgctgcccaaagtttttttttcaaacagccgtatcgatgaattcaagccgggaacagaacttctcgagaattataagaacgagacgcataagaagggtgataattttaatctcaacgattgtcaccaccttattgatttcttcaagaccagtatcaacaagcacgaggactggaagcactttggcttccagttttctgatacaaaaacgtacaatgacttgtctggattctatagagaagtggaacaacagggctataagatcacatataaggcaatcagcgaaaactacattgctcaaatgatcgcagaggggaaactgtacttgttccagatctacaataaagatttcagtccttactccaaagggatgccaaatatgcataccctgtactggaaaatgcttttcgacgccgtcaatctgaagaacgttgtctataagctgaacgggcaggcagaagtgttctataggaaactgtctatcaaagccgaaaacattatcacacataaggcgaatgtgcctattcacaataaaaatgaggagaacgagaaaaagcaacaatcccgctttgattatgatataatcaaggacaagcggtacactatggacaaattccagttccatgtccctattactatgaatttcaaggctaaaggcttgaataacatcaacatcgaggtaaaccagtaccttaagaaagaatcggacattcatatcataggaatagaccggggggaaaggcatctgctatatttgacattaattgatggcaagggcaacatcaaacagcaatttagtctcaacgagatcattaatgagtatcagggaaagacctataagactaattaccacgatttactcgacaagaaagaaggcgaccgggatgatgctcgtagaaattggaagaccatcgagacaatcaaggagcttaaggagggatatctctcgcaagtcatccataaaatctctgaactcatggtagaacacaacgctatagtcgtgctggaagacctcaacatgggcttcatgagggggcgccaaaaagttgagaagcaggtgtaccagaagtttgaaaagatgctaatcgacaaactgaactacctggtcgataagaagaaaaaccccacagatctgggtggcactttaaatgcttatcagctgacgaacaagtttgagtctttccagaagatggggaaacagtctggcttcctcttttatgtccctgcttggaacaccagtaaaatggacccagtcaccgggttcgtaaacctgctggacacacgctacgaaaacattgaaaaggccaaaacgtttttctctaaattcgatagcatccattacaatccccttaagaagtatgtggagttcgagtgcgactacaatcgatttaccaccaaagccgaggggacacaaactaaatggacgctgtgtacgtataaggaaagaattgaaacctttcgtgacccaacccagaacagccagtggaagtccagggaaatagttcttacagatgaattcatcagcctgtttgagcagtacggtattgcttacaagaacaaggaagaactgaaagatgcaattgcgaggcagacagagaaggtgttctttgagcgcctgctgcacctgctgaaactgactctgcagatgcggaatagtatcacagggactgaaaccgattatctcataagcccagtggcaaatgccaaaggcgagttctatgactcccgcactgcttccgaaacgcttcccaagaatgccgacgccaatggagcatataacatcgccagaaaaggcctgtgggtggttgagcagattaaacaagccgatgatctgaaaaagctcaagctcgctatctctaataaggaatggctgggatttgtgcagaactatgggaaatga

SEQ ID NO: 199 - DNA, 3804 bp, synthetic construct
  source 1..3804: mol_type = other DNA
atgggctggagaaacggcttccagaagatcctgatcctgatcaacaacaagaagatgggcaatacaaatctgttcaagggatttacaaacttttaccccgtctccaaaaccctcagattcgaactgaagcccatcggcaaaaccctggagcacatcgaaaaaaacggcctcctgctgcaggatgagcaccgcgccgagtcctacgtgacagtgaagaagattattgacgaataccacaaagcctttattgccaaagccctggatggcctggtcctgaacgtgctggaggactatcacctgtattatcaactgcctaaacgggacgaggcccaaaataaaaaattcgaggagctgcagacagagatgagaaagcagatcgccgataggttcacaaagcaggacggcttcaagaacctgttcgccaaggagctgattaaggaggacctgaaggccttcgtccagacactcgaggacagacagctggtggaggagttcggcaactttaccacatacttcactgggtttcatgagaataggaaaaacatgtatagcgccgaggacaagagcaccgccatcgcctacaggctgattcaccagaacctgcccaaattcgtggacaacatgaaggctttcgataagatcagaaatagcgccgtgaaggagaaattcgccctgatcatctcagatgacgagttgggccccatcatccaggtgaaagacatcgaggaagtgttctgcctggattactttaacgagaccctgacccagaagggcattgacaagtacaatcagctgatcggaggatatatgccagaagacggcaaggagaagaaaaagggcctgaacgaatatatcaacctgttcaaccagaccgccaagaaggaggagcggatccctaagctgaagccactgtataaacagatcctgtctgaccggagcacagcctcctttattcctgaggagttcgagtgtgataacgaggtgctggagtcaatcgagaagctgtaccaggagattaacaaacacgcccttccccagctgaagggcctgatgaataacctgcacgattttgatctgcacaagatctatctgcgtaatgacctgtctctgacagacatcagccagaaaatgctgggcgactggggagccttccagaaggccatgaataagtggtttgacctgaattataagggcaaggcaaaacccggcaccgagaagtacgaggaggagcagaaaaagtactttaggaatcacgagtcatacagtatcgggttcatcaacgattgtctggccaagagcgacattgccgagcaccataagaaaatcgaagactactttaagcgggcaggagagcagattaatgagaccgagaatctctttaccctggtggagaaggggtactccaccgtgaacgacttactgaataacccatacccaaaggagaagaatttgagccaggaccagcagaatgtggataagattaaggcctttctggacggcatcaaggccctgcagtggtttattaagcctctgctgggcaaggggaatgaggccgagaaagacgagagattctacggggagttcgcaatgctgtggaccaccctggaccagatcacccctctgtacaataaggtgcgcaattacatgacccagaagccttactccaccgagaagatcaagctgaattttgagaattcctacttcctgaacggatgggcccaggactacgaatccaaggccggcctgatcttcatcaaagacggcaactactacctgggaattaataataagaagctgacaatcgaggagaaggaactgctgaagggcacggatgccaagcgcatcatcctggacttccagaagcccgacaacaagaacatccctagactgtttattaggagcaagggcgacaactttgcccctgccgtggaaaagtacaacctgcctattaaagatgtgatcgagatttacgactccggaaagttcaaaaccgactatcggaagaccaacgaggaggattataccaagagcctgcataagctgatcgattactttaaggaggggttcagcaagcatgagtcctacaagcattatccctttagctggaagagcacaaccgaatacaaggatatcgcagagttctacaacgatgtggaggtgagctgctatcaggtgtttgaggagggagtgaactgggggaagatcatggacttcgtggatcaggggaagctgtacctgtttcagatctataataaagacttttccccctatagcaagggaacccctaatatgcataccctgtactggaaaatgctgttcgacgccgagaatctgaaggacgtggtgtacaagctcaacggccaggccgaggtgttcttcaggaagtccagcatcaaggctgagaataaggtggtgcataaggccgagggcagcatccctaacaaaaacgagctgaatgccaagaagcagagcaccttcgactacgatatcattaaagacaggcgctacaccaccgacaagttccagttccatgtgcccatcaccatgaatttcaaggccagaggactgaataacattaataccgaggtgaatcagctgattaagaaggagaatgagatccacatcattgggatcgataggggcgagcgccacctgctgtacctgacactgatcgactcaaagggcagcattaagcagcagttttccctgaacgagatcatcaaccagtacaatggccagaattataagaccaattatcacaatctgctggacaaaaaggaaggcggcagagatgaggctcggcgcaactggaagaccatcgaaactatcaaggagctgaaagaaggatatctgtctcaggtgatccacaagatcgcagagctgatggtggagtacaatgccatcgtggtcctggaggacctgaacatgggatttatgagagggcgccagaaggtggagaagcaggtctatcagaaattcgaaaaaatgctgattgacaaactgaattacctggtggacaagaagaaaaaggccggggaattcggcgggacgctcaaggcctaccagctgacaaacaaattcgagtcctttcagaagatggggaagcagagcggcctgctgtattacgtgccagcctggaacacctccaagatggacccagttaccgggttcgttaatctgctggacacacgctatgaaaatatggagaaggccaagcagttttttggaaagtttgaagccatctcctacaagcagacaaagggctatttcgagttcgagtttgactacatgaagtataccaataaggccgagggaactaagaccaggtggaccctgtgtaccaacaacgagagaatcgagacttacaggaatccagaaaaaaatagccagtgggacagcagggaggtgggactgaccaaggagtttgtgtccctcttcgagcagttcggcatcaattttaaagataacgccgggctgaaggaggccatttgcaggcagactgagaaagcattttacgagaggctgctgcacctgctgaagctgactctgcaaatgagaaactctattaccggaaccgagatcgactacctgatcagccccgtggccaacgacaaaggtgaattctacgatagcagaaccgccgccgagattctgccacagaatgccgatgccaacggggcctataatatcgccagaaaaggcctgtgggttatcgaccagattaagcaggccgacgatctgaagaagctgaagctggccattagcaataaagagtggctcggcttcgtgcagaaggacgtgtga

SEQ ID NO: 200 - DNA, 3762 bp, synthetic construct
  source 1..3762: mol_type = other DNA
atgaagaacctgaccgagttcaccggcctctaccctgtgagcaagaccctgcgatttgagctgaagccccaaggccggaccctggagtacatcgaaaagaacggactgctggaacaagacgaacacagagccagcagctatatcctggtgaagaagatcatcgacgactaccacaaagcctttatcgctaacgccctccgcgattttaagctgtacagcctggaggattattacctgtattacaatatccagaagagagacgacgaacagaaaaagaaatttgaggatatccagtctaaactgcggaagcagatcgccgacagatttaccaaagaggagtcttttaagaacctgttcgccaaggaattgattaaggagaacctgatcgagttcgtgcagaccgtggaggaccgcgagctgatcaaggagtttgagagcttcactacctatttcaccggcttccacgagaatagaaagaacatgtactccgccgaggagaagagcaccgccatcgcctatcgcctgatccaccagaacctgcccaagttcatcgacaacatgagggtgttcgagaagatcgccaattcccctgtgaaggacaagttccagaccatcctgtccgacaaccaactgggcccagtcatccaggtgatggccgtggaggacatgttccgcctggattactttaacgagacactgactcagatcggcatcgacaaatacaattcactgtgcggcggcttttcaccaaatgagggcaaggaaaagatccaggggctgaatgagtatattaacctgtataaccagacagctaagaaggaagagagaatccccaagctgaagccactgtttaagcagattctgtctgatagatctaccgccagcttcatccctgacgagttcgagaacgactccgaggtgctggagagcatcgagctgttttatcaggaggtgaacgaacaggtgattaataagaacgtggaaggagagcactcactgaaggagctgctgaagagcctgcccgagtacgagctgaccaaaatttatctccgcaacgatctgtcaatcacagacattagtcagaagatctttggagactggggcgtgttccagaaggccatgaatacctggtttgagctgaattataacggcaaggccaagttcggaaccgagaagtacgaagaggagcagcggaagtattttgccaatctggatagcttctccataggcttcattaatgagtgcctgctgcagctggatacaccctaccacaagaacatcgccgactattttgccctcagagggaagaccgataccgaaacccaggacctgttcgccgtgctggaggacaagtacaacgccgtgaccgacctgctgaataacccctacccccaggaccaggatttagcccaggaccaaaagcaggtggataagctgaaagagctgctggatgccgtgaaggctatccagtggttcattaaaccccttctgggaaagggcaacgaggccgacaaagatgagagattctacggagagttcaccagcctgtggatcacactggatcagattacacctttgtacaacaaggtgagaaactacatgaccagaaaaccctacagcaccgataagattaagctgaattttgagaactcctattttctgaatggctgggctcaggactacgagtccaaggccgggctgatcttcaccaaagacggcaactattatctcggcatcaatgacaagaagctgagcaacgaggataagacactgctgaagagcaactctgagctgaacctggcaaagaggatcgtgctggatttccagaaacctgataataagaacatcccccggctgttcatccggagtaagggaaacaactttgcccctgccgtggagaagtacaacctgcccattcatgaggtcattgagatttacgataacggcaagtttaaaacagagtaccgcaagattaatgaaacagactacctgaagtctctgcacctgctgatcgactactttaagattggcttctctaagcacgagagctacaagcattaccccttctcctggaagaacaccaccgagtacaaggacatcgccgagttttaccacgacgtggaggtgagttgctaccaggtgttcgaggagaacgtgaattgggacaccctgatgaatttcgtggatgaggggaagctgtatctgttccagctgtacaacaaggacttctctcccaacagcaagggaaccccaaacctgcacacactgtattggaagatgctgttcgatgctgacaacctgaaagacgtcgtgtacaagctgaacgggcaggccgaagtgttttttagaaagtcctccatcaagcccgagaatatcgtgctgcataaggccaacgaggccgtcaacaacaagaacgagcagaacacaaagaagcagtctagatttgagtatgatatcatcaaggataagagatacaccgtggacaagttccagttccacgtccctatcaccatgaactttaaggccagagggctcaacaacattaacaccgaggtgaaccagtggctgcagaagagcgataacgtgcacatcatcggcattgacaggggtgagaggcacctgctgtacctgaccctgatcgacagcaaggggaacattaaacagcagttcagcctgaacgagatcgtgaatgagtatgagggcaagacctacaagaccgactaccacaaactgctggacaacagggaagggaaccgcgacgaggcccggaagaactggaaaaccatcgaaaccatcaaggaactgaaggagggctacctgagccaggtgatccacaagatttctgagctgatggtggagtacaacgccattgtggtgctggaagatctgaacatgggcttcatgaggggacggcagaaagtggagaagcaggtgtaccagaagttcgagaagatgctgatcgacaagctgaactacctggtggacaagaagcagaacccagctgagatggggggaaccctgcatgcctatcagtttaccaacaagtttgaatcctttcagaagatgggcaagcagtctgggatgctgttctacgttcccgcttggaatacttccaagatggaccccgtgaccggcttcgtgaatctgttcgacaccaggtacgaaaacatggaaaaggccagatccttcatcggcaagtttgacacaattcgctacaatcccaagaaggagtactttgaatttgacttcgactataacaaattcaccgccaaagccgagggtaccagaactagatggaccctgtgtacaaacgataccaggatcgaaaccttcaggaaccccgccaaaaattcccagtgggataaccgggagatcattctgtctgacgaattcatcaacctgtttaaactctacaacatcgactaccagaattccgacctgaaggtccagatctgtaagcagaccgaaaaagccttttttgagaggctgctgcacctgctgaagctgaccctgcagatgaggaatagtatgactggcacagaggtggactaccttatctcacccgtgaccaattccaggggcgagttctacgacagtaggactgcaagcgacatcctgcccaagaatgccgatgccaatggcgcctacaatattgcccgcaaggggatgtgggtcatcgaacagatcaggaaggccacagacttccggaagctgaagctggctatcagcaacaaagagtggctgagttttgtgcagcactga

SEQ ID NO: 201 - DNA, 3777 bp, synthetic construct
  source 1..3777: mol_type = other DNA
atgaagaggtttaccaatttgtatcagctgtcaaagaccctcagattcgagctcaagccaataggcaagactctggagaatatcgaaaagcacggactcctcgagcaggatacacatagggccgagtcctacgtgaaggtaaaagacattattgacgagtatcacaaggcctttatcgaagagtatctcaacactttcgcggattcctcagagacttacgcagagcaaaacaagaacttcgtcaaactgctccaagaactgtacaccaattacatgtgtaagacgaaggatgaaactcagcagaagctactgactgagagtcaggcaaagctacgtaagatcatagccaaaagttttaacaacgacaaatacaaacggctgttcggtaaggaattaatcaaggaagagttgatcgactttctcaaggatgacgtcgaggacattacactggtgcaggagttcaaggattttactacatatttcaccggctttcacgaaaatcgcaagaacatgtattctgatgaagacaaatctaccgccatagcctaccgactgatacacgagaatctgcctaggtttatagataacatcctggtgttcgaaaagattgcccaaagcgatgtggcccagaaatttacagagctgtataagaacttccagtcatacctcaatgttaaagagatctccgagatgttcaaattaggatactataacatggtgctgacacagacacagatcgacgtgtacaatgctataattggaggcaagaccatcgaggataatgacattaaaatcaaagggctcaatgaatacatcaacctgtacaaccagcaacaggaggataagcataacaggttacccaagctcaaaccgctctataaacagattttatctgaccgcaacgccattagctggcttcctgagcagttcgatgctaatgagaaaggcggcaaagttctggaggctattcagaaggcttacaatgagctggagcaacagattctgaacaattcaaatgaggcggagcattcactgcctgaactgctgaaacttctgagtaactacgacctaaacaagatctacatacccaacgacgcccaattgaccgatattagccaaaaggtgtacggacactggaacataatttcgaaggcactgatcgaagatctgaagctgaccacaccacggaaatctcgcaaggagacagatgaaaagtacgaagagagactcaacaaaatcctgaagagtcaatcatctttcagcatccgcaagataactgactccgtgcacaacacataccccgagatcaaatctagcattataacgtacttcgagaatatcggcaatatcgacaacgaagaggaaaacattattagcaagatcactaacagctataacatcgccaaagacttactgaacaccccctacctcgggaataacctcagtcaagacacggtaaatgtcgagaagattaaaaacctcctggacgcgattaaggacttgcagcattttattaagcccctgctaggaaaaggcgatgagtctgagaaagatgaaaagttttatggggagttcactttattgtgggacgaactgaacaatattacccctctgtataacatggtgaggaattatatgactagaaagccatactccactgaaaagatcaaactgaacttcgaaaacagcacacttctggacggatgggatttgaataaagagacagacaatacgtccgtcattctgcggaaagatggaatgtactatctggctataatgaacaagaagcacaatagggtgtttaatatcgattcgatacccaccgaaggggactgctttgaaaagatggaatataagttgttgcctggcgctaataagatgttgccaaaggtatttttctctaagtcacgcatcgacgagtttgcgccatctaagcagttgatagaaaaataccagtctggtactcataagaagggtgataacttttctctgatcgactgccataatctcatcaacttcttcaaagactccatcaataaacatgaggactggaaaaagttcaacttcaatttcagtgacacgaacacttatgaggacctgtctaatttctatagggaagtggaaaaacagggctataaaatcagcttccggaatgtatcttcagagtacataaactcactggttgaagacgggaaaatctaccttttccagatctacaacaaggatttttccagctatagcaagggaacacctaatatgcacacactgtactggaagatgctgtttgacgaaactaatatgagtgacgtctgctataaactgaacgggcaggcagaaatctttttccggaaatcctcgattaaggcagaacatccgacccaccccgctaatcagccgatcgagaacaaaaataccctcagcaataagaaacaatcagtgttcacctatgacctgattaaggacaaacggtatactatcgacaaattccattttcacgtccccatcacaatgaactttaaaggcatcggcattaacaacattaacaacatcgtgaatcagtttatccaggaacaagaagatcttcacataattggaattgacagaggagaaaggcacttgctatatctaaccgtcatcgacttacaggggaatatcaaggagcagtacagtcttaatgagatcatcaacaactataacggcaatacctataagaccaactaccacgatcttctcgaaaaaagagaaaaagaacgaatggatgctcgtcagagttggaagagtattgagagcatcaaggagctgaaggaaggttacctcagccaggttattcataagatcactaagctcatgatcaaatacaacgctatcgtggtgcttgaggacttaaatattggcttcatgcgggggcgacaaaaagttgaggcttccgtttatcagaagttcgagaaaatgctcattgataagctgaactatctggtggataaaaaaaagcagcctgaggaacttgggggcacattgaatgctttacagcttaccaacaaattcgaatcctttcaaaagctgggcaagcagtctggatttctattttatacccaggcctggaatacctctaaaatagatcctgtcacggggtttgttaacctgttcgacacacgctacgaaacacgcgaaaaagcaaaggagttctttaagaagtttgattccatctgttacaacagcgagaaagattggtttgagttctcctttgactataacaatttcacgactaaggctgagggtactagaaccaactggacattatgtacgtacggtaaacgaattgagacatttagagacgagaaacagaatagtcagtgggcctcaaatgagattaaccttaccgataagttcaaggagtttttcgcgaagtacaacattgatatcaacgcaaacctcaaggaaagcattacagcccaagaatccgcagattttttcaaagggattctcgcactcttgaaactaaccctgcaaatgcgtaattcaatgaccggtaccgatgtagattatcttcagtcgccagtggccgacaacaatggcgtgttcttcaattcccaggagtgcgacaatagcctgccacagaatgccgacgcaaatggggcctacaatattgccagaaaaggactttggattgtcaacaaaatcaagatcagcaatgatctgtccaacttgaatttcgccatatccaataaagagtggcttcagtttgcacaggagaagccctaccttttgaatgattga

SEQ ID NO: 202 - DNA, 3753 bp, synthetic construct
  source 1..3753: mol_type = other DNA
atggcaagtctgaaaaaattcacaagattgtaccccctgtccaagaccctgagattcgagctgattccactgggcctgaccgccgaccatatcggcaagagtggcatcctgagccaggacgaacacagggccgaatcttataagaaggtgaagaaaattatcgatgagtaccacaaggccttcatcgagaaggtgctgaacaacatccacctgcagtatgacaacatcgaacagaacaatagcctggaggagtatttcctgtactacatgatcaaaaacaaagacgagaagaaggagaagatctttgaggagatccagaagaagctgcggaagcagatcgccgatagatttatcgacgatccatctttcaagaatattgataagaaagaactgattcgctccgacctgaaggatttcgtgtgtagccaggaggatctgcagctggtggacgagttcaaggatttcaccacctatttcacaggcttccatgaaaatagaaagaacatgtactcctctgaggcccagagcaccgccatcgccttcagactgatccatgagaacctgcctaagtttatcgataacatccaggtgttcaacaaggtggccgcctcatccgtgtcagagtttttcactgagctgtacgccaacttcgaagagtgcctcacagtgaccgagatcgccgagatgttcaagctggagtactttaacagcgtgctgacacagaagcagatcgacgtgtacaatttcattctgggtggaaagtccatcgaggggggctctaagattaaggggctgaacgagtacatcaacctgtacaaccagcagcagaaggacaagtccaagcggctgccaaagttcaagcctctgtttaaagagattctgagcgaccgaaatagcatttcttggctgccagaaaagtttaaaagcgacgaggaagtgctggagacaatcgagaaggcttatcaggaactcaatgagcacgtgttgaacagaaacgtgggcggggagcactctctgaaggagctgctggtgcggctggaggacttcaacctcgacaagatctacgtgagaaacgaccaacagctgaccgacatcagtcagaaaatcttcggccactgggggactatatccaaagccctgctggaagagctgaagaacgaggtgcccaagaaaagcaacaaggagacagacgaggcctacgaggaacggctgaacaagatcctcaaatcccagggaagtgtgtctatcgccctgattaacaactccatccagaagctgaatatcgaagagaaaaagaccgtgaacagttacttcagcctgaacagcaatatttgccccaaggacaatctgtatacaaggattgagaacgcctacctggaggtgaaagacctgctgaataccccttatactggcaaaaatctggcccaggacaaactgaacgtcgaaaaaatcaagaatctgctggacgccatcaagtcactgcagcatttcgtgaagcccctgctcggcgacggaaaggaacccgagaaagacgagaaattctatggcgagttcttgtctctgtgggaggaactggacaagatcactccactgtacaatatggtgaggaattacatgacacagaagccctactctaccgagaagatcaagatcaactttgaaaacagtaccctgatggatggatgggatgtgaacaaggagcgggacaacaccagcgtgattctgcgaaaagacggcctgtattacctggccatcatgaacaagaagaacaaccaggtatttgatgcccacaatactcccagtaatggcatctgctacgaaaaaatggagtacaaacttctgcccggagctaacaagatgctgcctaaagtgttcttctccaaatcccggatccatgagtttgccccctccaagaagctgatcgagaattacaagaacgagacccacaagaaaggcaccactttcaatctggacgactgtcacaagctgatcgactttttcaagaccagcatcaagaagcatgaggattggaacagatttgagtttaagttttctgatactaccacctacgaggatctgagcgggttttacaaagaagtggagcagcagggctacaaaatctctttccgcaatgtgagcgccgattacattgataatctcgtgaaggagggcaagatctacctgttccagatttacaacaaggacttctccccatattccaagggcaccccaaatctgcacaccctgtactggaaaatgattttcgacgagcggaatctggccaatgtggtgtacaagctgaacggccaggccgaggtgttttttcggaagagctccatctcatacgacaagcctacccaccccgccaaccaggagattgataacaagaacatcctgaataagaaaaagcagtccatattctcctacgatctgattaaggacaagagatatactgtggacaagttccagtttcatgtgcctatcaccatgaatttcaagtccaccgggcaggataatatcaatctgagcgtcaacgagtacatccggcagagcgatgacctgcacatcatcggcattgacagaggcgagcgccacctgctgtatctgaccgtgatcgacctggagggcagaattaaggagcagtattccctgaacgagattgtgaacatctataacggcaatgagtaccataccaattaccatgacctgctgtcaaaacgcgaggacgagcgggagaaggcccgccagtcatggcagaccatcgagaatattaaggacctgaaggagggctacctgagccaggtgattcataaaatttccgagctgatgattaaatataacgccatcgtggtgctggaggacctgaacatcgggtttatgaggggtcgccagaaggtggaagcctccgtgtaccagaagtttgagaagatgctgatcgacaaactgaactacctggccaacaagaagattgatcctgaggaggagggcggaattctgaacgcctaccagctgaccaacaagttcaccagctttcagaagatcggcaaacagtcaggcttccttttttacactcaggcctggaacacctctaagatcgaccccagcacaggcttcgtgaatctgtttgataccagatacgagacccgcgagaagagcaagatgttcttcagtaagtttgactcaatcaaatataacaaagataaggattggtttgaatttatcttcgactataccaactttaccaccaaggccgaaggcacacgcacccagtggacaatctgctcctacggcaagcggattgagacactgagggatgagaacaaaaactctaactgggtgagtaccgagatcgacctgacccaatcctttaagaacttctttaccaagtacggcatcgacatcaacgacaacctgaaagagttcattgtgcagcaggatacttccgagttcttcaagggcatcctgtacctgttcaagctgactctgcagatgagaaacagcgccatcggcaaggacatcgattatattatcagccccatcgccgacgagaaaggcatcttttataattccaatgagtgcgactccagcctgcctaagaacgccgatgccaatggggcctataacattgcccggaagggcctgtacattgtgcgaaagataaagcactctgatgaactcaaaaatctgaatcttgccataactaacaaggagtggcttcagttcgcccagagcaagccttacatcaataagtga

SEQ ID NO: 203 - DNA, 3864 bp, synthetic construct
  source 1..3864: mol_type = other DNA
atgaagaaactgaatgccttctctcggatctatcccctgtccaaaaccctgcggtttgaactgcgccctatcggcaagacactggagcacatcgagaaatcaggaatcctgagccaggaccaacaccgcgccgagtcttatgtggaggtgaagaagatcatcgatgaatatcacaaagccttcattgagaatgtgctgaaggacttccgctttagcgaaaacagaggcgagaagaactccctggaggagttcctggtgtactatatgtgtaagtccaaggacgaaacccagaagcggcagttcgccgatatccaggacaaacttagaaaacagattgctaagaggttctccgacgacgataggtttaaacggatcgataagaaggagctgatcaaggaagacctgctgagcttcgtggaggacgtggaaaagcggcagctgattgaggagttcaaggactttaccacttattttaccggatttcatgaaaatagaaagaacatgtacactgatgaggcccagagcaccgccatcgcctacaggctgatccacgagaatctgccaaaattcatcgacaatatcatggtgtttgataaggtggccgcctctcccatcgccaagtacttcgccgagctgtactccgatttcgaggagtacctgaacgtgtccgaactgggagagatgttccggctggattactacaacattgtgctgacacagactcagatcgacgtgtataacgctgtggtgggcggccggaccctcgatgacggcaccaagatccagggactgaatgaatacataaacctgtataatcagcagcagaaagataagtccgcccggctgcccaagctgaagcctctgtacaagcagatcctgtccgacagaaacgctattagttggctgcctgagcagttccagagcgatgagaaggtgctggaagccattctgaaggcttatcaggagctggacgagcaggtgctgaataggaagaaggagggcgagcactccctgaaggagctgctcctgagcctgtccaattacgacctgaccaagatttacatcagaaatgacacacagatgacagatatttcccagaaagcctttggccattgggacgtgatccctaaagccctgctggaacagcttaagaaggaggtgcagaagaagtctaaagagtccgaagaggcttatgaggagcgcctgaacaaaattatcaagtcccagggctccattcccatagccctgattaaccagggagtgcagaagcagaactccgaagaacagaacaccctgcagacttacttcgccagtctgggagccgtggagaccgagtccgtgaagaaggagaatctgtttacccagattgaaaatgcttacgccgaggtgaaagatctgttgaataccccttatagtggcaagaatctggcacaagataacgtggccgtggagaaaatcaaaaccctgctcgacgccatcaaagccctgcagcacttcgtgaagcctctgctgggcgacggaaccgagagcgagaaggatgagaagttttacggcgaattctccatgctttgggaagagctggacaagatcacccccctgtataatatggtgagaaactacatgacccggaagccttacagcacagagaaaatcaagctgaattttgagaactccactctgatgaacgggtgggacctgaacaaggagcaggataacaccaccgtgatcctgagaaaagacgggatctattacctggctatcatggataagaagcacaagaaagtgttcgacgagaaaaacatcctgggatccggggaatgtttcgaaaaaatggagtacaagtttttcaaagatctcaccaccatggtgcccaagtgcacaacccagctgaaggtggtgaaagaacacttcctgacccacagcgagccctacaccatctccaaggacgtgttttacagcaaattcgagatcactaaagaggagtacgagctgaacaatgtgctgtataatggcaaaaagaaattccagaaagattacctgagacagaccggcgatgagaagggttataaggatgccctgaccaagtggatccggttctgcctgagatttctggctcagtacaagagcaccatgatttatgacatttcctcttttcaggtggactgcaaaattaactcatatacatccatcgatgaattttacagcgagatcaacctgtatctgtacaacatcacattccggaacgtgtcggtggattatattaactctctggtggaggagggcaagatctacctgttccagatttacaacaaggacttcagcccctacagcaagggcactcccaacctgcacaccctgtattggaagatgctgttcgatgaaaagaatctggctgatgtggtgtacaaactgaatggccaggctgaagtgttctatagaaaatcatcaatcatctgtgagaggccaacccaccctgccaaccaggccatcaataataaaaacgtcctgaacaagaaaaagcactccacattcgtgtacgatctcgtcaaagataagcggtacactgtggacaagttccagttccacgtgcccatcacaatgaactttaagtccactggcggcgataacatcaatctcctggtgaacgagtatatccagcagagcgacgatctgcacatcatcggcatcgatagaggcgagcgccacctgctgtacctgaccgtgattgacctgcaggggcggattaaagagcagtattccctgaacgagatcgtgaacacttacaatggcaatgagtaccgcactaactatcacgacctgctgagcaagcgcgaagacgagcgcatgaaagcccggcagtcatggcagactattgagaacatcaaggagctgaaagaaggctatctcagccaggtgatccacaagatctctgagctgattgtgaagtacaatgccatcgtggtgctggaggacctgaacatgggcttcatgagaggcaggcagaaggtggaaagctctgtgtaccagaagttcgaaaagatgctgatcgacaagctgaactacctggtggataagaagaaaaaccctgaagaggatggcggagtgctcaacgcctatcagctgactaacaagtttgagtcattccagaaagtggggaaacagagcgggtttctgttctacactcaggcttggaatacatctaagatcgaccccgtgaccggcttcgtgaacctgttcgacactagatacgagaccagagagaaagcgaaggacttctttggcaagttcgacgccatccgctacaacaccgccaaagattggttcgagttcgccttcgactacagcaatttcactagtaaggccgaggggtctcggactaactggaccctgtgtacctacggcgaaaggatcgagaagtttagagatgagaaacagaactccaactgggcctccaggggcatcaatctgaccgacaagttcaaagagctgtttgccgagtataagatcgacattcaaaccgacctgaaggaggtgatcagccgccaggatagcgccgatttcttcaagcgcctcctgtatctgctcaagctgaccctgcagatgagaaactccgagaccggcaccgaggtcgactacatgcagagccctgtggccgacgcaaatggcaatttttataacagcgagacctgcgacgactccctgcctaagaacgccgatgccaacggcgcctataacatcgcccggaagggcctgtggattgtgcagcagattaaggccaccgacgacctgaagaacgtgaagctgagcatctccaataaggaatggctgaagttcgcccaggagaaaccctacctgaacgagtaa

SEQ ID NO: 204 - DNA, 3768 bp, synthetic construct
  source 1..3768: mol_type = other DNA
atgaagaagctgaacgccttctcgagaatctaccccctgagcaagaccctgcgctttgagctgagacccattggcaagacactggagcatatcgagaagtccggtatcttgtcacaggatcagcaccgggccgagtcctatgtggaggtgaagaagattatcgacgagtaccacaaggccttcatcgaaaacgtgctgaaggacttcagatttagcgagaatcggggcgagaagaattccctggaagaattcctggtgtactacatgtgcaagtctaaagatgagatgcagaagaggcagttcgccgacattcaggataaattgcgcaagcagatcacccagcgattcagcgacgacgaccggtttaagagaatcgacaagaaggagctgatcaaggaagacctgctgtcctttgtggaggatgtggagaagagacagctgattgaggagtttaaggacttcaccacctactttaccggcttccacgagaacagaaagaacatgtataccgacgaggcccagagcactgcaatcgcctatcggctgatccacgagaacctgcccaagttcattgacaacatcatggtgttcgacaaggtggccgccagccccattgccgagcattttgccaagctgtattccgacttcgaggagtatctgaacgtgagcgagctgggggagatgttcaggctggattattataatatcgttctgacacagacccagatcgacgtgtacaatgccattgtgggcgggaagaccctggaggacgggaagaaaattcagggactgaatgagtacatcaacctgtacaaccagcagcagaaggacaaatccgccagactgcctaagctcaagcctctgtataagcagatcctgtctgataggaatgctatctcctggctgcccgagcagtttcagtctgacgagaaggtgctggaggccatccagaaggcctaccaagatctggaggagcaggtctttaaccgcaaaaaggagggagagcactcactgaaagacctcctgctgagcttgtccgactatgatctgtctaaaatttacatcaggaatgacactcagatgaccgacatctcccagaaggccttcggacactgggacgtgatccacaaggccctgctggagcagctcaaggaagacgtgcagaagaagcccaagaaagagagcgatgaggcctacgaggagaggctgaacaagattataaagagtcagggcagcatccccattgccctgatcaatcagggggtgcagaagcagaacagcgaggagcagaacaccctgcagacctacttcgccagtctgggcgccgtggagactgaatccgtgaaaaaagagaatctgtttacacagatcgagaacgcctacgccgaggtgaaggacctgctgaatactccctactccggcaagaatctggcccaggacaacgtggccatcgagaagattaaaacactgctggacacaatcaaggccctgcagcacttcgtgaaacccctgctgggggacggcacagagtctgaaaaggatgagaaattttatggcgaatttagtatgctgtgggaggagctggacaagattacccctctgtataacatggtgcggaactatatgaccagaaagccctactccaccgagaaaatcaagctgaacttcgaaaacagcactctgatgaacgggtgggacctgaacaaggagcaggataacaccaccgtgatcctgaggaaagatgggatgtattaccttgctatcatgaacaagaagcacaacagagtgtttgacgtgaagaacatcagcaaaaacggcgagtgttttgaaaaaatggagtacaagctgctgcccggagccaacaagatgctgcccaaggtgttcttttcaaagagcaggatcgacgagttcgccccctccgaacagctgctggaaaattacaacaagggaacccacaaaaagggcaatctgtttaacctgtctgattgccatgccctgatcgatttttttaaggcctctatcaataagcacaaagactggagcaagttcggcttcaaattctctgacactaacacatacgaggacctgtctggattctaccgagaggtggagcagcagggatataatatctcctttcggaatgtcagcgtggactatattaatagcctggtggaagagggaaagatctatctgtttcagatttataacaaggacttctcaccatacagcaagggcaccccaaacctgcacacactttactggaagatgctgtttgacgaaaaaaatctggccgatgttgtgtacaagctgaatggccaggccgaagttttctttagaaaatcctctatcatttgcgacaagcctacacacccagcaaaccagcccatcgacaacaagaacgctctgaataacaagcagcagtctgtgttcgagtacgatctggtcaaagacaagaggtataccgtggacaagtttcagttccatgtgcccatcaccatgaattttaagagcaccggcggggataacatcaatctgctggtgaacgagtatatcagacagagcgacgatctgcacatcatcggaatcgacagaggtgagagacacctgctgtacctgacggtgattgatctgcagggccggattaaggacaaggagcagtacagcctgaataagatcgtgaacacctacaacggcgacgagtacccaacaaattatcacgatctgctgagcaagcgcgaggatgagagaatgaaggccaggcagagctggcagacaatcgagaatatcaaggaactgaaggaggggtatctgagccaggtgattcacaaaatcagtgaactgattgtgaaatataatgccatcgttgtgctggaagatctgaacatgggattcatgaggggtcggcagaaggtggagagctccgtgtaccagaagtttgagaagatgctgatcgacaagctgaactatctggtcgataagaaaaagaaccctgaggaggatgggggagtgctgaacgcttaccagctgacaaacaagttcgatagctttcagaaactgggcaagcagtctggcttcctgttttacactcaggcctggaacaccagcaagattgaccctgtgacagggtttgtgaacctgttcgatacaagatatgaaacaagagaaaaagccaaggacttctttggcaagtttgacgccattcggtacaacaccgctaaggactggttcgagttcgcgttcgactacagcaactttactagcaaagcagaaggctctagaacaaactggacactgtgcacctatggagaacggatcgagaagttccgggacgagaagcagaacagcaattgggccagccagggcattaacctgaccgataaattcaaggagctgtttgccaagtacaaaattgatattcaggccgatctgaaagaagctatcagtcagcaggactccgccgacttcttcaaaggcctgctgtacctgctgaagctgacactgcagatgagaaattctgagatcggcacagagattgactacatgcagtcacccgtggcagatgcaaatggcaacttctataactctgatacatgcgatgacagcctgcctaaaaacgctgacgcaaatggcgcctacaacatcgcccggaagggcctgtggatcgttcagcagattaaggccgccgatgatctgaaaaatgtgaaactgagcatctccaataaagaatggctgaagttcgcccaggaaaagccttatctgaatgagtga

SEQ ID NO: 205 - DNA, 3774 bp, synthetic construct
  source 1..3774: mol_type = other DNA
atgtttatcatgacttcacttaaacggttcacaagagtctaccccctgagtaagaccctgagatttgaactgaagcctgtggggaagaccctggaccacatcgtgtcttctggactgctggagcaggaccagcaccgcgcaggcagctatgtggaggtgaaaaagattatcgatgagtaccacaaagccttcattgagtccagcctggacgattttgagctgcagtattacaatgaggggaagaataacagtctggaagagttctacagctattacatgtgtcggtctaaggatgaaacacagaaaaagttgttcgaggagaatcaggacaagctcagaaagcagatcgccgatagactgagcaaggacgagagattcaagcgcatcgacaaaaaggagctgatcgaaaaggatctcatcgacttcgtcaagaaaccagaagagagacagctgctggaagagttcaagggatttaccacctattttaccggctttcacgagaatcgcaagaatatgtacagtgccgaggcccagtccactgccatcgcctatagactgattcacgagaacctgcccaagttcatcgacaatatcatggtgtttgacaaggtggccgcctcccctgtggccgactccttcgccgagctgtatgccaatttcgaagagtacctgaatgtgacagaaatcgccgaaatgtttaacctcgcctattataacgtggtgctgacccagtcccagatcgacgtgtacaacgccatcatcggcggcaagaccttcgagaacggcgtgaaaattaagggcctgaatgaatacatcaatctgtactcccagcagcagaaggacaaaagcgcccgcctgcctaaactgaagcccctgtacaaacagattcttagcgacagaaacgccatcagctggctgccagaatacttttcagaggacgaaaagctgctggaggctatccagaagtcttaccaggagctggatgagcaggtgttcaaccggaagagggagggcgagcacagcctgaaggagctgctgctgggccttgaggggttcgacctgtccaagatttatatccggaacgatttgcagctgacagacatttctcagaaagtgtacggtagctggtcagtgatccagaaagcactgctggaagaactgaagggcgaggtgcagaagaagagcaaaaaggagaccgacgaagcctacgaagatagactgaataagatcctgaagtctcagggatcaatctccatcgccctgattaacgattgtgtgcacaagctgaattccgaggagcagaacacaatccaggggtacttcgccaccctgggcgccgtggacaaccagatcctgcagaaagagaacctgtttgtgcagatcgagaacgcctacactgagattaaggacctgctgaacaccccataccagggcagaaacctggcccaggacaaggtgaatgtggagaagatcaagaacctgctcgattccatcaagagcctgcagcactttgtgaaaccactgctgggcgacgggagcgaagccgagaaggacgagaagttctatggggagtttgtcgccctgtgggacgagctggacaaaatcacccctctgtacaacatggtgagaaattacatgaccaggaagccctactccacagagaagatcaagctgaatttcgaaaattctaccctgatggatggctgggacctgaataaggagcaggccaacaccaccgtgatcctgagaaaggatgggctctattacctggccatcatgaacaagaagaacaacaaagtgttcgacgtgaagaacattagctctaagggcgagtgctatgagaagatggagtataaactgctgcccggcgctaacaagatgctgcccaaagtgttcttctccaagagcaggatccacgaattcgccccctctgagcagctgctggaaaactataacaacgagacccacaagaagggcgctaccttcaacctgtccgactgccacgccctgatcgatttctttaaagcctccatcaataagcacgaggattggtccaaattcggattcaatttttccgacacctcctcctacgaagatctgagcggattttatcgggaggtggagcagcaggggtacaagatctcctttaggaatgtgagcgtggactatgtggattcactcgtggaagagggcaagatttatctgttccagatctacaacaaggatttcagtctgtatagtaagggcacacccaacctgcataccctgtactggaaaatgctgttcgatgagaagaacctggccgacgtggtgtacaagctcaacggacaggctgaagtgttttttaggaaatccagtattaactacgagagacccacccaccccgccaaccagccaattgacaacaagaatccccagaatgagaaaaaacagagcgtgtttaactacgatctgatcaaggacaagagatacacagtcgacaagtttcagttccacgtgcccatcacaatgaattttaagtccaccggctccgagaacattaatcagagcgtgaatgagcacatccagaagagcgatgacctgcacatcatcggcatagaccgcggtgaacgccacctgctgtacatcaccgtgatcgacctcaagggaaggataaaggagcagtttagcctgaacgagattgtgaaccactacaacggcaagaaccactgcaccgactaccacgccctgctgtccaaaagggaggaggagagaatgaaggctcggcagtcctggcagaccatcgagtctatcaaggagctgaaagaaggctatctgagccaggtggtgcacaagattagcgagctgatggtgaagtataacgccatcgtggttctggaggatctgaacatggggttcatgcggggcaggcagaaagtggaagctagcgtgtaccagaaattcgaaaaaatgctgatcgataagctgaactacctggccgacaaaaagaaagggccagaggaggagggcggcattctgaacgcctaccagctcaccaataagttcgtgtccttccagaagatgggaaaacagtccggcttcctcttttacgttccagcttggaacaccagcaagattgaccccgtgactggattcgtcaacctgtttgatactcgctacgagacccgcgagaaggctaaggctttcttcgccaagttcgagtccatcaggtacaacgaggataaggattggtttgaatttgcattcgactactctaagtttacatccaaggccgatggcagctgcacaaaatggaccgtgtgtacctatggcaagcgaattgagacattcagagacgagaagcagaactctaactgggtgagtaaggaggtgtgtctgactgagaaattcaaggattttttcgccaagtacggcatcgagctgagatctaatctgaaggagtacattatctcccaggatagcgctgattttttcaaaggactgctgtccctgctgaagctgaccctgcagatgagaaactccgaaaccgggacagatgtggattatctgcagagccccgtcgccgacgccaacggggagttctacaacagcgagaactgcgacgaatctctgcccgagaacgccgacgcaaacggagcctataatatcgctcgaaaggggctgtgggttgtgaaacagataaaaggggccgacgacctgaagaatctgaagctcgccatttccaacaaggagtggctgcagtttgtgcaggccaaaccctatcttaacgactga

SEQ ID NO: 206 - DNA, 3789 bp, synthetic construct
  source 1..3789: mol_type = other DNA
atgaagactttccagcagttttcacgcgtgtacccactgtcaaagaccctgagattcgaactgaagccaatcggcagtacactggaacacattaacaagaacggcctgctcgaccaggaccagcaccgcgccaagagctacattcagatgaagaacattatcgacgagtaccacaaggagttcatcgaggacgtgctggacgacctggaactgcagtacgacaacgagggaaggaataatagcatctccgaattctacacctgctacatgatcaagtctaaggacgacaaccagaggaagttatacgagaagatccaggaggagcttcggaagcagattgccaacgcctttaacaagtccgacatttataagaggatcttctcagagaagctgattaaggaggatctgaagaactttatcacaaatcagaaagataacgataagagagagcaggatatccagatcatcgaggagtttaagaatttcaccacctatttcaccggattccatgaaaataggaaaaacatgtacaccagcgaggctcagagcacggccatcgcctataggctgatccacgagaacctgcccaaattcatcgataatattatggtgttcgataaggtggccgcctctcctatcgctgacagcttcagcgagctgtacaccaattttgaggagtgcctgaacgtgatgagcatcgaggagatgttcaagctgaattattttaatgtggtgctgacacagaagcagatcgacgtttataacgccatcattggcggcaagaccatcgataatactaacatcaaaatcaaggggctgaacgaatacatcaacctctacaaccagcagcagaaggataagagcgcccggctgccaaagctgaaacctctgtacaagcagatcctgagcgaccgtaacgccatcagctggctccctgaacagtttgagtctgatgacaaactcctggaggccattcagaaggcttatcaggagctggatgagcaggtgctgaacagaaagatcgagggggagcacagcctgagggaactgttagtcgggctggccgattacgacctgtccaagatctacatcagaaacgacctgcagttgactgacatttcccagaaagtcttcggccattggggcgtgattagcaaagccctgctggaggagctgaagaacgaggtgcctaagaagagcaaaaaggagtccgatgaggcctacgaagaccgtctgaacaaggtcatcaaatcacagggcagcatctccattgcgttcattaacgactgcatcaacaagcagctgcccgaaaaacagaagactatccagggctacttcgcagagctgggagccgtgaacaacgagactatccagaaggagaacctgttcgcccagattgaaaatgcctacacagaggtgaaggacctgctgaatactccatatacaggaaagaacctcgctcaggacaaggtgaatgtcgagaaaattaaaaacctgctggacgccatcaaggcactgcagcacttcattaagcccctgttgggcgacggaaccgagcctgagaaggacgagaaattttatggagagtttgctgccctgtgggaggagctggataaaatcacccccctgtataatatggtgagaaactacatgaccagaaagccttactcaaccgagaaaatcaagctgaacttcgaaaattccactctgatggatggctgggatctgaacaaggaacaggctaatactacagtgatcctgaggaaggacggcctctactacctagccattatgaacaagaagcacaacagagtgtttgatgtgaaggccatgccagacgatggggactgctacgaaaagatggagtacaagctgctgcccggcgctaacaaaatgctgcccaaggtgtttttcagcaagtccaggatccaggagttcgccccaagctctcagctgctggagaattaccacaacgacacccacaagaagggcgtgacattcaacatcaaggactgccacgccctgatcgacttcttcaaagcctccattaacaagcacgaggattggtgcaagttcggattcagattctctcccaccgagacctacgaggacctgtctggcttctacagggaggtggaacagcagggctacaagatcagcttcagaaatgtgtccgtggactatatccactccctggtggaggagggaaaaatcttcctgttccagatctacaacaaggacttcagcccatacagtaaggggacacccaatctgcacacactgtactggaagatgctgttcgacgagaagaatctggccgacgtggtgtacaagctgaacggccaggccgaggtgttctttagaaagagcagcattaattacgagcaacctacacacccagccaataaggcaatcgacaataagaacgaactgaacaagaagaagcagagcctgtttacatacgacctgatcaaggataagcggtacactattgataaattccagtttcacgtcccaatcaccatgaacttcaagtctaccggtaacgataacatcaatcagagcgtgaacgagtacatccagcagtcagacgacctgcatattatcgggatcgacaggggcgaaaggcacctgctgtacctgactgtgatcaacctgaagggcgaaattaaggagcagtacagtctgaacgagatcgtgaacacctacaagggcaatgagtaccggactgactatcatgacctgctgagcaagagagaggatgagagaatgaaagccaggcagagctggcagaccatcgagaacattaaagagctgaaggagggctacctgtctcaggtcgtgcacaagatcgctgagctgatgatcaagtacaatgcaattgtggtgctggaggacctgaatgccggcttcatgaggggcagacagaaggtggagtcctctgtgtaccagaaattcgagaagatgctgatcgataagctgaattacctggccgacaagaagaaacagcccgaggagcccggcgggatcctgaacgcctaccaactgactaacaaattcgtgtccttccagaagatgggtaagcagtgtgggttcctgttctacacccaggcttggaacacaagtaagattgaccctgtgactggcttcgtgaatctcttcgacacacggtacgagactagggagaaggccaagactttcttcggcaagttcgactccattaggtacaatgatgagaaggattggttcgagtttgcttttgattatactaacttcactagcaaggccgacggttctaggaccaactggaaactgtgtacatatggcaagaggatcgagaccttcagagatgagaagcagaactctaactggactagcaaggaggtggtgctgaccgacaaatttaaagagttcttcaaagagagtaatatcgacatccacagcaacctgaaggaggctatcatgcagcaggacagcgccgattttttcaagaagctgctgtatctgctgaagcttaccctgcagatgagaaactccgaaaccggtacaaacgtggattacatgcagagccccgtggccgacgaggagggcaacttctataactctgatacctgcgactccagcctgccaaagaatgccgacgcgaatggggcctacaacatcgccagaaagggtctgtggatcgtgcagcagatcaagacatccgacgatctgagaaatctgaagctggccattaccaacaaggaatggctgcagtttgcccagaggaagccctacctggacgagtga

SEQ ID NO: 207 - DNA, 3768 bp, synthetic construct
  source 1..3768: mol_type = other DNA
atgggcacactgaagcagttcaccagggtttaccctttgtccaagaccctgcggtttgaactgaaacccattggcagaaccctggaattcattaactcctccggcctgctggaacaggaccagcacagggcagactcctatatcaaggtcaaggggatcatcgacgagtaccacaaggccttcatcgagaccgtgctgaacgactttaagctgaattacaccgacgagggcaagaagaacagcttggaagaattttacacctgctatatgtgcaaggcaaaagatgaggcccagaaaaagctgtttgaggaaatacaggggaagctgcgaaagcagatcgccgactgcttttccaaagatgacaagttcaagcgcatcgacaagaaggagctgattaaggaggacctggtgaatttcgtgaccaaccaggaggacagactgctcatcgatgagttccgggatttcaccacctactttaccggcttccacgaaaatcggaagaacatgtacagtgctgaggcccagagcaccgccatcgcttacaggctgatccacgagaacctgccaaaattcattgacaatatgctggtgtttgacaaggtggccgcttcccccgtgagcgagcacttcgtaggcctgtatagcaatttcgaagagtacctgaatgtgatgaatatcgccgagatgttcagactggactacttcaatatcgtgctgactcagaagcagatcgatatttataattacatcatcggtggcagaacccttgacgatgggaccaagattaaaggcctgaacgagtatatcaatctgtacaaccagcagcagaaggacaagagcgtgaggctgcctaagctgaaaccactgtacaaacagatcttgagcgatagaaacgccatcagctggctgcccgagcagttcgaaagcgacgagaaggccctggaagcaatccagaaggcctaccaggaactggacgagcaggtgtttaacagaaataaagaaggcgagcactccctgaaggagctgctgcagaccctcgccgaatacgacctggacaaaatctatatcaggaacgatctgcagatgaccgatatctcacagaaagtgttcggccattggggcatcattagcaaagcgctgctggagcagctgaagaaggagctgccgaagaaatccaaaaaggagactgatgaagcctatgaggaaagactgaacaaggtgctgaagagccaggggtcaatttccatcgcccagatcaacaatagtgtgtgggttatgggcatggaggagcagaattccatccaggcctatttcgcccggctgggcgccgtgaatacagaaaccgtgcagcaggagaacatcttctctcacatcgagaatgcttacacagaggtgaaggatctgctgaataccccttaccccctgaataagaacctggcccaggacaaggtgaatgtggagaaaatcaaaaatctgctcgacgccattaagtctctgcagcactacgtgaagcccctgctgggcgatggcaccgagtccgagaaagatgagaagttctacggagagtttgtggccctgtgggaggatctggacaagatcacacccctgtacaacatggtgaggaattacatgaccaggaaaccctatagtacagagaagatcaaactgaacttcgaaaatagcacactgatggacggctgggacctgaacaaggagcaggccaacaccacagtgatcctgaggaaggacgggctgtattacctggctatcatgaataaaaaacataacagggtgttcgacgtgaaaaacatgcctgagagcggcgactgctatgagaaaatggagtacaaactgctgcctggcgccaataagatgctgcctaaagtgttcttttctaagagcaggattaatgagtttgctcctagcgagcagctgatggctaattaccgcaatgagactcacaagaagggcgccagcttcaacatccacgactgccacgccctgatcgacttttttaaaagctcaatcaataaacatgaagactggtccagatttgggttccactttagcgataccaacacctacgaggacctgtccggcttctaccgcgaggtggagcagcagggctataagatttccttcaggaatgtgagcgtggactacattcacagcctggtggaggaaggcaagatctacttgttccagatctacaataaggacttctccccctacagcaaggggacccccaatctgcatactctgtactggaacatgatgttcgacgagcggaacctggcagatgtggtgtacaagctcaacggccaggccgaggtgttcttcaggaaatccagcattacctgcgagaggcctactcaccccgccaatcaggccattgagaataagaacgcactgaacgagaagaagcagagcgtgtttacatacgacctgatcaaggatcggcgctataccgtggacaaatttcagttccacgtgcctatcaccatgaattttaagtcaaccggaaacgacaatatcaatcagtccgtgaatgaatacatccagaagtgtgacgacctgcatatcatcgggatcgacagaggcgagcgccacctgctgtacctgaccgtgattgacatgaagggccagattaaagagcagtacagcctgaacgagatcgtgaacacatacaagggcaatgagtacaggaccaattaccacgagctgctgagcaagagagaagacgagaggatgaaagcccggcagtcttggcagaccattgagaacatcaaggagcttaaggagggctacctgagccaagtgatccataagatctccgagctgatggttaaatacaacgccatcgtggtgctggaggatctgaacatgggtttcatgaggggcaggcagaaagtggaggccagcgtgtatcagaagttcgaaaaaatgctgatcgacaagttgaactacctcgccgacaaaaagaaaaatcccgaggaggaaggagggatcctgaacgcttatcagctgactaacaagttcacctctttccagaaaatgggtaaacagagtggcttcctgttctatactcaggcctggaacacctccaagattgaccctgttacagggttcgtgaacctgttcgacacccgatatgagacaagggagaaggccaaagtgttcttctgcaagttcgattctatccgctacaaccgcgataaggattggttcgagtttgcattcgactacaacaagttcaccactaaggctgaggggacccacacccagtggatcctctgcacctacggcaaaaggatggagaccttccgggatgaaaagcagaatagccagtggacttcccaggagtgcggcctgacagacaaattcaaagagttctttgccaagtacggcatcgatattcatactaacctgaaggaggctatcgctcagcaagactccgccgacttcttcaaagggctgctgtatctgctgaaactgaccctgcagatgagaaatagcaaaaccggaactgacatagattacatgcagagccctgtggccgacgcaaacggaaatttctacaatagcgagctgtgtgacaatagcctgcccaagaatgccgacgccaacggcgcctataacattgccaggaagggcctgtggatcgtgaggcagatcaaggcctcagatgatctgaggaacctgaagctgaccattagtaataaggagtggctgcagttcgcccagaataagccatacctgaatgactga

SEQ ID NO: 208 - DNA, 3882 bp, synthetic construct
  source 1..3882: mol_type = other DNA
atgagcacctatagcgatttcactgggctgtacactctgtccaaaacgctacgatttgagctgaagcctatcggaaaaaccaaggacaatatagaacggaatggcatattagaccgggatagccagagagccattggatataaggcgatcaagaaggtgatagatgagtaccataaagcctttatcgaattgatgctggatagcttcgaactgaagcttaaagacgaaggtagaatggacagtctgatggagttctattatctgtaccatctgcctaccattgatagcaaaaggaaggatgacctgaagaaagtgcaggaggccttgcgtaagcagatatccgagtgctttacgaaaagcgaacaatataagcggctgtttgggaaggaactgatcagagaggacctggcggacttcatcaagacacccaagtatgagggagtaattagatcccagcatgataacgaggaccttacagaggaggagattcgaaagattcaggaagaagtggagaagaccatagaccaattctatgacttcactacctatttcgtgggtttctatgacaaccgtaagaacatgtatgtggccgacgataaggcaacctcaattgcacatcggatgattaccaagaacctcccaaagtttatcgataatatggatgtctttgcgaagatctcttcctcagaggttgccacgcacttcgaaactctttacaaagagatggaggcttacttgaacgtaaactccatcgaggaaatgttccagttagattactttagcatggtccttacacaaaagcagattgacgtgtacaattcaatcatcggaggaatggtcctagaaaacgggacgaaaattcagggcttaaatgagtatgttaacctgtataaccagcagcagaaagataaaggcaaccgcttacccaaattgaaacccctctttaaacaaattctcagtgaaaggaacgctataagttggctgccagaggagtttgagtcagacaatgacatgcttgatggtattgagaggtgttatcaggacctgaagaaacaagtcttcaatggagagaacagcatgcaggtgctcctgaaaagcattggtgattatgatctggagcatatctacctgccgaacgatctccagctgaccgacatcgcccagaagtattatgggtcttggtcggtgatcaagaaagcaatggaggaggacgtgaaagccaataacccacagaaacggaatgacaccggcgaaaaatacgaagagaggatcactaagttactcaagtctaaagagtctatcagcattgaggaaatcaatcgcctgatgaaatggctgttgggcgacgattataaaccaatggagaattacttctccatgatgggcgctgaggatgatgagaatggtcagaaacctgatcttttcattagaattgagaacgcctacactgaggcaaaagcactcttgacttcagtttacccagaagataggaaattgagccaagataagaagaatgtggagcggattaaaaatctcctcgacgcaattaaagatctgcagcgtttcgtcaaacctctcctgggcggcggaacagaatcagaaaaagatccaaggttctacggagagttcgtgcctatgtgggaggcactggaccagatcacaccgctttacaacatggtcaggaatcgtatgacacagaaaccctacagtgaagaaaagattaaactgaacttcgacactcccacccttctgaaagggtggcccgatgcccaagcatcctccggtgccatcctgaaagataataaggggctatactacctggctattttggattccatgcataggacatgtctgaacgaactcaagtcctgccccactgaaaagagtgaaatggcgattatgaaatatctgcagggcggtgacatggaaaaaaatgtgcaaaatctgatgcgcatcaatggcgtgactcgcaaggtgaacggacggaaggaaaaggagggagcaatggttggccagaacattagactcgagaatgcaaagaacacctatcttcctacagagatcaatgatatccgccttaagcaatcataccttacttcgagtcagagctttaataagcaggacctggccctatacatcgagtattacatgccattggtaagggaatactacagcgactaccagttttcctttaggaatccctcggagtacaaatcttttgctgaatttaccgaccacatcaatcagcaagcttatcaggtgcagtttggcagcatctccgacaagcagttattccagatggtcgaggaggggaagatatatctgttccagatttacaacaaggacttttccccttattccaaggggacgcccaatatgcacacgctctactggaagatgctgttcgatgagcgaaatttggctgatgtggtatataagctcaatggcgaagctgaagtcttcttcagaaagcactctatagaagttggcagaccgacccatcccgcgaataagcctatcgagaacaaaaataagctgaacgagaagaagatttcagtctttgcctacgatttgttaaaagacaggcgttacactgtcgataagttccagttccatgtaccaataaccatgaactttaaggccgcagggctaaataacatcaatccactggtgaatgcttatctgaaggagtctaaagccacacacatcataggtatagacagaggtgaacggcaccttctttacctgagtctcatcgacttacaagggaacatcgtggagcaatacagtcttaacgaaatcgtcaatgagtacaacgggaatacatatcgcactaactatcacgacctcttggatgccaaggaaaagcaacgagacgaagcaagaaagtcttggcagaccatcgagaatataaaagaacttaaggagggctacatgtcccacgtgatccataagatcgcagaactcatggtgaagtacaacgccgttgtggttctggaagacctgaaaccggggtttatgcgcggcagacagaaagtcgagaagcaggtgtaccagaaatttgagaaaatgctgatagacaagctgaactatctcgtggacaaaaaactagaagctaccgaaatggggggggttctcaacgcttaccagctcacaaataagtttgaaagttttcagaagcctgggaagcaaagcgggtttttattttacatacctgcctggaacacatctaaaatggatcccactacgggcttcgttaatttgctcgatacccgctatgaaaatatggctaaggctaaggctttcttcggcaagttcaaatcaattcggtacaatgccaccaaagactggttcgagttcgcctttgactacaacaacttccacaaccgcgccgagggaacccgaacacaatgggctctgtgcacctatggtacccggatcgagactaagcgggatcccaaacagaacaacagctttgtctctgaagagtttgacctgacatctaagttcaagaagctgctagcccactacgcgattgaccttaacggcaatctactggagcagatttgtagccagaacgacactcagttttataaggacttactccacctactccacctgacactgcagatgcggaattctatcaccggcacagacgtggattatctggtgtcgccagtaatgaacgtttacggagagttctatgattcaaggacctgcggcaacaatctccctaaaaacgcggacgccaacggagcctacaacattgctcgaaaaggattgtggatcatcgaacagattaaacagacagaagatttgagtaagctcaagttggccatttctaacaaagagtggatgagatacgcacaaggactgcgctga

SEQ ID NO: 209 - DNA, 3792 bp, synthetic construct
  source 1..3792: mol_type = other DNA
atgaagaccctgaaaaacctgacagggctgtacagcctgtccaagactctgcggttcgagctgaaacccatcggcaagactaaagagaacatcgagaagaacggaatcctggaaagggacaatgaaagagctatcgcctataaagctgtcaagaaagtgatcgacgagtaccacaaggcttttattgagctgatgctggacgactttgagctgaacaaggacaccctgaacgaattctactatctgtatcacctgcctacttctgaggccaagcgcaagaccgatctgccaaaggtgcaggaggtgctgagaaagcagatcagtgaaaggttcacaaaaagcgagcagttcaagaggctgtttgggaaggagctgatcagggaagacctggtggaattcgtcaagacccctcagtacgagaatatcattaggaagatgccagggaacgagcagttgaccgacaaggaggttaagcagatccaggagcgggtgcaaaaggacatcgcccagtttgatgatttcaccacctatttctccggcttttatgataacaggaaaaacatgtacgtgcccgaggacattgccacaagcattgcccacagaatgatcggggagaatctgccgaagttcattgataacatggacgtgttcgccagaatagccgctagcgacgtcgccacacatttcgacgagctgaataaggccatggagctgtacctgaacgtgaacgagatcccagagatgttccagctggactatttccacatggtgctcactcagaagcagatcgacgtgtataatgccattatcggcgggaaggtgctggatgatggcacgaaggtgcaggggctgaatgaatacgtgaatctgtacaatcagcagcagaaggataagagcaagcggctgcccaagctgaagccactgtttaagcagattctgagcgaaagaaacgccatctcttggctgcccgacgagtttgactccgacaacgagatgctgcagagcatcggcaagtgctaccacgacctgaaagaacaggtgtttggctccctgaagactctgctgggatccatcaaggactatgacctggagcacatctacctgcccaacgatctgcagctgaccgatatcgctcagaagcacttcggcgactggtctgtgattaagaatgcagtcatcgagaacctgcagagcgtgaatcctaagaagaaaagagagaatggagaaaattacgatgaacggatcctgaagctgcagaaagccaacgattcctacagcatcggcttcatcaatgccctgctgaggagcaagaccgatgactttaacccactggagaattatttcgccggaatgggagccgaagacaatgaaaatggccagaaactgaatcatttcgctaggattgagaacgcttatacagaagtgaagaccctgctgaacgccgattatccagagggcaagtcactgagccaggacaaagccaatgtggagaagattaagaacctgctggacagtatcaaggatctgcagcactacgtgaagcccctgctgggctcaggcatggagtctgacaaggacaatagattttacggggagttcaccccactgtgggaagcactggatcagatcacaccactgtataacatggtgaggaacagaatgacccagaagccatactccgatgagaaaattaagctcaacttcgacaattccaccctgctggccgggtgggacctgaataaggaagcagacaacacttgcactctcctgaggaaggacgggaactattacctggccatcattaacaagaggtccaacaaagtgctgaagccagagaacctgatcagcgatggcgattgctacgaaaagatggagtacaagctgctgccaggggccaacaaaatgctgccaaaggtcttcttttccaaatctcggattgatgagttcaagcccagcgaaagtgtgctgaagaactaccagaaggagacacataagaagggggacaacttcaacctggatgactgccacgccctgatcgatttttttaaggagagcatcaataagcatgaggactggagcaagttcggctttcacttcagcgacaccaatagctacgaggacctgtccgggttttacagagaggtggaacagcagggatacaagatcagctttaggaacgtgagcgtgaactacatcaatcagctggtggacgaggggaagatctacctgttccagatctacaacaaagacttctctccttactccaagggcacccctaacatgcataccctgtactggaggatgctcttcgatgagaggaatctggccgatgtggtgtataagctgaacggagaggcagaagtgtttttccggaaacactcaattagagtggataaacccactcaccctgccaataagcccatcgccaataaaaacgcacagaatgagaagaaggagagtatcttcacctacgatctggtgaaggaccggagatacaccgtggacaagttccagtttcacgtccccatcaccatgaatttcaaggccgccgggctgaacaatatcaatcccctggtgaacgcctatctcaaagagtccaatagcacccacattatcggcatagaccgcggcgaaagacacctgctgtacctgtccctgatcgacatgaaaggcaacatcgtggaacagtacaccctgaatgagatcgtgaatgagtacaagggaaatacctaccggaccaactatcacgacctgctggatgcaaaggaaaaacagcgcgacgaagccagacgctcctggcagaccattgagaacattaaggagctgaaggagggctatatgtcccaggtgatccacaagatcgccgagctgatggtgaaacacaatgccattgtggtgctcgaggaccttaacatgggctttatgcgagggagacagaaagtggagaaacaggtgtaccagaagtttgagaagatgctgatcgataagctgaattacctcgtggataagaaactggacgccgaggagatggggggcgtgttgaacgcctaccagctgacaaataaattcgagggctttcagaagctgggcaaacagtccggctttctgttctacattcccgcctggaacacctctaaaatggacccgacaaccggatttgtgaacctgttcgacaccagatatgagaacatggagaagtcaaaggtgttcttcggcaagtttgacagcatcagatataatagcgccaagggttggtttgagttcgccttcgactatgggaattttacagctaaggccgaaggcacccgcaccaactggaccctgtgcacatacggcacccggatcgaaaccaagagaaatcccgagaaaaataacgagttcgactcagtcgagattgacctgactgagcagttcaaagccctgttcgccaagcatcagatcgacctgagcggtaacctgaaggagcagatctgcaatcagtccgatgccagctttcataaagagctgctgcacctgctgcacctgaccctgcaaatgcggaacagcgtcacaaacagcgaagtggacttcctgctgtcccccgtgatgaacgccagcggcgagttctatgactcaagaacctgcgggaagaacctgccagagaatgccgacgccaacggcgcttacaatatcgccagaaagggactgtggatcattgagcagatcaagaacaccaacgacaatgacctggccaagatcaagctggctatcagcaataaggagtggcttaggtacgcccagggactggactga

SEQ ID NO: 210 - DNA, 3846 bp, synthetic construct
  source 1..3846: mol_type = other DNA
ctgaaaaacaaatattacgtttgcatcttcattaagaagactatcaactccattatcaatctgaaggagactaacaaaatgaagaagttcagcgattttaccaacgtgtacccagtgtccaagaccctgagatttgagctcaagccaatcgggaagacccaggagaacctgggcaaaattatcgatgaagacaatcagagagccaaggattataaggtggtgaagaaagtgattgacgagtaccacaaggccgtgatcgagcagctgctgaacgggttcgagctggacaaagacaccctggagaagtttaaagatctgtaccatctgtccatcagcgagcctaagagaaaggatctgcctaaggtgcaggaagtgctgcgggaacagatttccaagcggtttatcaagagtgagcagtataagcggctgttcggaaaggagctgatccaggaggacctgccagagttcgtgtattcttcaaaatacggcgacgtcatcaggaagcaacacgagaaggaacacctgtcagacgacgatatcaaccgcgagaggaaaagaatctgcgatgagatcgcccagtttgatgactttacctcttactttggcggatttcacgagaaccggaagaacatgtacgttgcagacgataaagccactagcatcgctcacagactgatcaatgagaacctgccaaagttcgtcgataacatggacgtgtttgccaaaatcgccgcatcagacgtggcccagcactttgataagctgtataaggagatggagccttacctgaacgtgggcgcaatctctgaaatgttcgagatcgggtacttcagcaccgtcctgacccagaagcagatcgatgtttacaacgccatcatcggcggtaaggtggaggaggacggcaggaagatccagggtctgaacgagtacatcaatctgtataaccagcagcagaaggataaggcaaacaggctgcccaagctgaagcccctgttcaaacagatcctgagcgatcgcaatgccattagctggctgcccgaagaattcgagtcagacaacgacatgctccagaggatcgaggagtgctaccagaatctcaaggagcaggtgtttgactccctgaagaccctgctggccaacatcaaggagtacgacattgcccacatctacctccctaatgacctgcagctgaccgatatctctcagaagcattttggaagctggtctgtgatcaagaacgccgtgatcgaaaaggtgaaagccgagaatccccagaagaagaaagagtccggcgagaaatacgaggagaggatcgccaaggagctgaaacactacgatagcctgacaatcggattcctgaacgatctgctgaagaatcaggtgggcttcacccctattgagatgtatttcgctaatatgggcgccgaggacaacgaaaacgggcagcaggtgaaccacttcgtgcgtatcgagaatgcttataccgacatctgccagcttctgagcactgagtataaaggggattccctggcccaggacaaaaagaacgtggaaaagattaagaacctgctggatgcaatcaaaaacctgcagcacttcgtgaagcccttgctggggaagggcaacgaatccgagaaggataatcgcttctacggggaattcacaccactgtgggaaatgctggaccagatcacccccctctataatatggtgaggaacaggatgaccaaaaagccttactcagaggagaaaatcaagctgaacttcgagaactcacagctgctgaaaggctgggacctgaacaaagaggtggccaacacctgtaccatgctgagaaaggacggcaattactacctggtgatcatgaataaaaagcacaatactgtgctgcagcccggcaagctggtgagcgacggggactgctacgagaagatggaatacaagctgctgcctggggccaacaagatgctgcctaaggtgttctttagcaagagcagaattggcgagttcaatccctccgagaggatcattaataactacaacaacaacactcataagaagggggatacatttaacctggacgattgccacgccctcatcgacttcttcaagaccagcattaacaagcatgaagactggtccaaattcgactttaaatttagcgatactaacacatactctgatctgagcggattttaccgggaggtggagcagcagggctacaaaatcgccttcagaaacgtgagcgtgcagtacatcgatcagctggtggacgaggggaagatttatctcttccagatttacaacaaagatttctccccctacagcaagggcaccccaaacatgcatacactgtactggagggccctgttcgacgagaagaacctggccaatgtggtgtataagctgaatggggaagccgaggtgtttttcagaaagcattctctgccatacaagcctacacaccctgccaaccagcctatcgcaaataagaactctcagaacaaaaagaaggagagcacattcgcctacgacctgattaaggaccggcgatacactctggacaagttccagctgcacgtgcccatcactatgaactttaaggccgccggcatcaacaatatcaacctgatggtcaaggattatctgaaggaatctgacgccacccacatcatcggcatcgacagaggcgagcgccacctgctgtacctgtctgtgatcaacatgaagggggagatcgtggagcagtactcactgaacgagatcgtgaacgagtataacggcaatacctacagaactaattaccacgacctgctggacgccaaagagaaacagcgcgatgaggcacgcaggagctggcagaccatcgaaaacatcaaggaactcaaggagggctatatgtcccaggtggtgcacaaaatcgcccagctgatggtgaaatataaggctatcgtggtgctggagaatctgaacatgggcttcatgcgcggccggcagaaggtggagaaacaggtgtaccagaaatttgagaagatgctcatcgataagctcaactacctggtcgacaaacagtgcgccatcgacgaagaaggcgggatcctgcacgcctatcagttaaccaacaagtttgagagcttccagaaaataggcacccagtccggcttcctgttttacatcccagcctggaatacatccaagatggaccctacaacaggcttcgtgaacctgtttgacaccagatatgaaaacatggagaaagcccgcctgttcttcgccaagttcgattccatccggtataatacaaatcagaactacatcgagtttgccttcgactacgacaatttcacctccaaggccgagggcactaagacaaaatggactctgtgtacctacggcactcgcatcgagaccaaaaggaatccagacaagaacaacgagttcgacagcatcgaactgaatctgaccgagcagttcaaggccctgttcactacataccatatcgacatcaccggaaatctgaaggagcagatctgcaatcagaacgacgcaactttctacaaggggttgctgcacctgctgcacctcaccctgcagatgcgaaacagtgtgaccggaacagcaacagactacctgctgtctcctgtgatgaacaataagggggagttttttgacagccggaaatgcggcaagaacctgccagagaatgcagatgccaacggcgcctacaacatcgccagaaaagggctgtgggtgattgagcagattaaacaggccgaggacctgtccaacatcgacctggccatcaagaacaaggagtggatgcagttcgcccagaagaacaggtga

SEQ ID NO: 211 - DNA, 36 bp, synthetic construct
  source 1..36: mol_type = other DNA
ggctactaagcctttataatttctactattgtagat

SEQ ID NO: 212 - DNA, 35 bp, synthetic construct
  source 1..35: mol_type = other DNA
gctactaagcctttataatttctactattgtagat

SEQ ID NO: 213 - DNA, 36 bp, synthetic construct
  source 1..36: mol_type = other DNA
atctacaatagtagaaattaattgagtcaattagac

SEQ ID NO: 214 - DNA, 36 bp, synthetic construct; identical to SEQ ID NO: 213
  source 1..36: mol_type = other DNA

SEQ ID NO: 215 - DNA, 36 bp, synthetic construct
  source 1..36: mol_type = other DNA
atctacaatagtagaaattaaaatggctttatagcc

SEQ ID NO: 216 - DNA, 37 bp, synthetic construct
  source 1..37: mol_type = other DNA
atctacaatagtagaaattaaaatggctttatagcca

SEQ ID NO: 217 - DNA, 36 bp, synthetic construct
  source 1..36: mol_type = other DNA
atctacaatagtagaaattcaaatggctttattgcc

SEQ ID NO: 218 - DNA, 36 bp, synthetic construct; identical to SEQ ID NO: 217
  source 1..36: mol_type = other DNA

SEQ ID NO: 219 - DNA, 36 bp, synthetic construct
  source 1..36: mol_type = other DNA
gtctaaaggactcaaataatttctactattgtagat

SEQ ID NO: 220 - DNA, 36 bp, synthetic construct; identical to SEQ ID NO: 219
  source 1..36: mol_type = other DNA

SEQ ID NO: 221 - DNA, 36 bp, synthetic construct
  source 1..36: mol_type = other DNA
gtctaacagattggaataatttctactattgtagat

SEQ ID NO: 222 - DNA, 36 bp, synthetic construct; identical to SEQ ID NO: 221
  source 1..36: mol_type = other DNA

SEQ ID NO: 223 - DNA, 36 bp, synthetic construct
  source 1..36: mol_type = other DNA
atctacaatagtagaaatttatagtctcttttagac

SEQ ID NO: 224 - DNA, 36 bp, synthetic construct; identical to SEQ ID NO: 223
  source 1..36: mol_type = other DNA

SEQ ID NO: 225 - DNA, 36 bp, synthetic construct
  source 1..36: mol_type = other DNA
ggctataagccttgtataatttctactattgtagat

SEQ ID NO: 226 - DNA, 36 bp, synthetic construct; identical to SEQ ID NO: 225
  source 1..36: mol_type = other DNA

SEQ ID NO: 227 - DNA, 36 bp, synthetic construct
  source 1..36: mol_type = other DNA
ggctataagccttatataatttctactattgtagat

SEQ ID NO: 228 - skipped

SEQ ID NO: 229 - DNA, 36 bp, synthetic construct
  source 1..36: mol_type = other DNA
gtctatagaggctcaataatttctactattgtagat

SEQ ID NO: 230 - DNA, 36 bp, synthetic construct; identical to SEQ ID NO: 229
  source 1..36: mol_type = other DNA

SEQ ID NO: 231 - DNA, 36 bp, synthetic construct
  source 1..36: mol_type = other DNA
ggctataagtctgtataatttctacttagtgtagat

SEQ ID NO: 232 - DNA, 36 bp, synthetic construct; identical to SEQ ID NO: 231
  source 1..36: mol_type = other DNA

SEQ ID NO: 233 - DNA, 36 bp, synthetic construct
  source 1..36: mol_type = other DNA
gcctataaaggcacaataatttctactattgtagat

SEQ ID NO: 234 - DNA, 36 bp, synthetic construct; identical to SEQ ID NO: 233
  source 1..36: mol_type = other DNA

SEQ ID NO: 235 - DNA, 36 bp, synthetic construct
  source 1..36: mol_type = other DNA
atctacgatagtagaaattaacttggctttatagcc

SEQ ID NO: 236 - DNA, 36 bp, synthetic construct; identical to SEQ ID NO: 235
  source 1..36: mol_type = other DNA

SEQ ID NO: 237 - DNA, 36 bp, synthetic construct
  source 1..36: mol_type = other DNA
ggctataaagccaatttaatttctactattgtagat

SEQ ID NO: 238 - DNA, 36 bp, synthetic construct; identical to SEQ ID NO: 237
  source 1..36: mol_type = other DNA

SEQ ID NO: 239 - DNA, 37 bp, synthetic construct
  source 1..37: mol_type = other DNA
atctacaatagtagaaattttatttgtcatttagact

SEQ ID NO: 240 - DNA, 36 bp, synthetic construct
  source 1..36: mol_type = other DNA
atctacaatagtagaaattttatttgtcatttagac

SEQ ID NO: 241 - DNA, 36 bp, synthetic construct
  source 1..36: mol_type = other DNA
atctacaacagtagaaattattgaggccttatagcc

SEQ ID NO: 242 - DNA, 36 bp, synthetic construct; identical to SEQ ID NO: 241
  source 1..36: mol_type = other DNA

SEQ ID NO: 243 - DNA, 36 bp, synthetic construct
  source 1..36: mol_type = other DNA
gtctataagacgattctaatttctactattgtagat

SEQ ID NO: 244 - DNA, 36 bp, synthetic construct; identical to SEQ ID NO: 243
  source 1..36: mol_type = other DNA

SEQ ID NO: 245 - DNA, 36 bp, synthetic construct
  source 1..36: mol_type = other DNA
gtctataaggcctcaataatttctactattgtagat

SEQ ID NO: 246 - DNA, 36 bp, synthetic construct; identical to SEQ ID NO: 245
  source 1..36: mol_type = other DNA

SEQ ID NO: 247 - DNA, 36 bp, synthetic construct
  source 1..36: mol_type = other DNA
ggctaataagtcgatgtaatttctactattgtagat

SEQ ID NO: 248 - DNA, 36 bp, synthetic construct; identical to SEQ ID NO: 247
  source 1..36: mol_type = other DNA

SEQ ID NO: 249 - DNA, 36 bp, synthetic construct; identical to SEQ ID NO: 247
  source 1..36: mol_type = other DNA

SEQ ID NO: 250 - DNA, 36 bp, synthetic construct; identical to SEQ ID NO: 247
  source 1..36: mol_type = other DNA

SEQ ID NO: 251 - DNA, 36 bp, synthetic construct
  source 1..36: mol_type = other DNA
ggctaataagccagtggaatttctactattgtagat

SEQ ID NO: 252 - DNA, 36 bp, synthetic construct; identical to SEQ ID NO: 251
  source 1..36: mol_type = other DNA

SEQ ID NO: 253 - DNA, 36 bp, synthetic construct
  source 1..36: mol_type = other DNA
atctacaatagtagaaattaaattggcttgttagcc

SEQ ID NO: 254 - DNA, 36 bp, synthetic construct; identical to SEQ ID NO: 253
  source 1..36: mol_type = other DNA

SEQ ID NO: 255 - DNA, 36 bp, synthetic construct
  source 1..36: mol_type = other DNA
ggctataaagccataacaatttctactattgtagat

SEQ ID NO: 256 - DNA, 36 bp, synthetic construct; identical to SEQ ID NO: 255
  source 1..36: mol_type = other DNA

SEQ ID NO: 257 - DNA, 37 bp, synthetic construct
  source 1..37: mol_type = other DNA
ggctagtaagcttcaataatttctactattgtagatt

SEQ ID NO: 258 - DNA, 36 bp, synthetic construct
  source 1..36: mol_type = other DNA
ggctagtaagcttcaataatttctactattgtagat

SEQ ID NO: 259 - DNA, 36 bp, synthetic construct
  source 1..36: mol_type = other DNA
atctacgatagtagaaattatcaagtccttatagac

SEQ ID NO: 260 - DNA, 36 bp, synthetic construct; identical to SEQ ID NO: 259
  source 1..36: mol_type = other DNA

SEQ ID NO: 261 - DNA, 36 bp, synthetic construct; identical to SEQ ID NO: 259
  source 1..36: mol_type = other DNA

SEQ ID NO: 262 - DNA, 36 bp, synthetic construct; identical to SEQ ID NO: 259
  source 1..36: mol_type = other DNA

SEQ ID NO: 263 - DNA, 36 bp, synthetic construct
  source 1..36: mol_type = other DNA
atctacaatagtagaaattacttaggctttatagcc

SEQ ID NO: 264 - DNA, 36 bp, synthetic construct; identical to SEQ ID NO: 263
  source 1..36: mol_type = other DNA

SEQ ID NO: 265 - DNA, 36 bp, synthetic construct
  source 1..36: mol_type = other DNA
gtctaagacagcatttaaatttctactattgtagat

SEQ ID NO: 266 - DNA, 24 bp, synthetic construct
  source 1..24: mol_type = other DNA
atttaaatttctactattgtagat

SEQ ID NO: 267 - DNA, 36 bp, synthetic construct
  source 1..36: mol_type = other DNA
ggctataagccttattaaatttctactattgtagat

SEQ ID NO: 268 - DNA, 36 bp, synthetic construct; identical to SEQ ID NO: 267
  source 1..36: mol_type = other DNA

SEQ ID NO: 269 - DNA, 36 bp, synthetic construct
  source 1..36: mol_type = other DNA
atctacaatagtagaaattataaaagtcatttagac

SEQ ID NO: 270 - DNA, 36 bp, synthetic construct; identical to SEQ ID NO: 269
  source 1..36: mol_type = other DNA

SEQ ID NO: 271 - DNA, 36 bp, synthetic construct
  source 1..36: mol_type = other DNA
atctacaatagtagaaatttaattaggcgagtagcc

SEQ ID NO: 272 - DNA, 36 bp, synthetic construct; identical to SEQ ID NO: 271
  source 1..36: mol_type = other DNA

SEQ ID NO: 273 - DNA, 36 bp, synthetic construct
  source 1..36: mol_type = other DNA
gtctgaaagacacatataatttctactattgtagat

SEQ ID NO: 274 - DNA, 36 bp, synthetic construct; identical to SEQ ID NO: 273
  source 1..36: mol_type = other DNA

SEQ ID NO: 275 - DNA, 36 bp, synthetic construct
  source 1..36: mol_type = other DNA
atctacaatagtagaaattataaaattactatagcc

SEQ ID NO: 276 - DNA, 36 bp, synthetic construct
  source 1..36: mol_type = other DNA
atctacaatagtagaaattataagattactatagcc

SEQ ID NO: 277 - DNA, 36 bp, synthetic construct
  source 1..36: mol_type = other DNA
atctacgatagtagaaattataaaattactatagcc

SEQ ID NO: 278 - DNA, 36 bp, synthetic construct; identical to SEQ ID NO: 277
  source 1..36: mol_type = other DNA

SEQ ID NO: 279 - DNA, 36 bp, synthetic construct
  source 1..36: mol_type = other DNA
gtctaattgactttattaatttctactgttgtagat

SEQ ID NO: 280 - DNA, 36 bp, synthetic construct; identical to SEQ ID NO: 279
  source 1..36: mol_type = other DNA

SEQ ID NO: 281 - DNA, 36 bp, synthetic construct
  source 1..36: mol_type = other DNA
atctacaatagtagaaattataatagtcttatagac

SEQ ID NO: 282 - DNA, 36 bp, synthetic construct; identical to SEQ ID NO: 281
  source 1..36: mol_type = other DNA

SEQ ID NO: 283 - DNA, 36 bp, synthetic construct
  source 1..36: mol_type = other DNA
atctacaatagtagaaattatccaagtcctatagac

SEQ ID NO: 284 - DNA, 37 bp, synthetic construct
  source 1..37: mol_type = other DNA
atctacaatagtagaaattatccaagtcctatagact

SEQ ID NO: 285 - DNA, 36 bp, synthetic construct
  source 1..36: mol_type = other DNA
ctctatgaggcacatttaatttctactattgtagat

SEQ ID NO: 286 - DNA, 36 bp, synthetic construct; identical to SEQ ID NO: 285
  source 1..36: mol_type = other DNA

SEQ ID NO: 287 - DNA, 36 bp, synthetic construct
  source 1..36: mol_type = other DNA
gtctataagacttaagtaatttctacttttgtagat

SEQ ID NO: 288 - DNA, 36 bp, synthetic construct; identical to SEQ ID NO: 287
  source 1..36: mol_type = other DNA

SEQ ID NO: 289 - DNA, 36 bp, synthetic construct
  source 1..36: mol_type = other DNA
atctacaatagtagaaatttaatcagctttatagcc

SEQ ID NO: 290 - DNA, 47 bp, synthetic construct
  source 1..47: mol_type = other DNA
gttgttcgcgactgcaaatgtataaaactttgaaagcaattcacaac

SEQ ID NO: 291 - RNA, 36 nt, synthetic construct
  source 1..36: mol_type = other RNA
ggctactaagcctttataatttctactattgtagat

SEQ ID NO: 292 - RNA, 36 nt, synthetic construct
  source 1..36: mol_type = other RNA
gtctaattgactcaattaatttctactattgtagat

SEQ ID NO: 293 - RNA, 36 nt, synthetic construct
  source 1..36: mol_type = other RNA
ggctataaagccattttaatttctactattgtagat

SEQ ID NO: 294 - RNA, 36 nt, synthetic construct
  source 1..36: mol_type = other RNA
ggcaataaagccatttgaatttctactattgtagat

SEQ ID NO: 295 - RNA, 36 nt, synthetic construct
  source 1..36: mol_type = other RNA
gtctaaaggactcaaataatttctactattgtagat

SEQ ID NO: 296 - RNA, 36 nt, synthetic construct
  source 1..36: mol_type = other RNA
gtctaacagattggaataatttctactattgtagat

SEQ ID NO: 297 - RNA, 36 nt, synthetic construct
  source 1..36: mol_type = other RNA
gtctaaaagagactataaatttctactattgtagat

SEQ ID NO: 298 - RNA, 36 nt, synthetic construct
  source 1..36: mol_type = other RNA
ggctataagccttgtataatttctactattgtagat

SEQ ID NO: 299 - RNA, 36 nt, synthetic construct
  source 1..36: mol_type = other RNA
ggctataagccttatataatttctactattgtagat

SEQ ID NO: 300 - RNA, 36 nt, synthetic construct
  source 1..36: mol_type = other RNA
gtctatagaggctcaataatttctactattgtagat

SEQ ID NO: 301 - RNA, 36 nt, synthetic construct
  source 1..36: mol_type = other RNA
ggctataagtctgtataatttctacttagtgtagat

SEQ ID NO: 302 - RNA, 36 nt, synthetic construct
  source 1..36: mol_type = other RNA
gcctataaaggcacaataatttctactattgtagat

SEQ ID NO: 303 - RNA, 36 nt, synthetic construct
  source 1..36: mol_type = other RNA
ggctataaagccaagttaatttctactatcgtagat

SEQ ID NO: 304 - RNA, 36 nt, synthetic construct
  source 1..36: mol_type = other RNA
ggctataaagccaatttaatttctactattgtagat

SEQ ID NO: 305 - RNA, 37 nt, synthetic construct
  source 1..37: mol_type = other RNA
agtctaaatgacaaataaaatttctactattgtagat

SEQ ID NO: 306 - RNA, 36 nt, synthetic construct
  source 1..36: mol_type = other RNA
ggctataaggcctcaataatttctactgttgtagat

SEQ ID NO: 307 - RNA, 36 nt, synthetic construct
  source 1..36: mol_type = other RNA
gtctataagacgattctaatttctactattgtagat

SEQ ID NO: 308 - RNA, 36 nt, synthetic construct
  source 1..36: mol_type = other RNA
gtctataaggcctcaataatttctactattgtagat

SEQ ID NO: 309 - RNA, 36 nt, synthetic construct
  source 1..36: mol_type = other RNA
ggctaataagtcgatgtaatttctactattgtagat

SEQ ID NO: 310 - RNA, 36 nt, synthetic construct; identical to SEQ ID NO: 309
  source 1..36: mol_type = other RNA

SEQ ID NO: 311 - RNA, 36 nt, synthetic construct
  source 1..36: mol_type = other RNA
ggctaataagccagtggaatttctactattgtagat

SEQ ID NO: 312 - RNA, 36 nt, synthetic construct
  source 1..36: mol_type = other RNA
ggctaacaagccaatttaatttctactattgtagat

SEQ ID NO: 313 - RNA, 36 nt, synthetic construct
  source 1..36: mol_type = other RNA
ggctataaagccataacaatttctactattgtagat

SEQ ID NO: 314 - RNA, 36 nt, synthetic construct
  source 1..36: mol_type = other RNA
ggctagtaagcttcaataatttctactattgtagat

SEQ ID NO: 315 - RNA, 36 nt, synthetic construct
  source 1..36: mol_type = other RNA
gtctataaggacttgataatttctactatcgtagat

SEQ ID NO: 316 - RNA, 36 nt, synthetic construct; identical to SEQ ID NO: 315
  source 1..36: mol_type = other RNA

SEQ ID NO: 317 - RNA, 36 nt, synthetic construct
  source 1..36: mol_type = other RNA
ggctataaagcctaagtaatttctactattgtagat

(The sequence listing continues in the following parts.)

The invention claimed is:

1. An isolated or recombinant polynucleotide comprising:
a nucleic acid sequence that encodes a polypeptide at least 95% identical to SEQ ID NO: 585, wherein the polypeptide comprises arginine (R) at position 169.

2. The isolated or recombinant nucleic acid sequence of claim 1, wherein the nucleic acid sequence encodes a polypeptide which comprises:
a. a Wedge (WED), α-helical recognition lobe (REC), PAM-interacting (PI), RuvC nuclease, Bridge Helix (BH) and NUC domains; or b. one or more domains selected from RuvC, REC, WED, BH, PI and NUC domains.

3. The isolated or recombinant nucleic acid sequence of claim 1, wherein the nucleic acid sequence is operably fused to a nucleic acid sequence encoding one or more reverse transcriptases.

4. The isolated or recombinant nucleic acid sequence of claim 3, wherein the one or more reverse transcriptases comprises Moloney Murine Leukemia Virus (M-MLV) reverse transcriptase.

5. The isolated or recombinant nucleic acid sequence of claim 1, wherein the nucleic acid sequence is operably linked to a nucleic acid sequence encoding one or more nuclear localization signals.

6. The isolated or recombinant nucleic acid sequence of claim 1, wherein the nucleic acid sequence is operably linked to one or more expression control sequences.

7. A vector comprising the isolated or recombinant nucleic acid sequence of claim 3.

8. The vector of claim 7, wherein the vector comprises a viral vector, liposomes, lipid nanoparticles (LNPs), cationic polymers, vesicles, or gold nanoparticles.

9. An isolated host cell comprising the isolated or recombinant nucleic acid sequence of claim 3.

10. The isolated host cell of claim 9, wherein the host cell comprises a prokaryotic cell, a mammalian cell, or a synthetic cell.

11. The vector of claim 8, wherein the vector comprises an LNP comprising:
   a) one or more ionizable lipids;
   b) one or more structural lipids;
   c) one or more PEGylated lipids; and
   d) one or more phospholipids.

12. A composition comprising the isolated or recombinant nucleic acid sequence of claim 1; and a pharmaceutically or veterinarily acceptable carrier.

13. A composition comprising the vector of claim 11; and a pharmaceutically or veterinarily acceptable carrier.

14. A polypeptide or an isolated polypeptide comprising:
   an amino acid sequence at least 95% identical to SEQ ID NO: 585 and comprising arginine (R) at position 169.

15. The polypeptide or isolated polypeptide of claim 1, wherein the polypeptide or isolated polypeptide comprises the amino acid sequence of SEQ ID NO:585.

16. The polypeptide or isolated polypeptide of claim 14, wherein the polypeptide or isolated polypeptide comprises the amino acid sequence of SEQ ID NO:585.

\* \* \* \* \*